United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 5

SEQ ID NO: 4084 - DNA, 3534 bp, Homo sapiens
agaggctgccgggaacgcgggcccagaggcggggcgagcgcgcgcggggcggaagtcggccaccttcctccgtcccggccgttagcccagccaagcccagccaagcccagccaagccccgccgatcgcgggcaccggagccagccccgcagcggagggaccacagagcaccagcctgcatggaacttccttcctcactcagcttcccacgttgccagctgggacaggggagatggagtaattttgctgtggaaagacttcacgtcttgccgaatgaaagtaagcaaagatactgctagagtcgggaatctagagtcgggaattcattaagccaagggagtaagaatggccacagagtagtgaaatactgtttcttctggaaaagtcagcctccagcgcctgcagcttccggaactaagatgtgactgggcttgcggaggcgctgactcctctcctccctccctggctgtgcaggtcccgcctgtctgtcacgctgatgcccgtgcagctgtctgagcacccggaatggaatgagtctatgcactccctccggatcagtgtggggggccttcctgtgctggcgtccatgaccaaggccgcggacccccgcttccgcccccgctggaaggtgatcctgacgttctttgtgggtgctgccatcctctggctgctctgctcccaccgcccggcccccggcaggccccccacccacaatgcacacaactggaggctcggccaggcgcccgccaactggtacaatgacacctaccccctgtctcccccacaaaggacaccggctgggattcggtatcgaatcgcagttatcgcagacctggacacagagtcaagggcccaagaggaaaacacctggttcagttacctgaaaaagggctacctgaccctgtcagacagtggggacaaggtggccgtggaatgggacaaagaccatggggtcctggagtcccacctggcggagaaggggagaggcatggagctatccgacctgattgttttcaatgggaaactctactccgtggatgaccggacgggggtcgtctaccagatcgaaggcagcaaagccgtgccctgggtgattctgtccgacggcgacggcaccgtggagaaaggcttcaaggccgaatggctggcagtgaaggacgagcgtctgtacgtgggcggcctgggcaaggagtggacgaccactacgggtgatgtggtgaacgagaacccggagtgggtgaaggtggtgggctacaagggcagcgtggaccacgagaactgggtgtccaactacaacgccctgcgggctgctgccggcatccagccgccaggctacctcatccatgagtctgcctgctggagtgacacgctgcagcgctggttcttcctgccgcgccgcgccagccaggagcgctacagcgagaaggacgacgagcgcaagggcgccaacctgctgctgagcgcctcccctgacttcggcgacatcgctgtgagccacgtcggggcggtggtccccactcacggcttctcgtccttcaagttcatccccaacaccgacgaccagatcattgtggccctcaaatccgaggaggacagcggcagagtcgcctcctacatcatggccttcacgctggacgggcgcttcctgttgccggagaccaagatcggaagcgtgaaatacgaaggcatcgagttcatttaactcaaaacggaaacactgagcaaggccatcaggactcagcttttataaaaacaagaggagtgcacttttgttttgttttgttctttttggaactgtgcctgggttggaggtctggacagggagcccagtcccgggccccatagtggtgcgggcactggacccccgggccccacggaggccgcggtctgaactgctttccatgctgccatctggtggtgatttcggtcacttcaggcattgactcaaggcctgcctaactggctgggtcgtttcttccatccgacctcgtttcttttctttcctatgttcttttgttcagtgaatatccctagagctcctaccatatgtcaggccctatgcctcaccctgagaacgcagtgagcatgaggtggacctgtttgctgggaaccccaggtcacccccttttcttcctactctgtgcctggagcatcatgtccacccctgcagatccttggaaaagaaaatgtttatgttgcagggtattgcatggtcacgagtgagggcaggcccctggggacacatctgcccacagctgcacaggccagggcgcaggcacatctgttggttctcaggcctcagataaaaccatctccgcatcatatggccagtgaccgctttctcccttcaagaaaattctgtggctgtgcagtactttgaagttttaattattaacctgctttaattaaagcagtttcctttcttataaagtggaatcaccaaatcttatcacacagagcacagtcctgtagttacccagcccgctccagcagtgcgggagattgtaaggaagcggtggcggctggtgaagcaagtctcacatgtcggcgttcttggccaatggatacaaagataaagaaaatgttgcctttttctaggaactgtcagaaatcctcatgcctttcaagacttctgtgaatgacttgaattttttattccctgcctagggtctgtgaacgaggcctgtctcttccctggggtttctttccatggcctttatttctcctcttccagtgggagttttgcaggctcttctctgtggaaacttcacgagcgttggctgggcctcggcttcgctggagtgtactccagggtgaaggcagagtgggatttgagacccaggttaggcacgacccaggctgagaagggacgtttccatcattcacagtgccctccccacagcactacctcaccccgacccccaccctcactcctaccccaccccgcgatcgtcaggggtgccacggtgggccggagggtgccggctctggctgtccctgtgccggtccctcacaaacctctccccctttgaaactcaagcacagctgcgaggagggcagcgaggagggacccctctctcatggttgtctctttcccccgctatgtcataggtagtggaggaagcgaaggaagtgaacgctgaatgtgacgcatttctgaagagctcagctgtcaccgggcatagcctggaagccccaagtctgttctgactttgcctggctgtctccttgacccgcctcctagatcattgtccttgatgtccaggctgggtcatttaaaatagagatgcaatcaggaaggttgggggacttgggactgtggctgaattgagaccttgctgatgtattcatgtcagcacctgagtcacagcccaggtgcccggaagcagcctcttcgcataggcagtgatttgcgattactttaaagctcaccttttttcttcccctctctgttcgctgctgtcagcataatgattgtgttccttccctatgggatccatctgttttgtaaacaataaagcgtctgagggagtgt

SEQ ID NO: 4085 - DNA, 1373 bp, Homo sapiens
agaggcggggcgagcgcgcgcggggcggaagtcggccaccttcctccgtcccggccgttagcccagccaagcccagccaagcccagccaagccccgccgatcgcgggcaccggagccagccccgcagcggagggaccacagagcaccagcctgcatggaacttccttcctcactcagcttcccacgttgccagctgggacaggggagatggagtaattttgctgtggaaagacttcacgtcttgccgaatgaaagtcccgcctgtctgtcacgctgatgcccgtgcagctgtctgagcacccggaatggaatgagtctatgcactccctccggatcagtgtggggggccttcctgtgctggcgtccatgaccaaggccgcggacccccgcttccgcccccggtctcccccacaaaggacaccggctgggattcggtatcgaatcgcagttatcgcagacctggacacagagtcaagggcccaagaggaaaacacctggttcagttacctgaaaaagggctacctgaccctgtcagacagtggggacaaggtggccgtggaatgggacaaagaccatggggtcctggagtcccacctggcggagaaggggagaggcatggagctatccgacctgattgttttcaatgggaaactctactccgtggatgaccggacgggggtcgtctaccagatcgaaggcagcaaagccgtgccctgggtgattctgtccgacggcgacggcaccgtggagaaaggcttcaaggccgaatggctggcagtgaaggacgagcgtctgtacgtgggcggcctgggcaaggagtggacgaccactacgggtgatgtggtgaacgagaacccggagtgggtgaaggtggtgggctacaagggcagcgtggaccacgagaactgggtgtccaactacaacgccctgcgggctgctgccggcatccagccgccaggctacctcatccatgagtctgcctgctggagtgacacgctgcagcgctggttcttcctgccgcgccgcgccagccaggagcgctacagcgagaaggacgacgagcgcaagggcgccaacctgctgctgagcgcctcccctgacttcggcgacatcgctgtgagccacgtcggggcggtggtccccactcacggcttctcgtccttcaagttcatccccaacaccgacgaccagatcattgtggccctcaaatccgaggaggacagcggcagagtcgcctcctacatcatggccttcacgctggacgggcgcttcctgttgccggagaccaagatcggaagcgtgaaatacgaaggcatcgagttcatttaactcaaaacggaaacactgagcaaggccatcaggactcagctttt

SEQ ID NO: 4086 - DNA, 3478 bp, Homo sapiens
agaggctgccgggaacgcgggcccagaggcggggcgagcgcgcgcggggcggaagtcggccaccttcctccgtcccggccgttagcccagccaagcccagccaagcccagccaagccccgccgatcgcgggcaccggagccagccccgcagcgggagcctaacccagaggaagtggagactcctttactgcacatctgtctgctccaggccaggcactgttctaggagccaggatacagaggtggagacagaaacaaacaaaccgataactgtatacaatactctaacgtcagagggaccacagagcaccagcctgcatggaacttccttcctcactcagcttcccacgttgccagctgggacaggggagatggagtaattttgctgtggaaagacttcacgtcttgccgaatgaaagtcccgcctgtctgtcacgctgatgcccgtgcagctgtctgagcacccggaatggaatgagtctatgcactccctccggatcagtgtggggggccttcctgtgctggcgtccatgaccaaggccgcggacccccgcttccgcccccgctggaaggtgatcctgacgttctttgtgggtgctgccatcctctggctgctctgctcccaccgcccggcccccggcaggccccccacccacaatgcacacaactggaggctcggccaggcgcccgccaactggtacaatgacacctaccccctgtctcccccacaaaggacaccggctgggattcggtatcgaatcgcagttatcgcagacctggacacagagtcaagggcccaagaggaaaacacctggttcagttacctgaaaaagggctacctgaccctgtcagacagtggggacaaggtggccgtggaatgggacaaagaccatggggtcctggagtcccacctggcggagaaggggagaggcatggagctatccgacctgattgttttcaatgggaaactctactccgtggatgaccggacgggggtcgtctaccagatcgaaggcagcaaagccgtgccctgggtgattctgtccgacggcgacggcaccgtggagaaaggcttcaaggccgaatggctggcagtgaaggacgagcgtctgtacgtgggcggcctgggcaaggagtggacgaccactacgggtgatgtggtgaacgagaacccggagtgggtgaaggtggtgggctacaagggcagcgtggaccacgagaactgggtgtccaactacaacgccctgcgggctgctgccggcatccagccgccaggctacctcatccatgagtctgcctgctggagtgacacgctgcagcgctggttcttcctgccgcgccgcgccagccaggagcgctacagcgagaaggacgacgagcgcaagggcgccaacctgctgctgagcgcctcccctgacttcggcgacatcgctgtgagccacgtcggggcggtggtccccactcacggcttctcgtccttcaagttcatccccaacaccgacgaccagatcattgtggccctcaaatccgaggaggacagcggcagagtcgcctcctacatcatggccttcacgctggacgggcgcttcctgttgccggagaccaagatcggaagcgtgaaatacgaaggcatcgagttcatttaactcaaaacggaaacactgagcaaggccatcaggactcagcttttataaaaacaagaggagtgcacttttgttttgttttgttctttttggaactgtgcctgggttggaggtctggacagggagcccagtcccgggccccatagtggtgcgggcactggacccccgggccccacggaggccgcggtctgaactgctttccatgctgccatctggtggtgatttcggtcacttcaggcattgactcaaggcctgcctaactggctgggtcgtttcttccatccgacctcgtttcttttctttcctatgttcttttgttcagtgaatatccctagagctcctaccatatgtcaggccctatgcctcaccctgagaacgcagtgagcatgaggtggacctgtttgctgggaaccccaggtcacccccttttcttcctactctgtgcctggagcatcatgtccacccctgcagatccttggaaaagaaaatgtttatgttgcagggtattgcatggtcacgagtgagggcaggcccctggggacacatctgcccacagctgcacaggccagggcgcaggcacatctgttggttctcaggcctcagataaaaccatctccgcatcatatggccagtgaccgctttctcccttcaagaaaattctgtggctgtgcagtactttgaagttttaattattaacctgctttaattaaagcagtttcctttcttataaagtggaatcaccaaatcttatcacacagagcacagtcctgtagttacccagcccgctccagcagtgcgggagattgtaaggaagcggtggcggctggtgaagcaagtctcacatgtcggcgttcttggccaatggatacaaagataaagaaaatgttgcctttttctaggaactgtcagaaatcctcatgcctttcaagacttctgtgaatgacttgaattttttattccctgcctagggtctgtgaacgaggcctgtctcttccctggggtttctttccatggcctttatttctcctcttccagtgggagttttgcaggctcttctctgtggaaacttcacgagcgttggctgggcctcggcttcgctggagtgtactccagggtgaaggcagagtgggatttgagacccaggttaggcacgacccaggctgagaagggacgtttccatcattcacagtgccctccccacagcactacctcaccccgacccccaccctcactcctaccccaccccgcgatcgtcaggggtgccacggtgggccggagggtgccggctctggctgtccctgtgccggtccctcacaaacctctccccctttgaaactcaagcacagctgcgaggagggcagcgaggagggacccctctctcatggttgtctctttcccccgctatgtcataggtagtggaggaagcgaaggaagtgaacgctgaatgtgacgcatttctgaagagctcagctgtcaccgggcatagcctggaagccccaagtctgttctgactttgcctggctgtctccttgacccgcctcctagatcattgtccttgatgtccaggctgggtcatttaaaatagagatgcaatcaggaaggttgggggacttgggactgtggctgaattgagaccttgctgatgtattcatgtcagcacctgagtcacagcccaggtgcccggaagcagcctcttcgcataggcagtgatttgcgattactttaaagctcaccttttttcttcccctctctgttcgctgctgtcagcataatgattgtgttccttccctatgggatccatctgttttgtaaacaataaagcgtctgagggagtgt

SEQ ID NO: 4087 - DNA, 1138 bp, Homo sapiens
gcgcgcggggcggaagtcggccaccttcctccgtcccggccgttagcccagccaagcccagccaagcccagccaagccccgccgatcgcgggcaccggagccagccccgcagcgggagcctaacccagaggaagtggagactcctttactgcacatctgtctgctccaggccaggcactgttctaggagccaggatacagaggtggagacagaaacaaacaaaccgataactgtatacaatactctaacgtcagagggaccacagagcaccagcctgcatggaacttccttcctcactcagcttcccacgttgccagctgggacaggggagatggagtaattttgctgtggaaagacttcacgtcttgccgaatgaaagtcccgcctgtctgtcacgctgatgcccgtgcagctgtctgagcacccggaatggaatgagtctatgcactccctccggatcagtgtggggggccttcctgtgctggcgtccatgaccaaggccgcggacccccgcttccgcccccgctggaaggtgatcctgacgttctttgtgggtgctgccatcctctggctgctctgctcccaccgcccggcccccggcaggccccccacccacaatgcacacaactggaggctcggccaggcgcccgccaactggtacaatgacacctaccccctgtctcccccacaaaggacaccggctgggattcggtatcgaatcgcagttatcgcagacctggacacagagtcaagggcccaagaggaaaacacctggttcagttacctgaaaaagggctacctgaccctgtcagacagtggggacaaggtggccgtggaatgggacaaagaccatggggtcctggagtcccacctggcggagaaggggagaggcatggagctatccgacctgattgttttcaatgggaaactctactccgtggatgaccggacgggggtcgtctaccagatcgaaggcagcaaagccgtgccctgggtgattctgtccgacggcgacggcaccgtggagaaaggtgtgggtggggagtgggaggcagtgcgggagattgtaaggaagcggtggcggctggtgaagcaagtctcacatgtcggcgttcttggccaatggatacaaagataa

SEQ ID NO: 4088 - DNA, 925 bp, Homo sapiens
aggcagcagcatccgccgaggcccacccgggccacccccggggttccaggcctggcatggttcagggcccatggggaactgtgccaagcggccctggcgccggggccctaaggaccccttgcagtggctcggctccccaccaaggggctcctgccccagccccagctccagccccaaggagcagggggaccccgcgccaggcgtccagggctactcggtgctcaacagcctggtggggcctgcctgcatcttcctgcggcccagcattgccgccacccaactcgaccgggagctgcggcccgaggagattgaagagctgcaggtcgccttccaggagtttgaccgagaccgggacggctacattggctgccgggagctgggtgcctgcatgcggaccctgggctacatgcccaccgagatggagctcatcgagatctcacaacaaatcagtggcggaaaggtggactttgaagacttcgtggagctgatgggccccaagctgctggcagagacggcagacatgatcggtgtccgggagctacgggacgccttccgggagttcgacaccaatggggacggccgcatcagcgtgggcgagctccgggcggccctcaaggccctgctgggggagcgcctcagccagcgggaggtggacgagatcctccaggacgtggacctcaatggggacggtctggtcgacttcgaagagtttgtgcgaatgatgtctcggtgagcctgtacagaagctggaggcagcataaaggactcaaggaccacagcctctgcccaccagcatgttccttgaagcccatcgcctctagcggggaccctcctttcctccccatcccacctgtgtgcagtgcccttgcctgccttcacccccaccaccacttctccaataaagccgcctggccttgtctctgtc

SEQ ID NO: 4089 - DNA, 3826 bp, Homo sapiens
gtgcgcacgtcaaagccgggctcgggccgcaagcggggcgaggggttcggggagcggcgcggcctgggagacacagagccttcaggcgccggggcgggggcacaggcgaagactaaggcggcgccgggccccacagcagcagccgcagcccaagcgagcgcagcagcgcggcggcagccgcgggagcccctgggcagccgtccgcccgcgcagccgccgccgccgcgggagcccgtcgccgggagcaggagcgggcggaagacaacggaggggccgagcgtccgagccactccgcggggaccgaacgagcagcccgaagcggcggcggccgaggacggggacagcgacgacgcggaggcagagaagggaacgcccggcccagccccgtagcacaggcggagtgcagcggaggcccctgccgctgccgtcatgccgttcccgtttgggaagtctcacaaatctccagcagacattgtgaagaatctgaaggagagcatggctgttctggaaaagcaagacatttctgataaaaaagcagaaaaggctacagaagaagtttccaaaaatctggttgccatgaaagaaattctgtatggcacaaatgaaaaagagcctcagacagaagcagtagctcaacttgctcaagaactctataatagtgggctccttagcaccctggtagctgatttacagctcattgactttgagggcaaaaaagacgtggctcaaattttcaacaatattctcagaagacaaattggtacgagaactcctactgttgaatacatctgcacccaacagaatattttgttcatgttattgaaagggtatgaatctccagaaatagctctaaattgtggaataatgttaagagaatgcatcagacatgaaccacttgcaaaaatcattttgtggtcggaacagttttatgatttcttcagatatgtcgaaatgtcaacatttgacatagcttcagatgcatttgccacattcaaggatttacttacaagacataaattgctcagtgcagaatttttggaacagcattatgatagatttttcagtgaatatgagaagttacttcattcagaaaattatgtgacaaaaagacagtcactgaagcttctcggtgaactactactagatagacacaacttcacaattatgacaaaatacatcagtaaacctgagaacctcaaattaatgatgaacctgctgcgagacaaaagtcgcaacatccagtttgaggcctttcacgtttttaaggtgtttgtagccaatcctaacaagacgcagcccatcctagacatcctcctcaagaaccaggccaaactcatagagttcctcagcaagtttcagaacgacaggacggaggatgagcagtttaacgacgagaagacctatttagttaaacagatcagggatttgaagagaccagctcagcaagaagcttaatctccaataaacatctatgttaaatccaaattcagcatttgctgttagctattcagcatcaggcactcttattgattcatgaggaacattactgctaatctgctgttaagtgaacggtttttcattttacccttttgtttttcagtccaggttggagatcgtagctgctgctgcttgcacactagggcacatgtgggctttctcttgatctttgtgtcatttcagaattcaaagactgtgctacgggagttctgaacatggctgggttcatgaaggcaaatgtatggatgagagtgtggtttaggaaagagggcactgatatcagattagacctatgtgtttgcacccatctttgttggcgatctgagtgcagtgtggcaagtgcacacctggcatccctgcgtcagatcgcgcaccttcaggtcgcgcaccttcgctgaaggaagatgacgcagagctttatctgaaatcagaggggagctatccaaaatgggagtttgggggcagctaaagttgacatgcgaataaattgatactgaaacttagcaacttcttaaaagtgtaaagaagcctcataagatcataaggaaaatgtatatatgcttttcacagctttctagaattttttgacatttgattttcttgagacttgtaaacctggatatgttgaagggtatttgttaattttacttttcaaagatactttaaaacagtagagctagcaatgacaccttgcatttcatttcaacactgcttcaaggtttcttttgtatataattcttagaatgctcatttcttttaaatggtttaatttgtacagcagaggaatgttattgtagtagtatgtaactattacctaatactgagtttttgcaaaaaacaatgaatgctcatatgtaattgaaatacttcagatcacatgaaaatgctgatttaacatttaagtatcacagcattaaaagaaaaagaaagtaaaccagtcctttgtattcagttacctaatggggtgccatcaataagctgcgatacagccctggagctcagtcagccacaccttcctgcatcctattggccttattcattttaaatgagttaatgaatctgccagatctgtgaatgatagagattatgctaaattaatgctgattctttgtgtgtgtgggaaatctctgtagagcaccttttctttcttagactaagtaacccagtacaatagttgtgaactgaataattaaaactttggcttctcttaggaaaagacgacttcctagtcataggtgtcctatggggaaatttattttttttaatgtcctgttccttaatgctgcaaattatcagtatttataaagtaactgattttgcaccacttttttgttactgtgaccacggcagaacaatgtcttctagactatatctatgtaaagttattagaatggtatctgttcattttagtgatatgaagatcacaactaacaactgacaaatcagagtttgccagttcaaattcagcatggctgcagctgattaagaaattgatatgattattctttgctagcctctcttactaatggaattatatactggccagtaaaatgggcctcccaattgctgtttcagcaggttttaaaccttcaggaacaccagttaggaaaatagctccagaaaatatagatatattttatttttattaaaatggcagtctacatcataattggcatttctcaagactgtctttaccagaatctgtgtgaaataaggcaatctagtctccttgaaaaaaaaatctcttggatgtttaggaaggaagacttggccgtgatgtggtgtcctggctttgtggtgtagtgctgtgtgtatggagttagtgtaaaaacatggattacaccaagtggaagaaacgtcttcttgccaagctcattcttagaacttacacatctagaacagcttccactttggcagtgaggtcgtagccttttaggtggaagaagtgagggtgcagcgtgtcagacacaacattcatgttactcttacattggaatctgaaggtagttcagacttcgtgggttttgtttttaagcaaaacaatgtgaaaacatttaagtttgaaatgttgcatttgaagttatgatcatttaatatattcatattaccaagactattatactggaagtggtttttgtgttataaaggtttaattttacataaggcagttacttaatgtgatttttaacccttaaaaaagtggagatgtatacatttgttaacaatgccatgaaagcattttctttctcctaaggaaaagtgaatttcttatcagaatatctggctggccctgtaatttaaattaaaataaaattttggagaaacagca

SEQ ID NO: 4090 - DNA, 1626 bp, Homo sapiens
agtcgggcgggcggggaagtgcgggccgggtcaactgtcaccggctgcacccgggcttcagcgcctcgctcccgcccctggtaaacttcctgttgtcgggaggcagataccagctttgtgaccaattcaggaaaatgcctaactgatttctggttaggaattgggcggtcggagcgttctggagttcaatggaaccaccccaagcgcagactgcgtgcaggcgccgtagtcggcccgcaccggagggattcaaaggtgaagcgggccccggtcccctcccccgaggagcttaggctctggtgtgagagataagacgagaacacaaataactgcgataccgggaaggaggtgataagtcctgtgaaagaacgacggagtgctagaacggcacccggaaaaaccgaaccgatcacttctgcctcgcagaaacctggaaggcttcctgggcgggggatgctgagcagagtcttgaaggcctgatgggatttaggagaggaggattgcagaagaggtagcacaggcggagtgcagcggaggcccctgccgctgccgtcatgccgttcccgtttgggaagtctcacaaatctccagcagacattgtgaagaatctgaaggagagcatggctgttctggaaaagcaagacatttctgataaaaaagcagaaaaggctacagaagaagtttccaaaaatctggttgccatgaaagaaattctgtatggcacaaatgaaaaagagcctcagacagaagcagtagctcaacttgctcaagaactctataatagtgggctccttagcaccctggtagctgatttacagctcattgactttgagggcaaaaaagacgtggctcaaattttcaacaatattctcagaagacaaattggtacgagaactcctactgttgaatacatctgcacccaacagaatattttgttcatgttattgaaagggtatgaatctccagaaatagctctaaattgtggaataatgttaagagaatgcatcagacatgaaccacttgcaaaaatcattttgtggtcggaacagttttatgatttcttcagatatgtcgaaatgtcaacatttgacatagcttcagatgcatttgccacattcaaggatttacttacaagacataaattgctcagtgcagaatttttggaacagcattatgatagatttttcagtgaatatgagaagttacttcattcagaaaattatgtgacaaaaagacagtcactgaagcttctcggtgaactactactagatagacacaacttcacaattatgacaaaatacatcagtaaacctgagaacctcaaattaatgatgaacctgctgcgagacaaaagtcgcaacatccagtttgaggcctttcacgtttttaaggtgtttgtagccaatcctaacaagacgcagcccatcctagacatcctcctcaagaaccaggccaaactcatagagttcctcagcaagtttcagaacgacaggacggaggatgagcagtttaacgacgagaagacctatttagttaaacagatcagggatttgaagagaccagctcagcaagaagcttaatctccaataaacatctatgttaaatccaaattcagcatttgctgtt

SEQ ID NO: 4091 - DNA, 1324 bp, Homo sapiens
agtcgggcgggcggggaagtgcgggccgggtcaactgtcaccggctgcacccgggcttcagcgcctcgctcccgcccctggtaaacttcctgttgtcgggaggcagataccagctttgtgaccaattcaggaaaatgcctaactgatttctggttaggaattgggcggtcggagcgttctggagttcaatggaaccaccccaagcgcagactgcgtgcaggcgccgtagtcggcccgcaccggagggattcaaaggtagcacaggcggagtgcagcggaggcccctgccgctgccgtcatgccgttcccgtttgggaagtctcacaaatctccagcagacattgtgaagaatctgaaggagagcatggctgttctggaaaagcaagacatttctgataaaaaagcagaaaaggctacagaagaagtttccaaaaatctggttgccatgaaagaaattctgtatggcacaaatgaaaaagagcctcagacagaagcagtagctcaacttgctcaagaactctataatagtgggctccttagcaccctggtagctgatttacagctcattgactttgagggcaaaaaagacgtggctcaaattttcaacaatattctcagaagacaaattggtacgagaactcctactgttgaatacatctgcacccaacagaatattttgttcatgttattgaaagggtatgaatctccagaaatagctctaaattgtggaataatgttaagagaatgcatcagacatgaaccacttgcaaaaatcattttgtggtcggaacagttttatgatttcttcagatatgtcgaaatgtcaacatttgacatagcttcagatgcatttgccacattcaaggatttacttacaagacataaattgctcagtgcagaatttttggaacagcattatgatagatttttcagtgaatatgagaagttacttcattcagaaaattatgtgacaaaaagacagtcactgaagcttctcggtgaactactactagatagacacaacttcacaattatgacaaaatacatcagtaaacctgagaacctcaaattaatgatgaacctgctgcgagacaaaagtcgcaacatccagtttgaggcctttcacgtttttaaggtgtttgtagccaatcctaacaagacgcagcccatcctagacatcctcctcaagaaccaggccaaactcatagagttcctcagcaagtttcagaacgacaggacggaggatgagcagtttaacgacgagaagacctatttagttaaacagatcagggatttgaagagaccagctcagcaagaagcttaa

SEQ ID NO: 4092 - DNA, 3520 bp, Homo sapiens
agcgctctcggcttgtctcgcgcactgtagctgagccaatggagttactcgtagtcgagaggccggcatcactggagtggtggcgcagctgtttcctccggatatccatcaaatattgagaagaaagaatatcaggagcaaagtgttctaagttgctgttcagaacgtaaagatgcgaaccccaaatcagtggtttgttcattcttcatgcaagagcaatgcactaaaggagagaagcgtaagttttctcttatttctgatggggaaacaagcacacgcatacacactcttgtgatggagatagattttacaagcattccatattggaagaagagatttctacacatgaaaaaaatgcctttgtttagtaaatcacacaaaaatccagcagaaattgtgaaaatcctgaaagacaatttggccattttggaaaagcaagacaaaaagacagacaaggcttcagaagaagtgtctaaatcactgcaagcaatgaaagaaattctgtgtggtacaaacgagaaagaacccccaacagaagcagtggctcagctagcacaagaactctacagcagtggcctgctagtgacactgatagctgacctgcagctgatagactttgagggaaaaaaagatgtgacccagatatttaacaacatcttgagaagacagataggcactcggagtcctactgtggagtatattagtgctcatcctcatatcctgtttatgctcctcaaaggatatgaagccccacagattgccttacgttgtgggattatgctgagagaatgtattcgacatgaaccacttgccaaaatcatcctcttttctaatcaattcagagatttctttaagtacgtggagttgtcaacatttgatattgcttcagatgcctttgctactttcaaggatttactaaccagacataaagtgttggtagcagacttcttagaacaaaattacgacactatttttgaagactatgagaaattgcttcagtctgagaattatgttactaagagacagtctttaaagctgctaggggagctgatcctggaccgtcacaactttgccatcatgacaaagtatatcagcaagccggagaacctgaaactcatgatgaacctccttcgggataaaagtcccaacatccagtttgaagcctttcatgtttttaaggtgtttgtggccagtcctcacaaaacacagcctattgtggagatcctgttaaaaaatcagcccaaactcattgagtttctgagcagcttccaaaaagaaaggacggatgatgagcagttcgctgacgagaagaactacttgattaaacagatccgagacttgaagaaaacggccccttgaagagctccccggcccctgtcacagtcagtcgtctcatttgtccagtttgtacagtgtgtcatttcagaaagtcatcattcttgggaagactttggaggtgcctattttttctgctgtaattgttctgggtagatggagtataaacatttgaatggaaaaaaattaacctagaataatatattcattttagtcaagtctgtgattatttatgtgaaatgagaaccattgtatcagatgttgataaaagcaattttaacttgcagatgtgagcccctgggcacaatgagccgctaaatgggagctcaattgacaggcatcaccaagtcttcaaggaggactgagttctcaggggagaactgggaatggggccagggtgcaaaaatgctttgcccatctgtaggtagacacacagatcgctcagggcactgagagatcccagaaggtaacgttaatgttttcagtcattgtgtgtcctttgttgctgccaatgtctttggactgtaatcagtgcatccacacctcccaggatccagtgctccctctcagctcagtctcccctctctccctgtcctgcattccatcccagctcctcagcatggcctcagtgggcgcacccatgcctcccgcagtccaggtgagcaggggagcaactgagcaggaagaggatggatcaacaagggtcacggggaataggggacccacggggtgtgacctgcttgctagagaactgtgaacatgtggctctggatagagtgactgctgctccatattagcttccagagggtgagtgagggacagaatatttccttcataatggtcatgggtgaatgctttctgctgtaagtgtcttttagagtaggaatcagcatagtgggatgcccagcaggcacaaaccatgggtccagggagtctcagcggggaacttctatcagtatcaataaccattggaaggagaaatgattcatgtgtgaaaaaattctcagatccatcaataaatttttttcagagccattgtatcagatgttgataaaagcaatttttttctaataagctgtcattctataattgcccatcacagtctttagtgaacacatagaaagcctatacagttttggtcctgaatagtctcttgtgactaggatgattgaggtgttaattcctcttccttataaaaaggcttggaatcaaaaatattttaaaaggccgtggtttcgtttcagacatcaaccatctaaaacgggattttaaagcgatattttacaagaatgaaaggcacaattgttgatctgtattttttacacttcagtttctaaatcatgaatcgttgccttccacaggaaccctcccttatacattacttgagtgttgtgtagtttttcttcagccaggtatttctctgcctagagaggggaagagaaatgtgttctccaggactgatcccctttgtagattttgtacctgaagagttacctggcagggcaccacccttggctaggcccaggtgtgtgtttctttcttgcctggcatggaccccgaggcaggtgatgtggggcctggcgcacctccccgctttggcagctgtggcctccctggccagtgcccttgcaggaggccggccggcagcctgatgacccgtactctttagtcactgacgtcagattatttttataacgttccctgacagttcagagtcccttcgaattgcacttttctggtttcgcttatttaattaaaagagatgagtgtaagtataaaaaatgaaggtgaaataaccattggaattgtatttggttacttaatactgttccacaacatcttgggacgtctgttttcctttggagagtgaggccttgttattattcttttctgataaagaaaacattttatttcctttgggcttgcattagctctttcctagcaacccattatcccagctcagtacctttcaaacagaaaactagagtctggggttttgttgtgatctgaatttgtaagttattaatgtgaaagggggagcaggaagctccccctttgcacaaagggggatttgtttgcacaaagttcactgtaaatactgtgagaattgaattctgaaaaggtcatatttagtgatttcaaaagcacacatttaaatgaagactgactaaataaaaggtaccac

SEQ ID NO: 4093 - DNA, 3676 bp, Homo sapiens
gtgacgttacaggactgaggagggaggaagtaaaagggagctgtgactgtggtacgtatctgaaagcaagtgttagagagggagtggagaacgcataagcaagctggtttgaccagaaacagaactgcctgtgacagattaagagacaagcaaggcttggaatctgagagcaagcaaagagagtggaaatttacagctgccctatgtgagtgttcaagtgatcattttctggtaacgttttccagtggtaactgttactcttcaaaaagagggacagaaagtcaagacctaattgtggaaactcttttctctgccacgcttggtaataggaggcaacctctattaaatggacgataaaggctacttcatctaaagtgctttgagctcaagaaagagctgtcttcagcacctcaccatgtgtctacattttgttgcttagaaaagcctaggcatttctgtaacatttgcattccatattggaagaagagatttctacacatgaaaaaaatgcctttgtttagtaaatcacacaaaaatccagcagaaattgtgaaaatcctgaaagacaatttggccattttggaaaagcaagacaaaaagacagacaaggcttcagaagaagtgtctaaatcactgcaagcaatgaaagaaattctgtgtggtacaaacgagaaagaacccccaacagaagcagtggctcagctagcacaagaactctacagcagtggcctgctagtgacactgatagctgacctgcagctgatagactttgagggaaaaaaagatgtgacccagatatttaacaacatcttgagaagacagataggcactcggagtcctactgtggagtatattagtgctcatcctcatatcctgtttatgctcctcaaaggatatgaagccccacagattgccttacgttgtgggattatgctgagagaatgtattcgacatgaaccacttgccaaaatcatcctcttttctaatcaattcagagatttctttaagtacgtggagttgtcaacatttgatattgcttcagatgcctttgctactttcaaggatttactaaccagacataaagtgttggtagcagacttcttagaacaaaattacgacactatttttgaagactatgagaaattgcttcagtctgagaattatgttactaagagacagtctttaaagctgctaggggagctgatcctggaccgtcacaactttgccatcatgacaaagtatatcagcaagccggagaacctgaaactcatgatgaacctccttcgggataaaagtcccaacatccagtttgaagcctttcatgtttttaaggtgtttgtggccagtcctcacaaaacacagcctattgtggagatcctgttaaaaaatcagcccaaactcattgagtttctgagcagcttccaaaaagaaaggacggatgatgagcagttcgctgacgagaagaactacttgattaaacagatccgagacttgaagaaaacggccccttgaagagctccccggcccctgtcacagtcagtcgtctcatttgtccagtttgtacagtgtgtcatttcagaaagtcatcattcttgggaagactttggaggtgcctattttttctgctgtaattgttctgggtagatggagtataaacatttgaatggaaaaaaattaacctagaataatatattcattttagtcaagtctgtgattatttatgtgaaatgagaaccattgtatcagatgttgataaaagcaattttaacttgcagatgtgagcccctgggcacaatgagccgctaaatgggagctcaattgacaggcatcaccaagtcttcaaggaggactgagttctcaggggagaactgggaatggggccagggtgcaaaaatgctttgcccatctgtaggtagacacacagatcgctcagggcactgagagatcccagaaggtaacgttaatgttttcagtcattgtgtgtcctttgttgctgccaatgtctttggactgtaatcagtgcatccacacctcccaggatccagtgctccctctcagctcagtctcccctctctccctgtcctgcattccatcccagctcctcagcatggcctcagtgggcgcacccatgcctcccgcagtccaggtgagcaggggagcaactgagcaggaagaggatggatcaacaagggtcacggggaataggggacccacggggtgtgacctgcttgctagagaactgtgaacatgtggctctggatagagtgactgctgctccatattagcttccagagggtgagtgagggacagaatatttccttcataatggtcatgggtgaatgctttctgctgtaagtgtcttttagagtaggaatcagcatagtgggatgcccagcaggcacaaaccatgggtccagggagtctcagcggggaacttctatcagtatcaataaccattggaaggagaaatgattcatgtgtgaaaaaattctcagatccatcaataaatttttttcagagccattgtatcagatgttgataaaagcaatttttttctaataagctgtcattctataattgcccatcacagtctttagtgaacacatagaaagcctatacagttttggtcctgaatagtctcttgtgactaggatgattgaggtgttaattcctcttccttataaaaaggcttggaatcaaaaatattttaaaaggccgtggtttcgtttcagacatcaaccatctaaaacgggattttaaagcgatattttacaagaatgaaaggcacaattgttgatctgtattttttacacttcagtttctaaatcatgaatcgttgccttccacaggaaccctcccttatacattacttgagtgttgtgtagtttttcttcagccaggtatttctctgcctagagaggggaagagaaatgtgttctccaggactgatcccctttgtagattttgtacctgaagagttacctggcagggcaccacccttggctaggcccaggtgtgtgtttctttcttgcctggcatggaccccgaggcaggtgatgtggggcctggcgcacctccccgctttggcagctgtggcctccctggccagtgcccttgcaggaggccggccggcagcctgatgacccgtactctttagtcactgacgtcagattatttttataacgttccctgacagttcagagtcccttcgaattgcacttttctggtttcgcttatttaattaaaagagatgagtgtaagtataaaaaatgaaggtgaaataaccattggaattgtatttggttacttaatactgttccacaacatcttgggacgtctgttttcctttggagagtgaggccttgttattattcttttctgataaagaaaacattttatttcctttgggcttgcattagctctttcctagcaacccattatcccagctcagtacctttcaaacagaaaactagagtctggggttttgttgtgatctgaatttgtaagttattaatgtgaaagggggagcaggaagctccccctttgcacaaagggggatttgtttgcacaaagttcactgtaaatactgtgagaattgaattctgaaaaggtcatatttagtgatttcaaaagcacacatttaaatgaagactgactaaataaaaggtaccacaca

SEQ ID NO: 4094 - DNA, 3613 bp, Homo sapiens
gtgacgttacaggactgaggagggaggaagtaaaagggagctgtgactgtggtacgtatctgaaagcaagtgttagagagggagtggagaacgcataagcaagctggtttgaccagaaacagaactgcctgtgacagattaagagacaagcaaggcttggaatctgagagcaagcaaagagagtggaaatttacagctgccctatgtgagtgttcaagtgatcattttctggtaacgttttccagtggtaactgttactcttcaaaaagagggacagaaagtcaagacctaattgtggaaactcttttctctgccacgcttggtaataggaggcaacctctattaaatggacgataaaggctacttcatctaaagtgctttgagctcaagaaagagctgtcttcagcacctcaccatgtgtctacattttgttgcttagaaaagcctaggcatttctgtaacatttgcattccatattggaagaagagatttctacacatgaaaaaaatgcctttgtttagtaaatcacacaaaaatccagcagaaattgtgaaaatcctgaaagacaatttggccattttggaaaagcaagacaaaaagacagacaaggcttcagaagaagtgtctaaatcactgcaagcaatgaaagaaattctgtgtggtacaaacgagaaagaacccccaacagaagcagtggctcagctagcacaagaactctacagcagtggcctgctagtgacactgatagctgacctgcagctgatagactttgagggaaaaaaagatgtgacccagatatttaacaacatcttgagaagacagataggcactcggagtcctactgtggagtatattagtgctcatcctcatatcctgtttatgctcctcaaaggatatgaagccccacagattgccttacgttgtgggattatgctgagagaatgtattcgacatgaaccacttgccaaaatcatcctcttttctaatcaattcagagatttctttaagtacgtggagttgtcaacatttgatattgcttcagatgcctttgctactttcaagatttttgaagactatgagaaattgcttcagtctgagaattatgttactaagagacagtctttaaagctgctaggggagctgatcctggaccgtcacaactttgccatcatgacaaagtatatcagcaagccggagaacctgaaactcatgatgaacctccttcgggataaaagtcccaacatccagtttgaagcctttcatgtttttaaggtgtttgtggccagtcctcacaaaacacagcctattgtggagatcctgttaaaaaatcagcccaaactcattgagtttctgagcagcttccaaaaagaaaggacggatgatgagcagttcgctgacgagaagaactacttgattaaacagatccgagacttgaagaaaacggccccttgaagagctccccggcccctgtcacagtcagtcgtctcatttgtccagtttgtacagtgtgtcatttcagaaagtcatcattcttgggaagactttggaggtgcctattttttctgctgtaattgttctgggtagatggagtataaacatttgaatggaaaaaaattaacctagaataatatattcattttagtcaagtctgtgattatttatgtgaaatgagaaccattgtatcagatgttgataaaagcaattttaacttgcagatgtgagcccctgggcacaatgagccgctaaatgggagctcaattgacaggcatcaccaagtcttcaaggaggactgagttctcaggggagaactgggaatggggccagggtgcaaaaatgctttgcccatctgtaggtagacacacagatcgctcagggcactgagagatcccagaaggtaacgttaatgttttcagtcattgtgtgtcctttgttgctgccaatgtctttggactgtaatcagtgcatccacacctcccaggatccagtgctccctctcagctcagtctcccctctctccctgtcctgcattccatcccagctcctcagcatggcctcagtgggcgcacccatgcctcccgcagtccaggtgagcaggggagcaactgagcaggaagaggatggatcaacaagggtcacggggaataggggacccacggggtgtgacctgcttgctagagaactgtgaacatgtggctctggatagagtgactgctgctccatattagcttccagagggtgagtgagggacagaatatttccttcataatggtcatgggtgaatgctttctgctgtaagtgtcttttagagtaggaatcagcatagtgggatgcccagcaggcacaaaccatgggtccagggagtctcagcggggaacttctatcagtatcaataaccattggaaggagaaatgattcatgtgtgaaaaaattctcagatccatcaataaatttttttcagagccattgtatcagatgttgataaaagcaatttttttctaataagctgtcattctataattgcccatcacagtctttagtgaacacatagaaagcctatacagttttggtcctgaatagtctcttgtgactaggatgattgaggtgttaattcctcttccttataaaaaggcttggaatcaaaaatattttaaaaggccgtggtttcgtttcagacatcaaccatctaaaacgggattttaaagcgatattttacaagaatgaaaggcacaattgttgatctgtattttttacacttcagtttctaaatcatgaatcgttgccttccacaggaaccctcccttatacattacttgagtgttgtgtagtttttcttcagccaggtatttctctgcctagagaggggaagagaaatgtgttctccaggactgatcccctttgtagattttgtacctgaagagttacctggcagggcaccacccttggctaggcccaggtgtgtgtttctttcttgcctggcatggaccccgaggcaggtgatgtggggcctggcgcacctccccgctttggcagctgtggcctccctggccagtgcccttgcaggaggccggccggcagcctgatgacccgtactctttagtcactgacgtcagattatttttataacgttccctgacagttcagagtcccttcgaattgcacttttctggtttcgcttatttaattaaaagagatgagtgtaagtataaaaaatgaaggtgaaataaccattggaattgtatttggttacttaatactgttccacaacatcttgggacgtctgttttcctttggagagtgaggccttgttattattcttttctgataaagaaaacattttatttcctttgggcttgcattagctctttcctagcaacccattatcccagctcagtacctttcaaacagaaaactagagtctggggttttgttgtgatctgaatttgtaagttattaatgtgaaagggggagcaggaagctccccctttgcacaaagggggatttgtttgcacaaagttcactgtaaatactgtgagaattgaattctgaaaaggtcatatttagtgatttcaaaagcacacatttaaatgaagactgactaaataaaaggtaccac

SEQ ID NO: 4095 - DNA, 468 bp, Homo sapiens
ggatttcttgtagaagccagttaaaaggagaacctagtatcacactaggcttctgaaaacaccaatcaagagttgcttaatgcaggggtcccttacccctgggctgcagacctgtacctgtccatggcctgttaggaaccgggcagcacagtaggagcattccatattggaagaagagatttctacacatgaaaaaaatgcctttgtttagtaaatcacacaaaaatccagcagaaattgtgaaaatcctgaaagacaatttggccattttggaaaagcaagacaaaaagacagacaaggcttcagaagaagtgtctaaatcactgcaagcaatgaaagaaattctgtgtggtacaaacgagaaagaacccccaacagaagcagtggctcagctagcacaagaactctacagcagtggcctgctagtgacactgatagctgacctgcagctgatagactttgaggtaa

SEQ ID NO: 4096 - DNA, 2416 bp, Homo sapiens
ccgcagtggcgcccgagcgcgccgcctcccgattgactgctagcgctctcggcttgtctcgcgcactgtagctgagccaatggagttactcgtagtcgagaggccggcatcactggagtggtggcgcagctgtttcctccggatatccatcaaatattgagaagaaagaatatcaggagcaaagtgttctaagttgctgttcagaacgtaaagatgcgaaccccaaatcagtggtttgttcattcttcatgcaagagcaatgcactaaaggagagaagcaagctgtggtgatcagtgactttggtgaaagctaagaaggttcaaacaaatttgcaaatgatatacaacttctaagcattccatattggaagaagagatttctacacatgaaaaaaatgcctttgtttagtaaatcacacaaaaatccagcagaaattgtgaaaatcctgaaagacaatttggccattttggaaaagcaagacaaaaagacagacaaggcttcagaagaagtgtctaaatcactgcaagcaatgaaagaaattctgtgtggtacaaacgagaaagaacccccaacagaagcagtggctcagctagcacaagaactctacagcagtggcctgctagtgacactgatagctgacctgcagctgatagactttgagggaaaaaaagatgtgacccagatatttaacaacatcttgagaagacagataggcactcggagtcctactgtggagtatattagtgctcatcctcatatcctgtttatgctcctcaaaggatatgaagccccacagattgccttacgttgtgggattatgctgagagaatgtattcgacatgaaccacttgccaaaatcatcctcttttctaatcaattcagagatttctttaagtacgtggagttgtcaacatttgatattgcttcagatgcctttgctactttcaaggatttactaaccagacataaagtgttggtagcagacttcttagaacaaaattacgacactatttttgaagactatgagaaattgcttcagtctgagaattatgttactaagagacagtctttaaagctgctaggggagctgatcctggaccgtcacaactttgccatcatgacaaagtatatcagcaagccggagaacctgaaactcatgatgaacctccttcgggataaaagtcccaacatccagtttgaagcctttcatgtttttaaggtgtttgtggccagtcctcacaaaacacagcctattgtggagatcctgttaaaaaatcagcccaaactcattgagtttctgagcagcttccaaaaagaaaggacggatgatgagcagttcgctgacgagaagaactacttgattaaacagatccgagacttgaagaaaacggccccttgaagagctccccggcccctgtcacagtcagtcgtctcatttgtccagtttgtacagtgtgtcatttcagaaagtcatcattcttgggaagactttggaggtgcctattttttctgctgtaattgttctgggtagatggagtataaacatttgaatggaaaaaaattaacctagaataatatattcattttagtcaagtctgtgattatttatgtgaaatgagaaccattgtatcagatgttgataaaagcaattttaacttgcagatgtgagcccctgggcacaatgagccgctaaatgggagctcaattgacaggcatcaccaagtcttcaaggaggactgagttctcaggggagaactgggaatggggccagggtgcaaaaatgctttgcccatctgtaggtagacacacagatcgctcagggcactgagagatcccagaaggtaacgttaatgttttcagtcattgtgtgtcctttgttgctgccaatgtctttggactgtaatcagtgcatccacacctcccaggatccagtgctccctctcagctcagtctcccctctctccctgtcctgcattccatcccagctcctcagcatggcctcagtgggcgcacccatgcctcccgcagtccaggtgagcaggggagcaactgagcaggaagaggatggatcaacaagggtcacggggaataggggacccacggggtgtgacctgcttgctagagaactgtgaacatgtggctctggatagagtgactgctgctccatattagcttccagagggtgagtgagggacagaatatttccttcataatggtcatgggtgaatgctttctgctgtaagtgtcttttagagtaggaatcagcatagtgggatgcccagcaggcacaaaccatgggtccagggagtctcagcggggaacttctatcagtatcaataaccattggaaggagaaatgattcatgtgtgaaaaaattctcagatccatcaataaatttttttcagagccattgta

SEQ ID NO: 4097 - DNA, 1627 bp, Homo sapiens
gagccaatggagttactcgtagtcgagaggccggcatcactggagtggtggcgcagctgtttcctccggatatccatcaaatattgagaagaaagaatatcaggagcaaagtgttctaagttgctgttcagaacgtaaagatgcgaaccccaaatcagtggtttgttcattcttcatgcaagagcaatgcactaaaggagagaagcaagctgtggtgatcagtgactttggtgaaagctaagaaggttcaaacaaatttgcaaatgatatacaacttctaaggaggcaacctctattaaatggacgataaaggctacttcatctaaagtgctttgagctcaagaaagagctgtcttcagcacctcaccatgtgtctacattttgttgcttagaaaagcctaggcatttctgtaacatttgcattccatattggaagaagagatttctacacatgaaaaaaatgcctttgtttagtaaatcacacaaaaatccagcagaaattgtgaaaatcctgaaagacaatttggccattttggaaaagcaagacaaaaagacagacaaggcttcagaagaagtgtctaaatcactgcaagcaatgaaagaaattctgtgtggtacaaacgagaaagaacccccaacagaagcagtggctcagctagcacaagaactctacagcagtggcctgctagtgacactgatagctgacctgcagctgatagactttgagggaaaaaaagatgtgacccagatatttaacaacatcttgagaagacagataggcactcggagtcctactgtggagtatattagtgctcatcctcatatcctgtttatgctcctcaaaggatatgaagccccacagattgccttacgttgtgggattatgctgagagaatgtattcgacatgaaccacttgccaaaatcatcctcttttctaatcaattcagagatttctttaagtacgtggagttgtcaacatttgatattgcttcagatgcctttgctactttcaaggatttactaaccagacataaagtgttggtagcagacttcttagaacaaaattacgacactatttttgaagactatgagaaattgcttcagtctgagaattatgttactaagagacagtctttaaagctgctaggggagctgatcctggaccgtcacaactttgccatcatgacaaagtatatcagcaagccggagaacctgaaactcatgatgaacctccttcgggataaaagtcccaacatccagtttgaagcctttcatgtttttaaggtgtttgtggccagtcctcacaaaacacagcctattgtggagatcctgttaaaaaatcagcccaaactcattgagtttctgagcagcttccaaaaagaaaggacggatgatgagcagttcgctgacgagaagaactacttgattaaacagatccgagacttgaagaaaacggccccttgaagagctccccggcccctgtcacagtcagtcgtctcatttgtccagtttgtacagtgtgtcatttcagaaagtcatcattcttgggaagactttggaggtgcctattttttctgctgtaattgttctgggtagatggagtataaacatttgaatggaaaaaaa

SEQ ID NO: 4098 - DNA, 633 bp, Homo sapiens
agcgttttgttagggaagaagtggagaacagatattggaaggcaattagctgtctctaatacattgataaaatatataactataactgcaaaatgctaataacccagcagaggagtagatttgggaacataagatgaaaaagtcaacaagtgcattgatcacaacatatggtaatgatagcgtgattgtgatgacctttgttttatacctccttttacattccatattggaagaagagatttctacacatgaaaaaaatgcctttgtttagtaaatcacacaaaaatccagcagaaattgtgaaaatcctgaaagacaatttggccattttggaaaagcaagacaaaaagacagacaaggcttcagaagaagtgtctaaatcactgcaagcaatgaaagaaattctgtgtggtacaaacgagaaagaacccccaacagaagcagtggctcagctagcacaagaactctacagcagtggcctgctagtgacactgatagctgacctgcagctgatagactttgagggaaaaaaagatgtgacccagatatttaacaacatcttgagaagacagataggcactcggagtcctactgtggagtatattagtgctcatcctcatatcctgtttatgc

SEQ ID NO: 4099 - DNA, 727 bp, Homo sapiens
agagagggagtggagaacgcataagcaagctggtttgaccagaaacagaactgcctgtgacagattaagagacaagcaaggcttggaatctgagagcaagcaaagagagtggaaatttacagctgccctatcattccatattggaagaagagatttctacacatgaaaaaaatgcctttgtttagtaaatcacacaaaaatccagcagaaattgtgaaaatcctgaaagacaatttggccattttggaaaagcaagacaaaaagacagacaaggcttcagaagaagtgtctaaatcactgcaagcaatgaaagaaattctgtgtggtacaaacgagaaagaacccccaacagaagcagtggctcagctagcacaagaactctacagcagtggcctgctagtgacactgatagctgacctgcagctgatagactttgagggaaaaaaagatgtgacccagatatttaacaacatcttgagaagacagataggcactcggagtcctactgtggagtatattagtgctcatcctcatatcctgtttatgctcctcaaaggatatgaagccccacagattgccttacgttgtgggattatgctgagagaatgtattcgacatgaaccacttgccaaaatcatcctcttttctaatcaattcagagatttctttaagtacgtggagttgtcaacatttgatattgcttcagatgcctttgctactttcaagg

SEQ ID NO: 4100 - DNA, 1299 bp, Homo sapiens
cataagcagctttatgggtcctgaaagccaagggtgcccaggggtgtggtgtctctgagccctgttatccctcccccatgaccacagagcaggcaagggggcagcagggcccaaatctggccattggccgtcagaagccccctgcgggggttgtgactcccaagagtgatgcagaggagcccccgttgaccaggaagaggagcaagaaggagagggggctccgagggtctcgaaagcgcactggcagctctggggagcagacaggccccgaggccccggggagcagcaataaccctcccagcactggagaggggccggcgggcgcaccccctgcatcccctgggccggcctcttctcgccagtcccaccgacatcgtcctgactccctgcacgacgctgctcagaggacatacgggcccctgctcaatcgagtcttcgggaaggaccgcgaactgggccccgaggagctagacgagcttcaggccgccttcgaggagtttgacactgaccgtgacggctacatcagccaccgggagctgggtgactgcatgcggaccctgggctacatgcccaccgagatggagctcctggaggtctcgcagcacatcaagatgcgcatgggcggccgtgtggactttgaggagtttgtagaactgataggcccaaagctgagggaggagacggcgcacatgctgggggtgcgagagctgcgcatcgccttccgagagtttgacagggacagggatggacgaattacggtggcggagctgcgggaggcggtaccggctctgctcggggagccgctggcgggtcctgagctggacgagatgctccgagaagtggacctcaatggggatggcaccgtagactttgacgagtttgtgatgatgctctcccgccactgaggctccaggagggaatatctgttgcccctgcggccccagacaccagccagacccaggctgcaggcctcccccaggagcctccaggatggagatggagacccagcagcccccagactacttctatccctgaaaacacctggcctcaatgttggcttgttatgttacctgcccaccctcatccttacctcctcctactcaagctgcctggagaagacctgctctcagctgcccaccgttcctcagtgtgagcaagatttgggtctctccagacctctgggaggtagggagttccctggcactggcagcattcagtggggaccccccagtggcatgatgaatggagaggatggctggaccccttccactacttatgtttataatttttttttttttt

SEQ ID NO: 4101 - DNA, 1426 bp, Homo sapiens
aggcagctgtccccagcggccagtgtcccccatgccggatctctaggatctggaaggccgctgctgccaggaacaagaagtcagagagggccaggctgagcaggagcagcgccagacgcgtgccagctccatgccgggcctgggagccggccagccacgccatcaacccattggctggcagcccaaggagcagcagggccaccaggaagaccgtgtcccagccaccttggggtcccaccgacatcgtcctgactccctgcacgacgctgctcagaggacatacgggcccctgctcaatcgagtcttcgggaaggccaacatgagcaggggatgaaggaggaaggatgacagagccgtggctggccctggggacatcctggactctccccctgcaggaccgcgaactgggccccgaggagctagacgagcttcaggccgccttcgaggagtttgacactgaccgtgacggctacatcagccaccgggagctgggtgactgcatgcggaccctgggctacatgcccaccgagatggagctcctggaggtctcgcagcacatcaagatgcgcatgggcggccgtgtggactttgaggagtttgtagaactgataggcccaaagctgagggaggagacggcgcacatgctgggggtgcgagagctgcgcatcgccttccgagagtttgacagggacagggatggacgaattacggtggcggagctgcgggaggcggtaccggctctgctcggggagccgctggcgggtcctgagctggacgagatgctccgagaagtggacctcaatggggatggcaccgtagactttgacgagtttgtgatgatgctctcccgccactgaggctccaggagggaatatctgttgcccctgcggccccagacaccagccagacccaggctgcaggcctcccccaggagcctccaggatggagatggagacccagcagcccccagactacttctatccctgaaaacacctggcctcaatgttggcttgttatgttacctgcccaccctcatccttacctcctcctactcaagctgcctggagaagacctgctctcagctgcccaccgttcctcagtgtgagcaagatttgggtctctccagacctctgggaggtagggagttccctggcactggcagcattcagtggggaccccccagtggcatgatgaatggagaggatggctggaccccttccactacttatgtttataattttttttttttttaatgaacttgagccgggtgcagtggctcacacctgtaagcccagctgtcagggggcagaagcgggaggatagcttgagcccaggagtgcaagacctgcctgggcaatatactgagaccccattctccacaaaaaggaaaaataaaagacaaaaaaacaaacaaaaaaccaaaaaa

SEQ ID NO: 4102 - DNA, 1250 bp, Homo sapiens
ccaagagaggcaggaagaggtggcaaaggagtgctggagaagataaggaggctgagctccgacagggagcagggaggaggggccatcttgagactggtgccctgcgagctccaccccacccctccatgcagttccccatgggccccgcctgcatcttcttgaggaaaggcattgctgagaaacagcgggaaagaccactgggacaagatgagattgaagagctgcgggaagcatttcttgagttcgataaggaccgagatgggttcatctcttgtaaggatctggggaatctcatgaggacgatgggttacatgcccacggagatggaactgattgagctcggccagcaaatccgcatgaacctgggtggccgtgtagactttgatgactttgtggagctgatgacccccaaattgcttgcagaaacagctgggatgatcggtgtccaggagatgcgggatgccttcaaggagtttgacacgaatggagatggggagatcaccctggtggagctacagcaggccatgcagagactcctgggggagcggctcaccccccgggagatctctgaggttgtccgggaggctgatgttaatggagacggcacagttgactttgaagagtttgtgaagatgatgtctcgctgaggaggtcctggaagctccagaccctctccacctggtcaacatggagcaagcgcttgtggagaaccaaagcccaaaagccccagatccccttaaagcagagagggagggcaggcgggagggagggcattggcatgcggcgctgtgcatggggtgagacccagagcggtatctttgccaggatgggggcgtctgcagaactagattaagaaggaagagtctgtggatggaaataggaagcgtgggagggtccagttgccacccccaaaaattccaatgattcttgacatcttttcacttcacgtagtcctaagtccctgtgacctgccagagtctcttccccagcttccccttgggtgaaaatagtctcttctcctgttgggtatcaaaaggttcagaacgtagtctctactcttcccctgcctgcatcaactgttgcaaatcccgtttctctctcccggtaaggggacaaattatactttattcaggtgatggttacatgaacagcccagacttcaccactacgcaatatatccatgtaacaaaaccgcacttgtactccctaaatctatagaaatacaaaatgaaataaaaaggatgcaaatc

SEQ ID NO: 4103 - DNA, 1044 bp, Homo sapiens
taagagcgcggccggaaagcagtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttagcaatggcaacaagtgaacgaggacaaccaccaccatgttctaacatgtggaccctttattgtctaactgataagaatcaacaaggtcacccatcaccgccacctgcacctgggccttttccccaagcaaccctctatttacctaatcctaaggatccacagtttcagcagcatccaccaaaagtcacttttccaacttatgtgatgggcgacaccaagaagaccagtgccccaccttttatcttagtaggctcaaatgttcaggaagcacagggatggaaacctcttcctggacatgctgtcgtttcacagtcagatgtcttgagatatgttgcaatgcaagtgcccattgctgttcctgcagatgagaaataccagaaacataccctaagtccccagaatgctaatcctccaagtggacaagatgtccccaggccaaaaagccctgttttcctttctgttgctttcccagtagaagatgtagctaaaaaaagttcaggatctggtgacaaatgtgctccctttggaagttacggtattgctggggaggtaaccgtgactactgctcacaaacgtcgcaaagcagaaactgaaaactgatccagaaatgacgctgtctgggtcaacatttcagggaggagtctgccaccagtgtaatgtatcaataaacttcatgcaagc

SEQ ID NO: 4104 - DNA, 1547 bp, Homo sapiens
aggagccgccggcaagggggcaacgaggaagctcttaagagcgcggccggaaagcagtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttaggtaaagtttcatctattcattctgatcaatctgatgtgttaatggtggatgtggcaaccagtatgcctgttgttatcaaggaggtgccaagctcagaggctgctgaagatgtcatggtggctgctcctcttgtgtgttctggaaaggtgctagaagtgcaggttgtgaaccaaacatctgtccatgtagatttgggttctcaacctaaagaaaatgaggctgaaccatcaacggcttcctcagtccccttgcaggatgaacaagaacctcctgcttatgatcaagctcctgaggtcactttgcaggctgatattgaggttatgtcaactgttcatatatcatctgtctataacgatgtgcctgtgactgaaggagttgtttatatcgagcaactgccagaacaaatagttatcccttttactgatcaagttgcttgtcttaaagaaaatgagcagtcaaaagaaaatgagcagtcaccacgagttagtcccaaatctgtagtagaaaagaccacctctggcatgtctaaaaaatctgtagagtctgtaaaacttgcacagttggaggagaatgcaaaatattcctcagtatatatggaggcagaagcaacagctctgctctctgacacatctttgaaaggtcagcctgaggtacctgcacaactcctggatgcagaaggtgctatcaaaataggctctgaaaaatctctgcaccttgaagtggagatcacttcaatagtctctgacaatactgggcaggaggagtctggggaaaactctgtaccccaggagatggaaggcaaacctgtgctctctggggaagctgcagaagcagtgcactcaggtacatctgtaaagtcatctagtggccccttccctcctgctccagaaggccttactgcaccagaaattgaaccagaaggggaatcaacagctgaataaggtttgatgaagccagcaatggcaacaagtgaacgaggacaaccaccaccatgttctaacatgtggaccctttattgtctaactgataagaatcaacaaggtcacccatcaccgccacctgcacctgggccttttccccaagcaaccctctatttacctaatcctaaggatccacagtttcagcagcatccaccaaaagtcactttt

SEQ ID NO: 4105 - DNA, 1389 bp, Homo sapiens
cggagctttgtgatgcggagcttcgtgatgcacgccccgatgcctgcggggctataaaaacgctcgcaagcgccaagtctcctcaggagccgccggcaagggggcaacgaggaagctcttaagagcgcggccggaaagcagttgagttacagacatcctgccaaaatgatttcttcaaagcccagacttgtcgtaccctatggcctcaagactctgctcgagggaattagcagagctgttctcaaaaccaacccatcaaacatcaaccagtttgcagcagcttattttcaagaacttactatgtatagagggaatactactatggatataaaagatctggttaaacaatttcatcagattaaagtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttagcaatggcaacaagtgaacgaggacaaccaccaccatgttctaacatgtggaccctttattgtctaactgataagaatcaacaaggtcacccatcaccgccacctgcacctgggccttttccccaagcaaccctctatttacctaatcctaaggatccacagtttcagcagcatccaccaaaagtcacttttccaacttatgtgatgggcgacaccaagaagaccagtgccccaccttttatcttagtaggctcaaatgttcaggaagcacagggatggaaacctcttcctggacatgctgtcgtttcacagtcagatgtcttgagatatgttgcaatgcaagtgcccattgctgttcctgcagatgagaaataccagaaacataccctaagtccccagaatgctaatcctccaagtggacaagatgtccccaggccaaaaagccctgttttcctttctgttgctttcccagtagaagatgtagctaaaaaaagttcaggatctggtgacaaatgtgctccctttggaagttacggtattgctggggaggtaaccgtgactactgctcacaaacgtcgcaaagcagaaactgaaaactgatccagaaatgacgctgtctgggtcaacatttcagggaggagtctgccaccagtgtaatgtatcaataaacttcatgcaagcata

SEQ ID NO: 4106 - DNA, 1284 bp, Homo sapiens
cctatggctccgaagtccccgctggcatcctgaaagttgagttacagacatcctgccaaaatgatttcttcaaagcccagacttgtcgtaccctatggcctcaagactctgctcgagggaattagcagagctgttctcaaaaccaacccatcaaacatcaaccagtttgcagcagcttattttcaagaacttactatgtatagagggaatactactatggatataaaagatctggttaaacaatttcatcagattaaagtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttagcaatggcaacaagtgaacgaggacaaccaccaccatgttctaacatgtggaccctttattgtctaactgataagaatcaacaaggtcacccatcaccgccacctgcacctgggccttttccccaagcaaccctctatttacctaatcctaaggatccacagtttcagcagcatccaccaaaagtcacttttccaacttatgtgatgggcgacaccaagaagaccagtgccccaccttttatcttagtaggctcaaatgttcaggaagcacagggatggaaacctcttcctggacatgctgtcgtttcacagtcagatgtcttgagatatgttgcaatgcaagtgcccattgctgttcctgcagatgagaaataccagaaacataccctaagtccccagaatgctaatcctccaagtggacaagatgtccccaggccaaaaagccctgttttcctttctgttgctttcccagtagaagatgtagctaaaaaaagttcaggatctggtgacaaatgtgctccctttggaagttacggtattgctggggaggtaaccgtgactactgctcacaaacgtcgcaaagcagaaactgaaaactgatccagaaatgacgctgtctgggtcaacatttcagggaggagtctgccaccagtgtaatgtatcaataaacttcatgcaagcata

SEQ ID NO: 4107 - DNA, 902 bp, Homo sapiens
tgcggagcttcgtgatgcacgccccgatgcctgcggggctataaaaacgctcgcaagcgccaagtctcctcaggagccgccggcaagggggcaacgaggaagctcttaagagcgcggccggaaagcagttgagttacagacatcctgccaaaatgatttcttcaaagcccagacttgtcgtaccctatggcctcaagactctgctcgagggaattagcagagctgttctcaaaaccaacccatcaaacatcaaccagtttgcagcagcttattttcaagaacttactatgtatagagggaatactactatggatataaaagatctggttaaacaatttcatcagattaaagtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttagaagatgtagctaaaaaaagttcaggatctggtgacaaatgtgctccctttggaagttacggtattgctggggaggtaaccgtgactactgctcacaaacgtcgcaaagcagaaactgaaaactgatccagaaatgacgctgtctgggtcaacatttcagggaggagtctgccaccagtgtaatgtatcaataaacttcatgcaagcata

SEQ ID NO: 4108 - DNA, 2226 bp, Homo sapiens
cttaagagcgcggccggaaagcagttgagttacagacatcctgccaaaatgatttcttcaaagcccagacttgtcgtaccctatggcctcaagactctgctcgagggaattagcagagctgttctcaaaaccaacccatcaaacatcaaccagtttgcagcagcttattttcaagaacttactatgtatagagggaatactactatggatataaaagatctggttaaacaatttcatcagattaaagtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttaggtaaagtttcatctattcattctgatcaatctgatgtgttaatggtggatgtggcaaccagtatgcctgttgttatcaaggaggtgccaagctcagaggctgctgaagatgtcatggtggctgctcctcttgtgtgttctggaaaggtgctagaagtgcaggttgtgaaccaaacatctgtccatgtagatttgggttctcaacctaaagaaaatgaggctgaaccatcaacggcttcctcagtccccttgcaggatgaacaagaacctcctgcttatgatcaagctcctgaggtcactttgcaggctgatattgaggttatgtcaactgttcatatatcatctgtctataacgatgtgcctgtgactgaaggagttgtttatatcgagcaactgccagaacaaatagttatcccttttactgatcaagttgcttgtcttaaagaaaatgagcagtcaaaagaaaatgagcagtcaccacgagttagtcccaaatctgtagtagaaaagaccacctctggcatgtctaaaaaatctgtagagtctgtaaaacttgcacagttggaggagaatgcaaaatattcctcagtatatatggaggcagaagcaacagctctgctctctgacacatctttgaaaggtcagcctgaggtacctgcacaactcctggatgcagaaggtgctatcaaaataggctctgaaaaatctctgcaccttgaagtggagatcacttcaatagtctctgacaatactgggcaggaggagtctggggaaaactctgtaccccaggagatggaaggcaaacctgtgctctctggggaagctgcagaagcagtgcactcaggtacatctgtaaagtcatctagtggccccttccctcctgctccagaaggccttactgcaccagaaattgaaccagaaggggaatcaacagctgaataaggtttgatgaagccagcaatggcaacaagtgaacgaggacaaccaccaccatgttctaacatgtggaccctttattgtctaactgataagaatcaacaaggtcacccatcaccgccacctgcacctgggccttttccccaagcaaccctctatttacctaatcctaaggatccacagtttcagcagcatccaccaaaagtcacttttccaacttatgtgatgggcgacaccaagaagaccagtgccccaccttttatcttagtaggctcaaatgttcaggaagcacagggatggaaacctcttcctggacatgctgtcgtttcacagtcagatgtcttgagatatgttgcaatgcaagtgcccattgctgttcctgcagatgagaaataccagaaacataccctaagtccccagaatgctaatcctccaagtggacaagatgtccccaggccaaaaagccctgttttcctttctgttgctttcccagtagaagatgtagctaaaaaaagttcaggatctggtgacaaatgtgctccctttggaagttacggtattgctggggaggtaaccgtgactactgctcacaaacgtcgcaaagcagaaactgaaaactgatccagaaatgacgctgtctgggtcaacatttcagggaggagtctgccaccagtgtaatgtatcaataaacttcatgcaagc

SEQ ID NO: 4109 - DNA, 2250 bp, Homo sapiens
atgcctgcggggctataaaaacgctcgcaagcgccaagtctcctcaggagccgccggcaagggggcaacgaggaagctcttaagagcgcggccggaaagcagttgagttacagacatcctgccaaaatgatttcttcaaagcccagacttgtcgtaccctatggcctcaagactctgctcgagggaattagcagagctgttctcaaaaccaacccatcaaacatcaaccagtttgcagcagcttattttcaagaacttactatgtatagagtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttaggtaaagtttcatctattcattctgatcaatctgatgtgttaatggtggatgtggcaaccagtatgcctgttgttatcaaggaggtgccaagctcagaggctgctgaagatgtcatggtggctgctcctcttgtgtgttctggaaaggtgctagaagtgcaggttgtgaaccaaacatctgtccatgtagatttgggttctcaacctaaagaaaatgaggctgaaccatcaacggcttcctcagtccccttgcaggatgaacaagaacctcctgcttatgatcaagctcctgaggtcactttgcaggctgatattgaggttatgtcaactgttcatatatcatctgtctataacgatgtgcctgtgactgaaggagttgtttatatcgagcaactgccagaacaaatagttatcccttttactgatcaagttgcttgtcttaaagaaaatgagcagtcaaaagaaaatgagcagtcaccacgagttagtcccaaatctgtagtagaaaagaccacctctggcatgtctaaaaaatctgtagagtctgtaaaacttgcacagttggaggagaatgcaaaatattcctcagtatatatggaggcagaagcaacagctctgctctctgacacatctttgaaaggtcagcctgaggtacctgcacaactcctggatgcagaaggtgctatcaaaataggctctgaaaaatctctgcaccttgaagtggagatcacttcaatagtctctgacaatactgggcaggaggagtctggggaaaactctgtaccccaggagatggaaggcaaacctgtgctctctggggaagctgcagaagcagtgcactcaggtacatctgtaaagtcatctagtggccccttccctcctgctccagaaggccttactgcaccagaaattgaaccagaaggggaatcaacagctgaataaggtttgatgaagccagcaatggcaacaagtgaacgaggacaaccaccaccatgttctaacatgtggaccctttattgtctaactgataagaatcaacaaggtcacccatcaccgccacctgcacctgggccttttccccaagcaaccctctatttacctaatcctaaggatccacagtttcagcagcatccaccaaaagtcacttttccaacttatgtgatgggcgacaccaagaagaccagtgccccaccttttatcttagtaggctcaaatgttcaggaagcacagggatggaaacctcttcctggacatgctgtcgtttcacagtcagatgtcttgagatatgttgcaatgcaagtgcccattgctgttcctgcagatgagaaataccagaaacataccctaagtccccagaatgctaatcctccaagtggacaagatgtccccaggccaaaaagccctgttttcctttctgttgctttcccagtagaagatgtagctaaaaaaagttcaggatctggtgacaaatgtgctccctttggaagttacggtattgctggggaggtaaccgtgactactgctcacaaacgtcgcaaagcagaaactgaaaactgatccagaaatgacgctgtctgggtcaacatttcagggaggagtctgccaccagtgtaatgtatcaataaacttcatgcaagc

SEQ ID NO: 4110 - DNA, 1872 bp, Homo sapiens
aggcgtgcaggcgggagcagcgtgcagagcagcggccgggttttgctcccgcctcggagcccctggcccgggggagggggagaggccgctagcctggtctatgtctttttctgactccagtgcaaccttcctgctgaacgagggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagaagtacagcaatgactggtggatcgggcggctagtgaaagagggcggggacatcgccttcatccccagcccccagcgcctggagagcatccggctcaaacaggagcagaaggccaggagatctgggaacccttccagcctgagtgacattggcaaccgacgctcccctccgccatctctagccaagcagaagcaaaagcaggcggaacatgttcccccatatgacgtggtgccctccatgcggcctgtggtgctggtgggaccctctctgaaaggttatgaggtcacagacatgatgcagaaggctctcttcgacttcctcaaacacagatttgatggcaggatctccatcacccgagtcacagccgacctctccctggcaaagcgatctgtgctcaacaatccgggcaagaggaccatcattgagcgctcctctgcccgctccagcattgcggaagtgcagagtgagatcgagcgcatatttgagctggccaaatccctgcagctagtagtgttggacgctgacaccatcaaccacccagcacagctggccaagacctcgctggcccccatcatcgtctttgtcaaagtgtcctcaccaaaggtactccagcgtctcattcgctcccgggggaagtcacagatgaagcacctgaccgtacagatgatggcatatgataagctggttcagtgcccaccggagtcatttgatgtgattctggatgagaaccagctggaggatgcctgtgagcacctggctgagtacctggaggtttactggcgggccacgcaccacccagcccctggccccggacttctgggtcctcccagtgccatccccggacttcagaaccagcagctgctgggggagcgtggcgaggagcactccccccttgagcgggacagcttgatgccctctgatgaggccagcgagagctcccgccaagcctggacaggatcttcacagcgtagctcccgccacctggaggaggactatgcagatgcctaccaggacctgtaccagcctcaccgccaacacacctcggggctgcctagtgctaacgggcatgacccccaagaccggcttctagcccaggactcagagcacaaccacagtgaccggaactggcagcgcaaccggccttggcccaaggatagctactgacagcctcctgctgccctaccctggcaggcacaggcgcagctggctggggggcccactccaggcagggtggcgttagactggcatcaggctggcactaggctcagcccccaaaaccccctgcccagccccagcttcagggctgcctgtggtcccaaggttctgggagaaacaggggaccccctcacctcctgggcagtgacccctactaggctcccattccaggtactagctgtgtgttctgcacccctggcaccttcctctcctcccacacaggaagctgccccactgggcagtgccctcaggccaggatccccttagca

SEQ ID NO: 4111 - DNA, 1814 bp, Homo sapiens
actgacccgaggagcggtcccgcgactctgtactccctgctgcccagtcccggccaggacgctgcccggcttagctggggcgcccctcgagaccaggatggagggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagaagtacagcaatgactggtggatcgggcggctagtgaaagagggcggggacatcgccttcatccccagcccccagcgcctggagagcatccggctcaaacaggagcagaaggccaggagatctgggaacccttccagcctgagtgacattggcaaccgacgctcccctccgccatctctagccaagcagaagcaaaagcaggcggaacatgttcccccatatgacgtggtgccctccatgcggcctgtggtgctggtgggaccctctctgaaaggttatgaggtcacagacatgatgcagaaggctctcttcgacttcctcaaacacagatttgatggcaggatctccatcacccgagtcacagccgacctctccctggcaaagcgatctgtgctcaacaatccgggcaagaggaccatcattgagcgctcctctgcccgctccagcattgcggaagtgcagagtgagatcgagcgcatatttgagctggccaaatccctgcagctagtagtgttggacgctgacaccatcaaccacccagcacagctggccaagacctcgctggcccccatcatcgtctttgtcaaagtgtcctcaccaaaggtactccagcgtctcattcgctcccgggggaagtcacagatgaagcacctgaccgtacagatgatggcatatgataagctggttcagtgcccaccggagtcatttgatgtgattctggatgagaaccagctggaggatgcctgtgagcacctggctgagtacctggaggtttactggcgggccacgcaccacccagcccctggccccggacttctgggtcctcccagtgccatccccggacttcagaaccagcagctgctgggggagcgtggcgaggagcactccccccttgagcgggacagcttgatgccctctgatgaggccagcgagagctcccgccaagcctggacaggatcttcacagcgtagctcccgccacctggaggaggactatgcagatgcctaccaggacctgtaccagcctcaccgccaacacacctcggggctgcctagtgctaacgggcatgacccccaagaccggcttctagcccaggactcagagcacaaccacagtgaccggaactggcagcgcaaccggccttggcccaaggatagctactgacagcctcctgctgccctaccctggcaggcacaggcgcagctggctggggggcccactccaggcagggtggcgttagactggcatcaggctggcactaggctcagcccccaaaaccccctgcccagccccagcttcagggctgcctgtggtcccaaggttctgggagaaacaggggaccccctcacctcctgggcagtgacccctactaggctcccattccaggtactagctgtgtgttctgcacccctggcaccttcctctcctcccacacaggaagctgccccactgggcagtgccctca

SEQ ID NO: 4112 - DNA, 2395 bp, Homo sapiens
tcccccgacccggactcccccatgtatgacgactcctacgtgcccgggtttgaggactcggaggcgggttcagccgactcctacaccagccgcccatctctggactcagacgtctccctggaggaggaccgggagagtgcccggcgtgaagtagagagccaggctcagcagcagctcgaaagggccaagaagtacagcaatgactggtggatcgggcggctagtgaaagagggcggggacatcgccttcatccccagcccccagcgcctggagagcatccggctcaaacaggagcagaaggccaggagatctgggaacccttccagcctgagtgacattggcaaccgacgctcccctccgccatctctagccaagcagaagcaaaagcaggcggaacatgttcccccatatgacgtggtgccctccatgcggcctgtggtgctggtgggaccctctctgaaaggttatgaggtcacagacatgatgcagaaggctctcttcgacttcctcaaacacagatttgatggcaggatctccatcacccgagtcacagccgacctctccctggcaaagcgatctgtgctcaacaatccgggcaagaggaccatcattgagcgctcctctgcccgctccagcattgcggaagtgcagagtgagatcgagcgcatatttgagctggccaaatccctgcagctagtagtgttggacgctgacaccatcaaccacccagcacagctggccaagacctcgctggcccccatcatcgtctttgtcaaagtgtcctcaccaaaggtactccagcgtctcattcgctcccgggggaagtcacagatgaagcacctgaccgtacagatgatggcatatgataagctggttcagtgcccaccggagtcatttgatgtgattctggatgagaaccagctggaggatgcctgtgagcacctggctgagtacctggaggtttactggcgggccacgcaccacccagcccctggccccggacttctgggtcctcccagtgccatccccggacttcagaaccagcagctgctgggggagcgtggcgaggagcactccccccttgagcgggacagcttgatgccctctgatgaggccagcgagagctcccgccaagcctggacaggatcttcacagcgtagctcccgccacctggaggaggactatgcagatgcctaccaggacctgtaccagcctcaccgccaacacacctcggggctgcctagtgctaacgggcatgacccccaagaccggcttctagcccaggactcagagcacaaccacagtgaccggaactggcagcgcaaccggccttggcccaaggatagctactgacagcctcctgctgccctaccctggcaggcacaggcgcagctggctggggggcccactccaggcagggtggcgttagactggcatcaggctggcactaggctcagcccccaaaaccccctgcccagccccagcttcagggctgcctgtggtcccaaggttctgggagaaacaggggaccccctcacctcctgggcagtgacccctactaggctcccattccaggtactagctgtgtgttctgcacccctggcaccttcctctcctcccacacaggaagctgccccactgggcagtgccctcaggccaggatccccttagcagggtccttcccaccagactcagggaagggatgccccattaaagtgacaaaagggtggggtgtgggcaccatggcatgaggaagaaacaaggtccctgagcaggcacaagtcctgacagtcaagggactgctttggcatccagggcctccagtcacctcactgccatacattagaaatgagacaatcaaagcccccccagggtggcacacccatctgtttgctggggtgtggcagccacatccaagactggagcagcaggctggccacgctcgggccagagagagctcacagctgaagctcttggagggaagggctctcctcaccctgccaggaagcttcttaacatgtgacaggaccagggaccaggagcatggtgaagccaagtggcagatgggagccaacctggatgggggtttggggaaggagggcatgtgtagcagagaacttaggggggcctccttgcctttctcattcttttgccctgcatcctgtcatttctgttcttgtccctcatacatctttggagaaccgggctccagactttgttccctgactcatagctgccgcttgttaggttagggttagatggggagagacagggcacagaggacctgtctccccggctactcttgccttatggctctagtgtgtgacctacagagcatgctccacaagcccctgcctcacctcactgtcatcactaataaacatcatgcacagtc

SEQ ID NO: 4113 - DNA, 1394 bp, Homo sapiens
cggctctgaacgatgtcctcctcctcctacgccaagaacgggaccgcggacgggccgcactcccccacctcgcaggtggcccgaggcaccacaacccggaggagcaggttgaaaagatccgatggcagcaccacttcgaccagcttcatcctcagacagggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccaagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtcta

SEQ ID NO: 4114 - DNA, 1886 bp, Homo sapiens
ccgctccggagcccgcagcctcccccagcggatgccggggactcggaccccgcaccctgagagtctttgttaatggatgtggtggcccgaggcaccacaacccggaggagcaggttgaaaagatccgatggcagcaccacttcgaccagcttcatcctcagacagggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaa

SEQ ID NO: 4115 - DNA, 5476 bp, Homo sapiens
gcgcagcccgcagaggcgctgcggcccgtgcagccccggaggcccctcgcggagaaggcggcggcggaggagaggccgagttaccgcccgccgcccgcgcccccccaaccccgccgccgccgccgccgccgccactgccccccctccccgcggcgccgcatcttgaatggaaacatggcggtgccggctcggacctgcggcgcctctcggcccggcccagcgcggactgcgcgcccctggcccggctgcggcccccaccctggccccggcacccggcgcccgacgtccgggcccccgcgcccgctgtggctgctgctgccgcttctaccgctgctcgccgcccccggcgcctctgcctacagcttcccccagcagcacacgatgcagcactgggcccggcgtctggagcaggaggtcgacggcgtgatgcggatttttggaggcgtccagcagctccgtgagatttacaaggacaaccggaacctgttcgaggtacaggagaatgagcctcagaagttggtggagaaggtggcaggggacattgagagccttctggacaggaaggtgcaggccctgaagagactggctgatgctgcagagaacttccagaaagcacaccgctggcaggacaacatcaaggaggaagacatcgtgtactatgacgccaaggctgacgctgagctggacgaccctgagagtgaggatgtggaaagggggtctaaggccagcaccctaaggctggacttcatcgaggacccaaacttcaagaacaaggtcaactattcatacgcggctgtacagatccctacggacatctacaaaggctccactgtcatcctcaatgagctcaactggacagaggccctggagaatgtgttcatggaaaaccgcagacaagaccccacactgctgtggcaggtcttcggcagcgccacaggagtcactcgctactacccggccaccccgtggcgagcccccaagaagatcgacctgtacgatgtccgaaggagaccctggtatatccagggggcctcgtcacccaaagacatggtcatcatcgtggatgtgagtggcagtgtgagcggcctgaccctgaagctgatgaagacatctgtctgcgagatgctggacacgctgtctgatgatgactatgtgaatgtggcctcgttcaacgagaaggcacagcctgtgtcatgcttcacacacctggtgcaggccaatgtgcgcaacaagaaggtgttcaaggaagctgtgcagggcatggtggccaagggcaccacaggctacaaggccggctttgagtatgcctttgaccagctgcagaactccaacatcactcgggccaactgcaacaagatgatcatgatgttcacggatggtggtgaggaccgcgtgcaggacgtctttgagaagtacaattggccaaaccggacggtgcgcgtgtttactttctccgtggggcagcataactatgacgtcacaccgctgcagtggatggcctgtgccaacaaaggctactattttgagatcccttccatcggagccatccgcatcaacacacaggaatatctagatgtgttgggcaggcccatggtgctggcaggcaaggaggccaagcaggtgcagtggaccaacgtgtatgaggatgcactgggactggggttggtggtaacagggaccctccctgttttcaacctgacacaggatggccctggggaaaagaagaaccagctgatcctgggcgtgatgggcattgacgtggctctgaatgacatcaagaggctgacccccaactacacgcttggagccaacggctatgtgtttgccattgacctgaacggctacgtgttgctgcaccccaatctcaagccccagaccaccaacttccgggagcctgtgactctggacttcctggatgcggagctagaggatgagaacaaggaagagatccgtcggagcatgattgatggcaacaagggccacaagcagatcagaacgttggtcaagtccctggatgagaggtacatagatgaggtgacacggaactacacctgggtgcctataaggagcactaactacagcctggggctggtgctcccaccctacagcaccttctacctccaagccaatctcagtgaccagatcctgcaggtcaagtattttgagttcctgctccccagcagctttgagtctgaaggacacgttttcattgctcccagagagtactgcaaggacctgaatgcctcagacaacaacaccgagttcctgaaaaactttattgagctcatggagaaagtgactccagactccaagcagtgcaacaacttccttctgcacaacctgatcttggacacgggcatcacgcagcagctggtagagcgtgtgtggagggaccaggatctcaacacgtacagcctactggccgtgttcgctgccacagacggtggcatcacccgagtcttccccaacaaggcagctgaggactggacagagaaccctgagcccttcaatgccagcttctaccgccgcagcctggataaccacggttatgtcttcaagcccccacaccaggatgccctgttaaggccgctggagctggagaatgacactgtgggcatcctcgtcagcacagctgtggagctcagcctaggcaggcgcacactgaggccagcagtggtgggcgtcaagctggacctagaggcttgggctgagaagttcaaggtgctagccagcaaccgtacccaccaagaccagcctcagaagtgcggccccaacagccactgtgagatggactgcgaggttaacaatgaggacttactctgtgtcctcattgatgatggaggattcctggtgctgtcaaaccagaaccatcagtgggaccaggtgggcaggttcttcagtgaggtggatgccaacctgatgctggcactctacaataactccttctacacccgcaaggagtcctatgactatcaggcagcctgtgcccctcagccccctggcaacctgggtgctgcaccccggggtgtctttgtgcccaccgttgcagatttccttaacctggcctggtggacctctgctgccgcctggtccctgttccagcagcttctctacggcctcatctaccacagctggttccaagcagaccccgcggaggccgaggggagccccgagacgcgcgagagcagctgcgtcatgaaacagacccagtactacttcggctcggtaaacgcctcctacaacgccatcatcgactgcggaaactgctccaggctgttccacgcgcagagactgaccaacaccaatcttctctttgtggtggccgagaagccgctgtgcagccagtgcgaggctggccggctgctgcagaaggagacgcactgcccagcggacggcccggagcagtgtgagctagtgcagagaccgcgataccggagaggcccgcacatctgcttcgactacaacgcgacagaagatacctcagactgtggccgcggggcctccttcccgccgtcgctgggcgtcctggtctccctgcaactgctgctcctcctgggcctgccgccccggccgcagcctcaagtcctcgtccacgcctctcgccgcctctgagcaccctgccccaccccacctccactcccacctcacccggcctcttcgcctttcccaccctcctgccccacactccccgccttagagcctcgtccctccctcactgaaggacctgagctggccaggccctgagagtctggtctgcgccttgggatggggagtcccaaagcgggacgccgcaggtgtttggcacccaaatcacatctcacctccgaactgttcaagtgtccccagacccttcttgcctgctgggctccccccagtgggatgggacagggaggccacacgcactggtgccaaaaccaggcctctgctgccgcccttcctggaggctgcctatgttgggggggaccctgcctcagctgacccggcctctctgccccacccaagcccaaacttggtttctgtgagaatagtggaggaaggtgagatggccagtttgaagcctgtgcctcccagcttaaatcctagcaggagagaggctctggggcagcccccatgggctcctgcccctttcaggcctacagccacatccccaagcccaccaggtgtcaggatagtcacagtgataccagttcagacactaccccatatacacctggaacattgaggatggaaactggactcacattcgacataccccactgggcacacgcacaaacacacacactatggggtggggtgggtgtaggggcttacaaagccttacacagggcgaggggttggtgggagggttggcacctgcacactccatctcctgctcaccacctgcctctaatctgagctgcagcctggctggtcctcccatttctaaagctgaatgtcaaacagtgccaaatgctggggcagggggtgaagaaccctctgtcccacccctagccaccagtgtcctccaagtgccccctcacctctccaggtgctcattgtaaccatttctcactagtgtcaggcccccagtgggaccacatgccactgcctgcacctttcggcagaggaacccccaccagacatcaccctttgccttagcaggggtgactttgtctctcctggctgggccatccttccgccaatctggcccttacacactcaggcctgtgcccactccctatctccttcccacccctacacacacactccctgcttgcaggaggccaaactgtccctcccttgctgaacacacacacacacacacacacacaggtggggactgggcacagctcttcacaccattcattctggtcatttcccccaaaggcatcccagcctgggggccagtggggaactgagggcaaggggatatagtgatggggctcagatggactgggaggagggggagggtgatgcattaattaatggcttcgttaattaatgtcatgttgcttgtcgctttctcagtgtgtgtgtgtggtccatgcccactgctggtgccagggtgggtgtccatgtgcacccggcctggatgccagctgtgtccttcgggggcgtgcgtgtaactgtagtgtagtcaggtgctcaatggagaatataaacatatacagaaaaatatatattttaagtttaaaaaacagaaaaacagacaaaacaatccccatcaggtagctgtctaacccccagctgggtctaatccttctcattacccacccgacctggctgcccctcaccttgggctgggggactggggggccatttccttttctctgccctttttttgttgttctattttgtacagacaagttggaaaaacaacagcgacaaaaaagtcaagaaactttgtaaaatatcgtgtgtgtgattccttgtaaaatattttcaaatggtttattacagaagatcagttattaaataatgttcatattttcacttc

SEQ ID NO: 4116 - DNA, 5272 bp, Homo sapiens
gcgaagcgagtggctgcagagggctgcatcctgccgtccccagccccccacaaccgtacagccgtgcccaggtttccgcttagggaaccaggaggtccaggccctttctgccagcagccgggcgtgcaagcccccgacagagagaaatcttaaagatagctagagccacgggggctgatgcagcactgggcccggcgtctggagcaggaggtcgacggcgtgatgcggatttttggaggcgtccagcagctccgtgagatttacaaggacaaccggaacctgttcgaggtacaggagaatgagcctcagaagttggtggagaaggtggcaggggacattgagagccttctggacaggaaggtgcaggccctgaagagactggctgatgctgcagagaacttccagaaagcacaccgctggcaggacaacatcaaggaggaagacatcgtgtactatgacgccaaggctgacgctgagctggacgaccctgagagtgaggatgtggaaagggggtctaaggccagcaccctaaggctggacttcatcgaggacccaaacttcaagaacaaggtcaactattcatacgcggctgtacagatccctacggacatctacaaaggctccactgtcatcctcaatgagctcaactggacagaggccctggagaatgtgttcatggaaaaccgcagacaagaccccacactgctgtggcaggtcttcggcagcgccacaggagtcactcgctactacccggccaccccgtggcgagcccccaagaagatcgacctgtacgatgtccgaaggagaccctggtatatccagggggcctcgtcacccaaagacatggtcatcatcgtggatgtgagtggcagtgtgagcggcctgaccctgaagctgatgaagacatctgtctgcgagatgctggacacgctgtctgatgatgactatgtgaatgtggcctcgttcaacgagaaggcacagcctgtgtcatgcttcacacacctggtgcaggccaatgtgcgcaacaagaaggtgttcaaggaagctgtgcagggcatggtggccaagggcaccacaggctacaaggccggctttgagtatgcctttgaccagctgcagaactccaacatcactcgggccaactgcaacaagatgatcatgatgttcacggatggtggtgaggaccgcgtgcaggacgtctttgagaagtacaattggccaaaccggacggtgcgcgtgtttactttctccgtggggcagcataactatgacgtcacaccgctgcagtggatggcctgtgccaacaaaggctactattttgagatcccttccatcggagccatccgcatcaacacacaggaatatctagatgtgttgggcaggcccatggtgctggcaggcaaggaggccaagcaggtgcagtggaccaacgtgtatgaggatgcactgggactggggttggtggtaacagggaccctccctgttttcaacctgacacaggatggccctggggaaaagaagaaccagctgatcctgggcgtgatgggcattgacgtggctctgaatgacatcaagaggctgacccccaactacacgcttggagccaacggctatgtgtttgccattgacctgaacggctacgtgttgctgcaccccaatctcaagccccagaccaccaacttccgggagcctgtgactctggacttcctggatgcggagctagaggatgagaacaaggaagagatccgtcggagcatgattgatggcaacaagggccacaagcagatcagaacgttggtcaagtccctggatgagaggtacatagatgaggtgacacggaactacacctgggtgcctataaggagcactaactacagcctggggctggtgctcccaccctacagcaccttctacctccaagccaatctcagtgaccagatcctgcaggtcaagtattttgagttcctgctccccagcagctttgagtctgaaggacacgttttcattgctcccagagagtactgcaaggacctgaatgcctcagacaacaacaccgagttcctgaaaaactttattgagctcatggagaaagtgactccagactccaagcagtgcaacaacttccttctgcacaacctgatcttggacacgggcatcacgcagcagctggtagagcgtgtgtggagggaccaggatctcaacacgtacagcctactggccgtgttcgctgccacagacggtggcatcacccgagtcttccccaacaaggcagctgaggactggacagagaaccctgagcccttcaatgccagcttctaccgccgcagcctggataaccacggttatgtcttcaagcccccacaccaggatgccctgttaaggccgctggagctggagaatgacactgtgggcatcctcgtcagcacagctgtggagctcagcctaggcaggcgcacactgaggccagcagtggtgggcgtcaagctggacctagaggcttgggctgagaagttcaaggtgctagccagcaaccgtacccaccaagaccagcctcagaagtgcggccccaacagccactgtgagatggactgcgaggttaacaatgaggacttactctgtgtcctcattgatgatggaggattcctggtgctgtcaaaccagaaccatcagtgggaccaggtgggcaggttcttcagtgaggtggatgccaacctgatgctggcactctacaataactccttctacacccgcaaggagtcctatgactatcaggcagcctgtgcccctcagccccctggcaacctgggtgctgcaccccggggtgtctttgtgcccaccgttgcagatttccttaacctggcctggtggacctctgctgccgcctggtccctgttccagcagcttctctacggcctcatctaccacagctggttccaagcagaccccgcggaggccgaggggagccccgagacgcgcgagagcagctgcgtcatgaaacagacccagtactacttcggctcggtaaacgcctcctacaacgccatcatcgactgcggaaactgctccaggctgttccacgcgcagagactgaccaacaccaatcttctctttgtggtggccgagaagccgctgtgcagccagtgcgaggctggccggctgctgcagaaggagacgcactgcccagcggacggcccggagcagtgtgagctagtgcagagaccgcgataccggagaggcccgcacatctgcttcgactacaacgcgacagaagatacctcagactgtggccgcggggcctccttcccgccgtcgctgggcgtcctggtctccctgcaactgctgctcctcctgggcctgccgccccggccgcagcctcaagtcctcgtccacgcctctcgccgcctctgagcaccctgccccaccccacctccactcccacctcacccggcctcttcgcctttcccaccctcctgccccacactccccgccttagagcctcgtccctccctcactgaaggacctgagctggccaggccctgagagtctggtctgcgccttgggatggggagtcccaaagcgggacgccgcaggtgtttggcacccaaatcacatctcacctccgaactgttcaagtgtccccagacccttcttgcctgctgggctccccccagtgggatgggacagggaggccacacgcactggtgccaaaaccaggcctctgctgccgcccttcctggaggctgcctatgttgggggggaccctgcctcagctgacccggcctctctgccccacccaagcccaaacttggtttctgtgagaatagtggaggaaggtgagatggccagtttgaagcctgtgcctcccagcttaaatcctagcaggagagaggctctggggcagcccccatgggctcctgcccctttcaggcctacagccacatccccaagcccaccaggtgtcaggatagtcacagtgataccagttcagacactaccccatatacacctggaacattgaggatggaaactggactcacattcgacataccccactgggcacacgcacaaacacacacactatggggtggggtgggtgtaggggcttacaaagccttacacagggcgaggggttggtgggagggttggcacctgcacactccatctcctgctcaccacctgcctctaatctgagctgcagcctggctggtcctcccatttctaaagctgaatgtcaaacagtgccaaatgctggggcagggggtgaagaaccctctgtcccacccctagccaccagtgtcctccaagtgccccctcacctctccaggtgctcattgtaaccatttctcactagtgtcaggcccccagtgggaccacatgccactgcctgcacctttcggcagaggaacccccaccagacatcaccctttgccttagcaggggtgactttgtctctcctggctgggccatccttccgccaatctggcccttacacactcaggcctgtgcccactccctatctccttcccacccctacacacacactccctgcttgcaggaggccaaactgtccctcccttgctgaacacacacacacacacacacacacaggtggggactgggcacagctcttcacaccattcattctggtcatttcccccaaaggcatcccagcctgggggccagtggggaactgagggcaaggggatatagtgatggggctcagatggactgggaggagggggagggtgatgcattaattaatggcttcgttaattaatgtcatgttgcttgtcgctttctcagtgtgtgtgtgtggtccatgcccactgctggtgccagggtgggtgtccatgtgcacccggcctggatgccagctgtgtccttcgggggcgtgcgtgtaactgtagtgtagtcaggtgctcaatggagaatataaacatatacagaaaaatatatattttaagtttaaaaaacagaaaaacagacaaaacaatccccatcaggtagctgtctaacccccagctgggtctaatccttctcattacccacccgacctggctgcccctcaccttgggctgggggactggggggccatttccttttctctgccctttttttgttgttctattttgtacagacaagttggaaaaacaacagcgacaaaaaagtcaagaaactttgtaaaatatcgtgtgtgtgattccttgtaaaatattttcaaatggtttattacagaagatcagttattaaataatgttcatattttcacttc

SEQ ID NO: 4117 - DNA, 5479 bp, Homo sapiens
gcgcagcccgcagaggcgctgcggcccgtgcagccccggaggcccctcgcggagaaggcggcggcggaggagaggccgagttaccgcccgccgcccgcgcccccccaaccccgccgccgccgccgccgccgccactgccccccctccccgcggcgccgcatcttgaatggaaacatggcggtgccggctcggacctgcggcgcctctcggcccggcccagcgcggactgcgcgcccctggcccggctgcggcccccaccctggccccggcacccggcgcccgacgtccgggcccccgcgcccgctgtggctgctgctgccgcttctaccgctgctcgccgcccccggcgcctctgcctacagcttcccccagcagcacacgatgcagcactgggcccggcgtctggagcaggaggtcgacggcgtgatgcggatttttggaggcgtccagcagctccgtgagatttacaaggacaaccggaacctgttcgaggtacaggagaatgagcctcagaagttggtggagaaggtggcaggggacattgagagccttctggacaggaaggtgcaggccctgaagagactggctgatgctgcagagaacttccagaaagcacaccgctggcaggacaacatcaaggaggaagacatcgtgtactatgacgccaaggctgacgctgagctggacgaccctgagagtgaggatgtggaaagggggtctaaggccagcaccctaaggctggacttcatcgaggacccaaacttcaagaacaaggtcaactattcatacgcggctgtacagatccctacggacatctacaaaggctccactgtcatcctcaatgagctcaactggacagaggccctggagaatgtgttcatggaaaaccgcagacaagaccccacactgctgtggcaggtcttcggcagcgccacaggagtcactcgctactacccggccaccccgtggcgagcccccaagaagatcgacctgtacgatgtccgaaggagaccctggtatatccagggggcctcgtcacccaaagacatggtcatcatcgtggatgtgagtggcagtgtgagcggcctgaccctgaagctgatgaagacatctgtctgcgagatgctggacacgctgtctgatgatgactatgtgaatgtggcctcgttcaacgagaaggcacagcctgtgtcatgcttcacacacctggtgcaggccaatgtgcgcaacaagaaggtgttcaaggaagctgtgcagggcatggtggccaagggcaccacaggctacaaggccggctttgagtatgcctttgaccagctgcagaactccaacatcactcgggccaactgcaacaagatgatcatgatgttcacggatggtggtgaggaccgcgtgcaggacgtctttgagaagtacaattggccaaaccggacggtgcgcgtgtttactttctccgtggggcagcataactatgacgtcacaccgctgcagtggatggcctgtgccaacaaaggctactattttgagatcccttccatcggagccatccgcatcaacacacaggaatatctagatgtgttgggcaggcccatggtgctggcaggcaaggaggccaagcaggtgcagtggaccaacgtgtatgaggatgcactgggactggggttggtggtaacagggaccctccctgttttcaacctgacacaggatggccctggggaaaagaagaaccagctgatcctgggcgtgatgggcattgacgtggctctgaatgacatcaagaggctgacccccaactacacgcttggagccaacggctatgtgtttgccattgacctgaacggctacgtgttgctgcaccccaatctcaagccccagaccaccaacttccgggagcctgtgactctggacttcctggatgcggagctagaggatgagaacaaggaagagatccgtcggagcatgattgatggcaacaagggccacaagcagatcagaacgttggtcaagtccctggatgagaggtacatagatgaggtgacacggaactacacctgggtgcctataaggagcactaactacagcctggggctggtgctcccaccctacagcaccttctacctccaagccaatctcagtgaccagatcctgcaggtcaagtattttgagttcctgctccccagcagctttgagtctgaaggacacgttttcattgctcccagagagtactgcaaggacctgaatgcctcagacaacaacaccgagttcctgaaaaactttattgagctcatggagaaagtgactccagactccaagcagtgcaacaacttccttctgcacaacctgatcttggacacgggcatcacgcagcagctggtagagcgtgtgtggagggaccaggatctcaacacgtacagcctactggccgtgttcgctgccacagacggtggcatcacccgagtcttccccaacaaggcagctgaggactggacagagaaccctgagcccttcaatgccagcttctaccgccgcagcctggataaccacggttatgtcttcaagcccccacaccaggatgccctgttaaggccgctggagctggagaatgacactgtgggcatcctcgtcagcacagctgtggagctcagcctaggcaggcgcacactgaggccagcagtggtgggcgtcaagctggacctagaggcttgggctgagaagttcaaggtgctagccagcaaccgtacccaccaagaccagcctcagaagtgcggccccaacagccactgtgagatggactgcgaggttaacaatgaggacttactctgtgtcctcattgatgatggaggattcctggtgctgtcaaaccagaaccatcagtgggaccaggtgggcaggttcttcagtgaggtggatgccaacctgatgctggcactctacaataactccttctacacccgcaaggagtcctatgactatcaggcagcctgtgcccctcagccccctggcaacctgggtgctgcaccccggggtgtctttgtgcccaccgttgcagatttccttaacctggcctggtggacctctgctgccgcctggtccctgttccagcagcttctctacggcctcatctaccacagctggttccaagcagaccccgcggaggccgaggggagccccgagacgcgcgagagcagctgcgtcatgaaacagacccagtactacttcggctcggtaaacgcctcctacaacgccatcatcgactgcggaaactgctccaggctgttccacgcgcagagactgaccaacaccaatcttctctttgtggtggccgagaagccgctgtgcagccagtgcgaggctggccggctgctgcagaaggagacgcactgttgcccagcggacggcccggagcagtgtgagctagtgcagagaccgcgataccggagaggcccgcacatctgcttcgactacaacgcgacagaagatacctcagactgtggccgcggggcctccttcccgccgtcgctgggcgtcctggtctccctgcaactgctgctcctcctgggcctgccgccccggccgcagcctcaagtcctcgtccacgcctctcgccgcctctgagcaccctgccccaccccacctccactcccacctcacccggcctcttcgcctttcccaccctcctgccccacactccccgccttagagcctcgtccctccctcactgaaggacctgagctggccaggccctgagagtctggtctgcgccttgggatggggagtcccaaagcgggacgccgcaggtgtttggcacccaaatcacatctcacctccgaactgttcaagtgtccccagacccttcttgcctgctgggctccccccagtgggatgggacagggaggccacacgcactggtgccaaaaccaggcctctgctgccgcccttcctggaggctgcctatgttgggggggaccctgcctcagctgacccggcctctctgccccacccaagcccaaacttggtttctgtgagaatagtggaggaaggtgagatggccagtttgaagcctgtgcctcccagcttaaatcctagcaggagagaggctctggggcagcccccatgggctcctgcccctttcaggcctacagccacatccccaagcccaccaggtgtcaggatagtcacagtgataccagttcagacactaccccatatacacctggaacattgaggatggaaactggactcacattcgacataccccactgggcacacgcacaaacacacacactatggggtggggtgggtgtaggggcttacaaagccttacacagggcgaggggttggtgggagggttggcacctgcacactccatctcctgctcaccacctgcctctaatctgagctgcagcctggctggtcctcccatttctaaagctgaatgtcaaacagtgccaaatgctggggcagggggtgaagaaccctctgtcccacccctagccaccagtgtcctccaagtgccccctcacctctccaggtgctcattgtaaccatttctcactagtgtcaggcccccagtgggaccacatgccactgcctgcacctttcggcagaggaacccccaccagacatcaccctttgccttagcaggggtgactttgtctctcctggctgggccatccttccgccaatctggcccttacacactcaggcctgtgcccactccctatctccttcccacccctacacacacactccctgcttgcaggaggccaaactgtccctcccttgctgaacacacacacacacacacacacacaggtggggactgggcacagctcttcacaccattcattctggtcatttcccccaaaggcatcccagcctgggggccagtggggaactgagggcaaggggatatagtgatggggctcagatggactgggaggagggggagggtgatgcattaattaatggcttcgttaattaatgtcatgttgcttgtcgctttctcagtgtgtgtgtgtggtccatgcccactgctggtgccagggtgggtgtccatgtgcacccggcctggatgccagctgtgtccttcgggggcgtgcgtgtaactgtagtgtagtcaggtgctcaatggagaatataaacatatacagaaaaatatatattttaagtttaaaaaacagaaaaacagacaaaacaatccccatcaggtagctgtctaacccccagctgggtctaatccttctcattacccacccgacctggctgcccctcaccttgggctgggggactggggggccatttccttttctctgccctttttttgttgttctattttgtacagacaagttggaaaaacaacagcgacaaaaaagtcaagaaactttgtaaaatatcgtgtgtgtgattccttgtaaaatattttcaaatggtttattacagaagatcagttattaaataatgttcatattttcacttc

SEQ ID NO: 4118 - DNA, 5206 bp, Homo sapiens
atggcggtgccggctcggacctgcggcgcctctcggcccggcccagcgcggactgcgcgcccctggcccggctgcggcccccaccctggccccggcacccggcgcccgacgtccgggcccccgcgcccgctgtggctgctgctgccgcttctaccgctgctcgccgcccccggcgcctctgcctacagcttcccccagcagcacacgatgcagcactgggcccggcgtctggagcaggaggtcgacggcgtgatgcggatttttggaggcgtccagcagctccgtgagatttacaaggacaaccggaacctgttcgaggtacaggagaatgagcctcagaagttggtggagaaggtggcaggggacattgagagccttctggacaggaaggtgcaggccctgaagagactggctgatgctgcagagaacttccagaaagcacaccgctggcaggacaacatcaaggaggaagacatcgtgtactatgacgccaaggctgacgctgagctggacgaccctgagagtgaggatgtggaaagggggtctaaggccagcaccctaaggctggacttcatcgaggacccaaacttcaagaacaaggtcaactattcatacgcggctgtacagatccctacggacatctacaaaggctccactgtcatcctcaatgagctcaactggacagaggccctggagaatgtgttcatggaaaaccgcagacaagaccccacactgctgtggcaggtcttcggcagcgccacaggagtcactcgctactacccggccaccccgtggcgagcccccaagaagatcgacctgtacgatgtccgaaggagaccctggtatatccagggggcctcgtcacccaaagacatggtcatcatcgtggatgtgagtggcagtgtgagcggcctgaccctgaagctgatgaagacatctgtctgcgagatgctggacacgctgtctgatgatgactatgtgaatgtggcctcgttcaacgagaaggcacagcctgtgtcatgcttcacacacctggtgcaggccaatgtgcgcaacaagaaggtgttcaaggaagctgtgcagggcatggtggccaagggcaccacaggctacaaggccggctttgagtatgcctttgaccagctgcagaactccaacatcactcgggccaactgcaacaagatgatcatgatgttcacggatggtggtgaggaccgcgtgcaggacgtctttgagaagtacaattggccaaaccggacggtgcgcgtgtttactttctccgtggggcagcataactatgacgtcacaccgctgcagtggatggcctgtgccaacaaaggctactattttgagatcccttccatcggagccatccgcatcaacacacaggaatatctagatgtgttgggcaggcccatggtgctggcaggcaaggaggccaagcaggtgcagtggaccaacgtgtatgaggatgcactgggactggggttggtggtaacagggaccctccctgttttcaacctgacacaggatggccctggggaaaagaagaaccagctgatcctgggcgtgatgggcattgacgtggctctgaatgacatcaagaggctgacccccaactacacgcttggagccaacggctatgtgtttgccattgacctgaacggctacgtgttgctgcaccccaatctcaagccccagaccaccaacttccgggagcctgtgactctggacttcctggatgcggagctagaggatgagaacaaggaagagatccgtcggagcatgattgatggcaacaagggccacaagcagatcagaacgttggtcaagtccctggatgagaggtacatagatgaggtgacacggaactacacctgggtgcctataaggagcactaactacagcctggggctggtgctcccaccctacagcaccttctacctccaagccaatctcagtgaccagatcctgcaggtcaagtattttgagttcctgctccccagcagctttgagtctgaaggacacgttttcattgctcccagagagtactgcaaggacctgaatgcctcagacaacaacaccgagttcctgaaaaactttattgagctcatggagaaagtgactccagactccaagcagtgcaacaacttccttctgcacaacctgatcttggacacgggcatcacgcagcagctggtagagcgtgtgtggagggaccaggatctcaacacgtacagcctactggccgtgttcgctgccacagacggtggcatcacccgagtcttccccaacaaggcagctgaggactggacagagaaccctgagcccttcaatgccagcttctaccgccgcagcctggataaccacggttatgtcttcaagcccccacaccaggatgccctgttaaggccgctggagctggagaatgacactgtgggcatcctcgtcagcacagctgtggagctcagcctaggcaggcgcacactgaggccagcagtggtgggcgtcaagctggacctagaggcttgggctgagaagttcaaggtgctagccagcaaccgtacccaccaagaccagcctcagaagtgcggccccaacagccactgtgagatggactgcgaggttaacaatgaggacttactctgtgtcctcattgatgatggaggattcctggtgctgtcaaaccagaaccatcagtgggaccaggtgggcaggttcttcagtgaggtggatgccaacctgatgctggcactctacaataactccttctacacccgcaaggagtcctatgactatcaggcagcctgtgcccctcagccccctggcaacctgggtgctgcaccccggggtgtctttgtgcccaccgttgcagatttccttaacctggcctggtggacctctgctgccgcctggtccctgttccagcagcttctctacggcctcatctaccacagctggttccaagcagaccccgcggaggccgaggggagccccgagacgcgcgagagcagctgcgtcatgaaacagacccagtactacttcggctcggtaaacgcctcctacaacgccatcatcgactgcggaaactgctccaggctgttccacgcgcagagactgaccaacaccaatcttctctttgtggtggccgagaagccgctgtgcagccagtgcgaggctggccggctgctgcagaaggagacgcactcggacggcccggagcagtgtgagctagtgcagagaccgcgataccggagaggcccgcacatctgcttcgactacaacgcgacagaagatacctcagactgtggccgcggggcctccttcccgccgtcgctgggcgtcctggtctccctgcaactgctgctcctcctgggcctgccgccccggccgcagcctcaagtcctcgtccacgcctctcgccgcctctgagcaccctgccccaccccacctccactcccacctcacccggcctcttcgcctttcccaccctcctgccccacactccccgccttagagcctcgtccctccctcactgaaggacctgagctggccaggccctgagagtctggtctgcgccttgggatggggagtcccaaagcgggacgccgcaggtgtttggcacccaaatcacatctcacctccgaactgttcaagtgtccccagacccttcttgcctgctgggctccccccagtgggatgggacagggaggccacacgcactggtgccaaaaccaggcctctgctgccgcccttcctggaggctgcctatgttgggggggaccctgcctcagctgacccggcctctctgccccacccaagcccaaacttggtttctgtgagaatagtggaggaaggtgagatggccagtttgaagcctgtgcctcccagcttaaatcctagcaggagagaggctctggggcagcccccatgggctcctgcccctttcaggcctacagccacatccccaagcccaccaggtgtcaggatagtcacagtgataccagttcagacactaccccatatacacctggaacattgaggatggaaactggactcacattcgacataccccactgggcacacgcacaaacacacacactatggggtggggtgggtgtaggggcttacaaagccttacacagggcgaggggttggtgggagggttggcacctgcacactccatctcctgctcaccacctgcctctaatctgagctgcagcctggctggtcctcccatttctaaagctgaatgtcaaacagtgccaaatgctggggcagggggtgaagaaccctctgtcccacccctagccaccagtgtcctccaagtgccccctcacctctccaggtgctcattgtaaccatttctcactagtgtcaggcccccagtgggaccacatgccactgcctgcacctttcggcagaggaacccccaccagacatcaccctttgccttagcaggggtgactttgtctctcctggctgggccatccttccgccaatctggcccttacacactcaggcctgtgcccactccctatctccttcccacccctacacacacactccctgcttgcaggaggccaaactgtccctcccttgctgaacacacacacacacacacacacacaggtggggactgggcacagctcttcacaccattcattctggtcatttcccccaaaggcatcccagcctgggggccagtggggaactgagggcaaggggatatagtgatggggctcagatggactgggaggagggggagggtgatgcattaattaatggcttcgttaattaatgtcatgttgcttgtcgctttctcagtgtgtgtgtgtggtccatgcccactgctggtgccagggtgggtgtccatgtgcacccggcctggatgccagctgtgtccttcgggggcgtgcgtgtaactgtagtgtagtcaggtgctcaatggagaatataaacatatacagaaaaatatatattttaagtttaaaaaacagaaaaacagacaaaacaatccccatcaggtagctgtctaacccccagctgggtctaatccttctcattacccacccgacctggctgcccctcaccttgggctgggggactggggggccatttccttttctctgccctttttttgttgttctattttgtacagacaagttggaaaaacaacagcgacaaaaaagtcaagaaactttgt

SEQ ID NO: 4119 - DNA, 5500 bp, Homo sapiens
gcgcagcccgcagaggcgctgcggcccgtgcagccccggaggcccctcgcggagaaggcggcggcggaggagaggccgagttaccgcccgccgcccgcgcccccccaaccccgccgccgccgccgccgccgccactgccccccctccccgcggcgccgcatcttgaatggaaacatggcggtgccggctcggacctgcggcgcctctcggcccggcccagcgcggactgcgcgcccctggcccggctgcggcccccaccctggccccggcacccggcgcccgacgtccgggcccccgcgcccgctgtggctgctgctgccgcttctaccgctgctcgccgcccccggcgcctctgcctacagcttcccccagcagcacacgatgcagcactgggcccggcgtctggagcaggaggtcgacggcgtgatgcggatttttggaggcgtccagcagctccgtgagatttacaaggacaaccggaacctgttcgaggtacaggagaatgagcctcagaagttggtggagaaggtggcaggggacattgagagccttctggacaggaaggtgcaggccctgaagagactggctgatgctgcagagaacttccagaaagcacaccgctggcaggacaacatcaaggaggaagacatcgtgtactatgacgccaaggctgacgctgagctggacgaccctgagagtgaggatgtggaaagggggtctaaggccagcaccctaaggctggacttcatcgaggacccaaacttcaagaacaaggtcaactattcatacgcggctgtacagatccctacggacatctacaaaggctccactgtcatcctcaatgagctcaactggacagaggccctggagaatgtgttcatggaaaaccgcagacaagaccccacactgctgtggcaggtcttcggcagcgccacaggagtcactcgctactacccggccaccccgtggcgagcccccaagaagatcgacctgtacgatgtccgaaggagaccctggtatatccagggggcctcgtcacccaaagacatggtcatcatcgtggatgtgagtggcagtgtgagcggcctgaccctgaagctgatgaagacatctgtctgcgagatgctggacacgctgtctgatgatgactatgtgaatgtggcctcgttcaacgagaaggcacagcctgtgtcatgcttcacacacctggtgcaggccaatgtgcgcaacaagaaggtgttcaaggaagctgtgcagggcatggtggccaagggcaccacaggctacaaggccggctttgagtatgcctttgaccagctgcagaactccaacatcactcgggccaactgcaacaagatgatcatgatgttcacggatggtggtgaggaccgcgtgcaggacgtctttgagaagtacaattggccaaaccggacggtgcgcgtgtttactttctccgtggggcagcataactatgacgtcacaccgctgcagtggatggcctgtgccaacaaaggctactattttgagatcccttccatcggagccatccgcatcaacacacaggaatatctagatgtgttgggcaggcccatggtgctggcaggcaaggaggccaagcaggtgcagtggaccaacgtgtatgaggatgcactgggactggggttggtggtaacagggaccctccctgttttcaacctgacacaggatggccctggggaaaagaagaaccagctgatcctgggcgtgatgggcattgacgtggctctgaatgacatcaagaggctgacccccaactacacgcttggagccaacggctatgtgtttgccattgacctgaacggctacgtgttgctgcaccccaatctcaagccccagaccaccaacttccgggagcctgtgactctggacttcctggatgcggagctagaggatgagaacaaggaagagatccgtcggagcatgattgatggcaacaagggccacaagcagatcagaacgttggtcaagtccctggatgagaggtacatagatgaggtgacacggaactacacctgggtgcctataaggagcactaactacagcctggggctggtgctcccaccctacagcaccttctacctccaagccaatctcagtgaccagatcctgcaggtcaagttgccaatcagcaaactgaaggattttgagttcctgctccccagcagctttgagtctgaaggacacgttttcattgctcccagagagtactgcaaggacctgaatgcctcagacaacaacaccgagttcctgaaaaactttattgagctcatggagaaagtgactccagactccaagcagtgcaacaacttccttctgcacaacctgatcttggacacgggcatcacgcagcagctggtagagcgtgtgtggagggaccaggatctcaacacgtacagcctactggccgtgttcgctgccacagacggtggcatcacccgagtcttccccaacaaggcagctgaggactggacagagaaccctgagcccttcaatgccagcttctaccgccgcagcctggataaccacggttatgtcttcaagcccccacaccaggatgccctgttaaggccgctggagctggagaatgacactgtgggcatcctcgtcagcacagctgtggagctcagcctaggcaggcgcacactgaggccagcagtggtgggcgtcaagctggacctagaggcttgggctgagaagttcaaggtgctagccagcaaccgtacccaccaagaccagcctcagaagtgcggccccaacagccactgtgagatggactgcgaggttaacaatgaggacttactctgtgtcctcattgatgatggaggattcctggtgctgtcaaaccagaaccatcagtgggaccaggtgggcaggttcttcagtgaggtggatgccaacctgatgctggcactctacaataactccttctacacccgcaaggagtcctatgactatcaggcagcctgtgcccctcagccccctggcaacctgggtgctgcaccccggggtgtctttgtgcccaccgttgcagatttccttaacctggcctggtggacctctgctgccgcctggtccctgttccagcagcttctctacggcctcatctaccacagctggttccaagcagaccccgcggaggccgaggggagccccgagacgcgcgagagcagctgcgtcatgaaacagacccagtactacttcggctcggtaaacgcctcctacaacgccatcatcgactgcggaaactgctccaggctgttccacgcgcagagactgaccaacaccaatcttctctttgtggtggccgagaagccgctgtgcagccagtgcgaggctggccggctgctgcagaaggagacgcactgttgcccagcggacggcccggagcagtgtgagctagtgcagagaccgcgataccggagaggcccgcacatctgcttcgactacaacgcgacagaagatacctcagactgtggccgcggggcctccttcccgccgtcgctgggcgtcctggtctccctgcaactgctgctcctcctgggcctgccgccccggccgcagcctcaagtcctcgtccacgcctctcgccgcctctgagcaccctgccccaccccacctccactcccacctcacccggcctcttcgcctttcccaccctcctgccccacactccccgccttagagcctcgtccctccctcactgaaggacctgagctggccaggccctgagagtctggtctgcgccttgggatggggagtcccaaagcgggacgccgcaggtgtttggcacccaaatcacatctcacctccgaactgttcaagtgtccccagacccttcttgcctgctgggctccccccagtgggatgggacagggaggccacacgcactggtgccaaaaccaggcctctgctgccgcccttcctggaggctgcctatgttgggggggaccctgcctcagctgacccggcctctctgccccacccaagcccaaacttggtttctgtgagaatagtggaggaaggtgagatggccagtttgaagcctgtgcctcccagcttaaatcctagcaggagagaggctctggggcagcccccatgggctcctgcccctttcaggcctacagccacatccccaagcccaccaggtgtcaggatagtcacagtgataccagttcagacactaccccatatacacctggaacattgaggatggaaactggactcacattcgacataccccactgggcacacgcacaaacacacacactatggggtggggtgggtgtaggggcttacaaagccttacacagggcgaggggttggtgggagggttggcacctgcacactccatctcctgctcaccacctgcctctaatctgagctgcagcctggctggtcctcccatttctaaagctgaatgtcaaacagtgccaaatgctggggcagggggtgaagaaccctctgtcccacccctagccaccagtgtcctccaagtgccccctcacctctccaggtgctcattgtaaccatttctcactagtgtcaggcccccagtgggaccacatgccactgcctgcacctttcggcagaggaacccccaccagacatcaccctttgccttagcaggggtgactttgtctctcctggctgggccatccttccgccaatctggcccttacacactcaggcctgtgcccactccctatctccttcccacccctacacacacactccctgcttgcaggaggccaaactgtccctcccttgctgaacacacacacacacacacacacacaggtggggactgggcacagctcttcacaccattcattctggtcatttcccccaaaggcatcccagcctgggggccagtggggaactgagggcaaggggatatagtgatggggctcagatggactgggaggagggggagggtgatgcattaattaatggcttcgttaattaatgtcatgttgcttgtcgctttctcagtgtgtgtgtgtggtccatgcccactgctggtgccagggtgggtgtccatgtgcacccggcctggatgccagctgtgtccttcgggggcgtgcgtgtaactgtagtgtagtcaggtgctcaatggagaatataaacatatacagaaaaatatatattttaagtttaaaaaacagaaaaacagacaaaacaatccccatcaggtagctgtctaacccccagctgggtctaatccttctcattacccacccgacctggctgcccctcaccttgggctgggggactggggggccatttccttttctctgccctttttttgttgttctattttgtacagacaagttggaaaaacaacagcgacaaaaaagtcaagaaactttgtaaaatatcgtgtgtgtgattccttgtaaaatattttcaaatggtttattacagaagatcagttattaaataatgttcatattttcacttc

SEQ ID NO: 4120 - DNA, 3453 bp, Homo sapiens
atggcggtgccggctcggacctgcggcgcctctcggcccggcccagcgcggactgcgcgcccctggcccggctgcggcccccaccctggccccggcacccggcgcccgacgtccgggcccccgcgcccgctgtggctgctgctgccgcttctaccgctgctcgccgcccccggcgcctctgcctacagcttcccccagcagcacacgatgcagcactgggcccggcgtctggagcaggaggtcgacggcgtgatgcggatttttggaggcgtccagcagctccgtgagatttacaaggacaaccggaacctgttcgaggtacaggagaatgagcctcagaagttggtggagaaggtggcaggggacattgagagccttctggacaggaaggtgcaggccctgaagagactggctgatgctgcagagaacttccagaaagcacaccgctggcaggacaacatcaaggaggaagacatcgtgtactatgacgccaaggctgacgctgagctggacgaccctgagagtgaggatgtggaaagggggtctaaggccagcaccctaaggctggacttcatcgaggacccaaacttcaagaacaaggtcaactattcatacgcggctgtacagatccctacggacatctacaaaggctccactgtcatcctcaatgagctcaactggacagaggccctggagaatgtgttcatggaaaaccgcagacaagaccccacactgctgtggcaggtcttcggcagcgccacaggagtcactcgctactacccggccaccccgtggcgagcccccaagaagatcgacctgtacgatgtccgaaggagaccctggtatatccagggggcctcgtcacccaaagacatggtcatcatcgtggatgtgagtggcagtgtgagcggcctgaccctgaagctgatgaagacatctgtctgcgagatgctggacacgctgtctgatgatgactatgtgaatgtggcctcgttcaacgagaaggcacagcctgtgtcatgcttcacacacctggtgcaggccaatgtgcgcaacaagaaggtgttcaaggaagctgtgcagggcatggtggccaagggcaccacaggctacaaggccggctttgagtatgcctttgaccagctgcagaactccaacatcactcgggccaactgcaacaagatgatcatgatgttcacggatggtggtgaggaccgcgtgcaggacgtctttgagaagtacaattggccaaaccggacggtgcgcgtgtttactttctccgtggggcagcataactatgacgtcacaccgctgcagtggatggcctgtgccaacaaaggctactattttgagatcccttccatcggagccatccgcatcaacacacaggaatatctagatgtgttgggcaggcccatggtgctggcaggcaaggaggccaagcaggtgcagtggaccaacgtgtatgaggatgcactgggactggggttggtggtaacagggaccctccctgttttcaacctgacacaggatggccctggggaaaagaagaaccagctgatcctgggcgtgatgggcattgacgtggctctgaatgacatcaagaggctgacccccaactacacgcttggagccaacggctatgtgtttgccattgacctgaacggctacgtgttgctgcaccccaatctcaagccccagaccaccaacttccgggagcctgtgactctggacttcctggatgcggagctagaggatgagaacaaggaagagatccgtcggagcatgattgatggcaacaagggccacaagcagatcagaacgttggtcaagtccctggatgagaggtacatagatgaggtgacacggaactacacctgggtgcctataaggagcactaactacagcctggggctggtgctcccaccctacagcaccttctacctccaagccaatctcagtgaccagatcctgcaggtcaagttgccaatcagcaaactgaaggattttgagttcctgctccccagcagctttgagtctgaaggacacgttttcattgctcccagagagtactgcaaggacctgaatgcctcagacaacaacaccgagttcctgaaaaactttattgagctcatggagaaagtgactccagactccaagcagtgcaacaacttccttctgcacaacctgatcttggacacgggcatcacgcagcagctggtagagcgtgtgtggagggaccaggatctcaacacgtacagcctactggccgtgttcgctgccacagacggtggcatcacccgagtcttccccaacaaggcagctgaggactggacagagaaccctgagcccttcaatgccagcttctaccgccgcagcctggataaccacggttatgtcttcaagcccccacaccaggatgccctgttaaggccgctggagctggagaatgacactgtgggcatcctcgtcagcacagctgtggagctcagcctaggcaggcgcacactgaggccagcagtggtgggcgtcaagctggacctagaggcttgggctgagaagttcaaggtgctagccagcaaccgtacccaccaagaccagcctcagaagtgcggccccaacagccactgtgagatggactgcgaggttaacaatgaggacttactctgtgtcctcattgatgatggaggattcctggtgctgtcaaaccagaaccatcagtgggaccaggtgggcaggttcttcagtgaggtggatgccaacctgatgctggcactctacaataactccttctacacccgcaaggagtcctatgactatcaggcagcctgtgcccctcagccccctggcaacctgggtgctgcaccccggggtgtctttgtgcccaccgttgcagatttccttaacctggcctggtggacctctgctgccgcctggtccctgttccagcagcttctctacggcctcatctaccacagctggttccaagcagaccccgcggaggccgaggggagccccgagacgcgcgagagcagctgcgtcatgaaacagacccagtactacttcggctcggtaaacgcctcctacaacgccatcatcgactgcggaaactgctccaggctgttccacgcgcagagactgaccaacaccaatcttctctttgtggtggccgagaagccgctgtgcagccagtgcgaggctggccggctgctgcagaaggagacgcactcggacggcccggagcagtgtgagctagtgcagagaccgcgataccggagaggcccgcacatctgcttcgactacaacgcgacagaagatacctcagactgtggccgcggggcctccttcccgccgtcgctgggcgtcctggtctccctgcaactgctgctcctcctgggcctgccgccccggccgcagcctcaagtcctcgtccacgcctctcgccgcctctga

SEQ ID NO: 4121 - DNA, 3671 bp, Homo sapiens
cggccgctctcgtcgccgccgcagcgggcgcgtcggagggagcccagcatggccgggccgggctcgccgcgccgcgcgtcccggggggcctcggcgcttctcgctgccgcgcttctctacgccgcgctgggggacgtggtgcgctcggagcagcagataccgctctccgtggtgaagctctgggcctcggcttttggtggggagataaaatccattgctgctaagtactccggttcccagcttctgcaaaagaaatacaaagagtatgagaaagacgttgccatagaagaaattgatggcctccaactggtaaagaagctggcaaagaacatggaagagatgtttcacaagaagtctgaggccgtcaggcgtctggtggaggctgcagaagaagcacacctgaaacatgaatttgatgcagacttacagtatgaatacttcaatgctgtgctgataaatgaaagggacaaagacgggaattttttggagctgggaaaggaattcatcttagccccaaatgaccattttaataatttgcctgtgaacatcagtctaagtgacgtccaagtaccaacgaacatgtacaacaaagaccctgcaattgtcaatggggtttattggtctgaatctctaaacaaagtttttgtagataactttgaccgtgacccatctctcatatggcagtactttggaagtgcaaagggcttttttaggcagtatccggggattaaatgggaaccagatgagaatggagtcattgccttcgactgcaggaaccgaaaatggtacatccaggcagcaacttctccgaaagacgtggtcattttagttgacgtcagtggcagcatgaaaggactccgtctgactatcgcgaagcaaacagtctcatccattttggatacacttggggatgatgacttcttcaacataattgcttataatgaggagcttcactatgtggaaccttgcctgaatggaactttggtgcaagccgacaggacaaacaaagagcacttcagggagcatctggacaaacttttcgccaaaggaattggaatgttggatatagctctgaatgaggccttcaacattctgagtgatttcaaccacacgggacaaggaagtatctgcagtcaggccatcatgctcataactgatggggcggtggacacctatgatacaatctttgcaaaatacaattggccagatcgaaaggttcgcatcttcacatacctcattggacgagaggctgcgtttgcagacaatctaaagtggatggcctgtgccaacaaaggattttttacccagatctccaccttggctgatgtgcaggagaatgtcatggaataccttcacgtgcttagccggcccaaagtcatcgaccaggagcatgatgtggtgtggaccgaagcttacattgacagcactctccctcaggcacaaaagctgactgatgatcagggccccgtcctgatgaccactgtagccatgcctgtgtttagtaagcagaacgaaaccagatcgaagggcattcttctgggagtggttggcacagatgtcccagtgaaagaacttctgaagaccatccccaaatacaagttagggattcacggttatgcctttgcaatcacaaataatggatatatcctgacgcatccggaactcaggctgctgtacgaagaaggaaaaaagcgaaggaaacctaactatagtagcgttgacctctctgaggtggagtgggaagaccgagatgacgtgttgagaaatgctatggtgaatcgaaagacggggaagttttccatggaggtgaagaagacagtggacaaagggaaacgggttttggtgatgacaaatgactactattatacagacatcaagggtactcctttcagtttaggtgtggcgctttccagaggtcatgggaaatatttcttccgagggaatgtaaccatcgaagaaggcctgcatgacttagaacatcccgatgtgtccttggcagatgaatggtcctactgcaacactgacctacaccctgagcaccgccatctgtctcagttagaagcgattaagctctacctaaaaggcaaagaacctctgctccagtgtgataaagaattgatccaagaagtcctttttgacgcggtggtgagtgcccccattgaagcgtattggaccagcctggccctcaacaaatctgaaaattctgacaagggcgtggaggttgccttcctcggcactcgcacgggcctctccagaatcaacctgtttgtcggggctgagcagctcaccaatcaggacttcctgaaagctggcgacaaggagaacatttttaacgcagaccatttccctctctggtaccgaagagccgctgagcagattccagggagcttcgtctactcgatcccattcagcactggaccagtcaataaaagcaatgtggtgacagcaagtacatccatccagctcctggatgaacggaaatctcctgtggtggcagctgtaggcattcagatgaaacttgaatttttccaaaggaagttctggactgccagcagacagtgtgcttccctggatggcaaatgctccatcagctgtgatgatgagactgtgaattgttacctcatagacaataatggatttattttggtgtctgaagactacacacagactggagacttttttggtgagatcgagggagctgtgatgaacaaattgctaacaatgggctcctttaaaagaattaccctttatgactaccaagccatgtgtagagccaacaaggaaagcagcgatggcgcccatggcctcctggatccttataatgccttcctctctgcagtaaaatggatcatgacagaacttgtcttgttcctggtggaatttaacctctgcagttggtggcactccgatatgacagctaaagcccagaaattgaaacagaccctggagccttgtgatactgaatatccagcattcgtctctgagcgcaccatcaaggagactacagggaatattgcttgtgaagactgctccaagtcctttgtcatccagcaaatcccaagcagcaacctgttcatggtggtggtggacagcagctgcctctgtgaatctgtggcccccatcaccatggcacccattgaaatcaggtataatgaatcccttaagtgtgaacgtctaaaggcccagaagatcagaaggcgcccagaatcttgtcatggcttccatcctgaggagaatgcaagggagtgtgggggtgcgccgagtctccaagcccagacagtcctccttctgctccctctgcttttgatgctcttctcaaggtgacactgactgagatgttctcttactgactgagatgttctcttggcatgctaaatcatggataaactgtgaaccaaaatatggtgcaacatacgagacatgaatatagtccaaccatcagcatctcatcatgattttaaactgtgcgtgatataaactcttaaagatatgttgacaaaaagttatctatcatctttttactttgccagtcatgcaaatgtgagtttgccacatgataatcacccttcatcagaaatgggaccgcaagtggtaggcagtgtcccttctgcttgaaacctattgaaaccaatttaaaactgtgtactttttaaataaagtatattaaaatc

SEQ ID NO: 4122 - DNA, 3264 bp, Homo sapiens
atgggggagttaaggcaagagagaagcacagccttacagcgtctggtggaggctgcagaagaagcacacctgaaacatgaatttgatgcagacttacagtatgaatacttcaatgctgtgctgataaatgaaagggacaaagacgggaattttttggagctgggaaaggaattcatcttagccccaaatgaccattttaataatttgcctgtgaacatcagtctaagtgacgtccaagtaccaacgaacatgtacaacaaagaccctgcaattgtcaatggggtttattggtctgaatctctaaacaaagtttttgtagataactttgaccgtgacccatctctcatatggcagtactttggaagtgcaaagggcttttttaggcagtatccggggattaaatgggaaccagatgagaatggagtcattgccttcgactgcaggaaccgaaaatggtacatccaggcagcaacttctccgaaagacgtggtcattttagttgacgtcagtggcagcatgaaaggactccgtctgactatcgcgaagcaaacagtctcatccattttggatacacttggggatgatgacttcttcaacataattgcttataatgaggagcttcactatgtggaaccttgcctgaatggaactttggtgcaagccgacaggacaaacaaagagcacttcagggagcatctggacaaacttttcgccaaaggaattggaatgttggatatagctctgaatgaggccttcaacattctgagtgatttcaaccacacgggacaaggaagtatctgcagtcaggccatcatgctcataactgatggggcggtggacacctatgatacaatctttgcaaaatacaattggccagatcgaaaggttcgcatcttcacatacctcattggacgagaggctgcgtttgcagacaatctaaagtggatggcctgtgccaacaaaggattttttacccagatctccaccttggctgatgtgcaggagaatgtcatggaataccttcacgtgcttagccggcccaaagtcatcgaccaggagcatgatgtggtgtggaccgaagcttacattgacagcactgtgagtcaggccgagcaactgactgatgatcagggccccgtcctgatgaccactgtagccatgcctgtgtttagtaagcagaacgaaaccagatcgaagggcattcttctgggagtggttggcacagatgtcccagtgaaagaacttctgaagaccatccccaaatacaagttagggattcacggttatgcctttgcaatcacaaataatggatatatcctgacgcatccggaactcaggctgctgtacgaagaaggaaaaaagcgaaggaaacctaactatagtagcgttgacctctctgaggtggagtgggaagaccgagatgacgtgttgagaaatgctatggtgaatcgaaagacggggaagttttccatggaggtgaagaagacagtggacaaagggaaacgggttttggtgatgacaaatgactactattatacagacatcaagggtactcctttcagtttaggtgtggcgctttccagaggtcatgggaaatatttcttccgagggaatgtaaccatcgaagaaggcctgcatgacttagaacatcccgatgtgtccttggcagatgaatggtcctactgcaacactgacctacaccctgagcaccgccatctgtctcagttagaagcgattaagctctacctaaaaggcaaagaacctctgctccagtgtgataaagaattgatccaagaagtcctttttgacgcggtggtgagtgcccccattgaagcgtattggaccagcctggccctcaacaaatctgaaaattctgacaagggcgtggaggttgccttcctcggcactcgcacgggcctctccagaatcaacctgtttgtcggggctgagcagctcaccaatcaggacttcctgaaagctggcgacaaggagaacatttttaacgcagaccatttccctctctggtaccgaagagccgctgagcagattccagggagcttcgtctactcgatcccattcagcactggaccagtcaataaaagcaatgtggtgacagcaagtacatccatccagctcctggatgaacggaaatctcctgtggtggcagctgtaggcattcagatgaaacttgaatttttccaaaggaagttctggactgccagcagacagtgtgcttccctggatggcaaatgctccatcagctgtgatgatgagactgtgaattgttacctcatagacaataatggatttattttggtgtctgaagactacacacagactggagacttttttggtgagatcgagggagctgtgatgaacaaattgctaacaatgggctcctttaaaagaattaccctttatgactaccaagccatgtgtagagccaacaaggaaagcagcgatggcgcccatggcctcctggatccttataatgccttcctctctgcagtaaaatggatcatgacagaacttgtcttgttcctggtggaatttaacctctgcagttggtggcactccgatatgacagctaaagcccagaaattgaaacagaccctggagccttgtgatactgaatatccagcattcgtctctgagcgcaccatcaaggagactacagggaatattgcttgtgaagactgctccaagtcctttgtcatccagcaaatcccaagcagcaacctgttcatggtggtggtggacagcagctgcctctgtgaatctgtggcccccatcaccatggcacccattgaaatcagtcaacataatgaatcccttaagtgtgaacgtctaaaggcccagaagatcagaaggcgcccagaatcttgtcatggcttccatcctgaggagaatgcaagggagtgtgggggtgcgccgagtctccaagcccagacagtcctccttctgctccctctgcttttgatgctcttctcaaggtgacactgactgagatgttctcttactgactgagatgttctcttggcatgctaaatcatggataaactgtgaaccaaaatatggtgcaacatacgagacatgaatatagtccaaccatcagcatctcatcatgattttaaactgtgcgtgatataaactcttaaagatatgttgacaaaaagttatctatcatctttttactttgccagtcatgcaaatgtgagtttgccacatgataatcacccttcatcagaaatgggaccgcaagtg

SEQ ID NO: 4123 - DNA, 3661 bp, Homo sapiens
cacccgctcctttttctgctccccaagtgagccgggcgctcgcccaccgcccgctccgcgcagctccccgcggccgctctcgtcgccgccgcagcgggcgcgtcggagggagcccagcatggccgggccgggctcgccgcgccgcgcgtcccggggggcctcggcgcttctcgctgccgcgcttctctacgccgcgctgggggacgtggtgcgctcggagcagcagataccgctctccgtggtgaagctctgggcctcggcttttggtggggagataaaatccattgctgctaagtactccggttcccagcttctgcaaaagaaatacaaagagtatgagaaagacgttgccatagaagaaattgatggcctccaactggtaaagaagctggcaaagaacatggaagagatgtttcacaagaagtctgaggccgtcaggcgtctggtggaggctgcagaagaagcacacctgaaacatgaatttgatgcagacttacagtatgaatacttcaatgctgtgctgataaatgaaagggacaaagacgggaattttttggagctgggaaaggaattcatcttagccccaaatgaccattttaataatttgcctgtgaacatcagtctaagtgacgtccaagtaccaacgaacatgtacaacaaagaccctgcaattgtcaatggggtttattggtctgaatctctaaacaaagtttttgtagataactttgaccgtgacccatctctcatatggcagtactttggaagtgcaaagggcttttttaggcagtatccggggattaaatgggaaccagatgagaatggagtcattgccttcgactgcaggaaccgaaaatggtacatccaggcagcaacttctccgaaagacgtggtcattttagttgacgtcagtggcagcatgaaaggactccgtctgactatcgcgaagcaaacagtctcatccattttggatacacttggggatgatgacttcttcaacataattgcttataatgaggagcttcactatgtggaaccttgcctgaatggaactttggtgcaagccgacaggacaaacaaagagcacttcagggagcatctggacaaacttttcgccaaaggaattggaatgttggatatagctctgaatgaggccttcaacattctgagtgatttcaaccacacgggacaaggaagtatctgcagtcaggccatcatgctcataactgatggggcggtggacacctatgatacaatctttgcaaaatacaattggccagatcgaaaggttcgcatcttcacatacctcattggacgagaggctgcgtttgcagacaatctaaagtggatggcctgtgccaacaaaggattttttacccagatctccaccttggctgatgtgcaggagaatgtcatggaataccttcacgtgcttagccggcccaaagtcatcgaccaggagcatgatgtggtgtggaccgaagcttacattgacagcactctccctcaggcacaaaagctgactgatgatcagggccccgtcctgatgaccactgtagccatgcctgtgtttagtaagcagaacgaaaccagatcgaagggcattcttctgggagtggttggcacagatgtcccagtgaaagaacttctgaagaccatccccaaatacaagttagggattcacggttatgcctttgcaatcacaaataatggatatatcctgacgcatccggaactcaggctgctgtacgaagaaggaaaaaagcgaaggaaacctaactatagtagcgttgacctctctgaggtggagtgggaagaccgagatgacgtgttgagaaatgctatggtgaatcgaaagacggggaagttttccatggaggtgaagaagacagtggacaaagggaaacgggttttggtgatgacaaatgactactattatacagacatcaagggtactcctttcagtttaggtgtggcgctttccagaggtcatgggaaatatttcttccgagggaatgtaaccatcgaagaaggcctgcatgacttagaacatcccgatgtgtccttggcagatgaatggtcctactgcaacactgacctacaccctgagcaccgccatctgtctcagttagaagcgattaagctctacctaaaaggcaaagaacctctgctccagtgtgataaagaattgatccaagaagtcctttttgacgcggtggtgagtgcccccattgaagcgtattggaccagcctggccctcaacaaatctgaaaattctgacaagggcgtggaggttgccttcctcggcactcgcacgggcctctccagaatcaacctgtttgtcggggctgagcagctcaccaatcaggacttcctgaaagctggcgacaaggagaacatttttaacgcagaccatttccctctctggtaccgaagagccgctgagcagattccagggagcttcgtctactcgatcccattcagcactggaccagtcaataaaagcaatgtggtgacagcaagtacatccatccagctcctggatgaacggaaatctcctgtggtggcagctgtaggcattcagatgaaacttgaatttttccaaaggaagttctggactgccagcagacagtgtgcttccctggatggcaaatgctccatcagctgtgatgatgagactgtgaattgttacctcatagacaataatggatttattttggtgtctgaagactacacacagactggagacttttttggtgagatcgagggagctgtgatgaacaaattgctaacaatgggctcctttaaaagaattaccctttatgactaccaagccatgtgtagagccaacaaggaaagcagcgatggcgcccatggcctcctggatccttataatgccttcctctctgcagtaaaatggatcatgacagaacttgtcttgttcctggtggaatttaacctctgcagttggtggcactccgatatgacagctaaagcccagaaattgaaacagaccctggagccttgtgatactgaatatccagcattcgtctctgagcgcaccatcaaggagactacagggaatattgcttgtgaagactgctccaagtcctttgtcatccagcaaatcccaagcagcaacctgttcatggtggtggtggacagcagctgcctctgtgaatctgtggcccccatcaccatggcacccattgaaatcaggtataatgaatcccttaagtgtgaacgtctaaaggcccagaagatcagaaggcgcccagaatcttgtcatggcttccatcctgaggagaatgcaagggagtgtgggggtgcgccgagtctccaagcccagacagtcctccttctgctccctctgcttttgatgctcttctcaaggtgacactgactgagatgttctcttactgactgagatgttctcttggcatgctaaatcatggataaactgtgaaccaaaatatggtgcaacatacgagacatgaatatagtccaaccatcagcatctcatcatgattttaaactgtgcgtgatataaactcttaaagatatgttgacaaaaagttatctatcatctttttactttgccagtcatgcaaatgtgagtttgccacatgataatcacccttcatcagaaatgggaccgcaagtg

SEQ ID NO: 4124 - DNA, 1554 bp, Homo sapiens
gaaatattatttcaccaaatgcaaaatcaaattaaacgtctggtggaggctgcagaagaagcacacctgaaacatgaatttgatgcagacttacagtatgaatacttcaatgctgtgctgataaatgaaagggacaaagacgggaattttttggagctgggaaaggaattcatcttagccccaaatgaccattttaataatttgcctgtgaacatcagtctaagtgacgtccaagtaccaacgaacatgtacaacaaagaccctgcaattgtcaatggggtttattggtctgaatctctaaacaaagtttttgtagataactttgaccgtgacccatctctcatatggcagtactttggaagtgcaaagggcttttttaggcagtatccggggattaaatgggaaccagatgagaatggagtcattgccttcgactgcaggaaccgaaaatggtacatccaggcagcaacttctccgaaagacgtggtcattttagttgacgtcagtggcagcatgaaaggactccgtctgactatcgcgaagcaaacagtctcatccattttggatacacttggggatgatgacttcttcaacataattgcttataatgaggagcttcactatgtggaaccttgcctgaatggaactttggtgcaagccgacaggacaaacaaagagcacttcagggagcatctggacaaacttttcgccaaaggaattggaatgttggatatagctctgaatgaggccttcaacattctgagtgatttcaaccacacgggacaaggaagtatctgcagtcaggccatcatgctcataactgatggggcggtggacacctatgatacaatctttgcaaaatacaattggccagatcgaaaggttcgcatcttcacatacctcattggacgagaggctgcgtttgcagacaatctaaagtggatggcctgtgccaacaaaggattttttacccagatctccaccttggctgatgtgcaggagaatgtcatggaataccttcacgtgcttagccggcccaaagtcatcgaccaggagcatgatgtggtgtggaccgaagcttacattgacagcactctgactgatgatcagggccccgtcctgatgaccactgtagccatgcctgtgtttagtaagcagaacgaaaccagatcgaagggcattcttctgggagtggttggcacagatgtcccagtgaaagaacttctgaagaccatccccaaatacaagttagggattcacggttatgcctttgcaatcacaaataatggatatatcctgacgcatccggaactcaggctgctgtacgaagaaggaaaaaagcgaaggaaacctaactatagtagcgttgacctctctgaggtggagtgggaagaccgagatgacgtgttgagaaatgctatggtgaatcgaaagacggggaagttttccatggaggtgaagaagacagtggacaaagggtttaggtgtggcgctttccagaggtcatgggaaatatttcttccgagggaatgtaaccatcgaagaagacctgct

SEQ ID NO: 4125 - DNA, 3675 bp, Homo sapiens
cggccgctctcgtcgccgccgcagcgggcgcgtcggagggagcccagcatggccgggccgggctcgccgcgccgcgcgtcccggggggcctcggcgcttctcgctgccgcgcttctctacgccgcgctgggggacgtggtgcgctcggagcagcagataccgctctccgtggtgaagctctgggcctcggcttttggtggggagataaaatccattgctgctaagtactccggttcccagcttctgcaaaagaaatacaaagagtatgagaaagacgttgccatagaagaaattgatggcctccaactggtaaagaagctggcaaagaacatggaagagatgtttcacaagaagtctgaggccgtcaggcgtctggtggaggctgcagaagaagcacacctgaaacatgaatttgatgcagacttacagtatgaatacttcaatgctgtgctgataaatgaaagggacaaagacgggaattttttggagctgggaaaggaattcatcttagccccaaatgaccattttaataatttgcctgtgaacatcagtctaagtgacgtccaagtaccaacgaacatgtacaacaaagaccctgcaattgtcaatggggtttattggtctgaatctctaaacaaagtttttgtagataactttgaccgtgacccatctctcatatggcagtactttggaagtgcaaagggcttttttaggcagtatccggggattaaatgggaaccagatgagaatggagtcattgccttcgactgcaggaaccgaaaatggtacatccaggcagcaacttctccgaaagacgtggtcattttagttgacgtcagtggcagcatgaaaggactccgtctgactatcgcgaagcaaacagtctcatccattttggatacacttggggatgatgacttcttcaacataattgcttataatgaggagcttcactatgtggaaccttgcctgaatggaactttggtgcaagccgacaggacaaacaaagagcacttcagggagcatctggacaaacttttcgccaaaggaattggaatgttggatatagctctgaatgaggccttcaacattctgagtgatttcaaccacacgggacaaggaagtatctgcagtcaggccatcatgctcataactgatggggcggtggacacctatgatacaatctttgcaaaatacaattggccagatcgaaaggttcgcatcttcacatacctcattggacgagaggctgcgtttgcagacaatctaaagtggatggcctgtgccaacaaaggattttttacccagatctccaccttggctgatgtgcaggagaatgtcatggaataccttcacgtgcttagccggcccaaagtcatcgaccaggagcatgatgtggtgtggaccgaagcttacattgacagcactctccctcaggcacaaaagctgactgatgatcagggccccgtcctgatgaccactgtagccatgcctgtgtttagtaagcagaacgaaaccagatcgaagggcattcttctgggagtggttggcacagatgtcccagtgaaagaacttctgaagaccatccccaaatacaagttagggattcacggttatgcctttgcaatcacaaataatggatatatcctgacgcatccggaactcaggctgctgtacgaagaaggaaaaaagcgaaggaaacctaactatagtagcgttgacctctctgaggtggagtgggaagaccgagatgacgtgttgagaaatgctatggtgaatcgaaagacggggaagttttccatggaggtgaagaagacagtggacaaagggaaacgggttttggtgatgacaaatgactactattatacagacatcaagggtactcctttcagtttaggtgtggcgctttccagaggtcatgggaaatatttcttccgagggaatgtaaccatcgaagaaggcctgcatgacttagaacatcccgatgtgtccttggcagatgaatggtcctactgcaacactgacctacaccctgagcaccgccatctgtctcagttagaagcgattaagctctacctaaaaggcaaagaacctctgctccagtgtgataaagaattgatccaagaagtcctttttgacgcggtggtgagtgcccccattgaagcgtattggaccagcctggccctcaacaaatctgaaaattctgacaagggcgtggaggttgccttcctcggcactcgcacgggcctctccagaatcaacctgtttgtcggggctgagcagctcaccaatcaggacttcctgaaagctggcgacaaggagaacatttttaacgcagaccatttccctctctggtaccgaagagccgctgagcagattccagggagcttcgtctactcgatcccattcagcactggaccagtcaataaaagcaatgtggtgacagcaagtacatccatccagctcctggatgaacggaaatctcctgtggtggcagctgtaggcattcagatgaaacttgaatttttccaaaggaagttctggactgccagcagacagtgtgcttccctggatggcaaatgctccatcagctgtgatgatgagactgtgaattgttacctcatagacaataatggatttattttggtgtctgaagactacacacagactggagacttttttggtgagatcgagggagctgtgatgaacaaattgctaacaatgggctcctttaaaagaattaccctttatgactaccaagccatgtgtagagccaacaaggaaagcagcgatggcgcccatggcctcctggatccttataatgccttcctctctgcagtaaaatggatcatgacagaacttgtcttgttcctggtggaatttaacctctgcagttggtggcactccgatatgacagctaaagcccagaaattgaaacagaccctggagccttgtgatactgaatatccagcattcgtctctgagcgcaccatcaaggagactacagggaatattgcttgtgaagactgctccaagtcctttgtcatccagcaaatcccaagcagcaacctgttcatggtggtggtggacagcagctgcctctgtgaatctgtggcccccatcaccatggcacccattgaaatcaggtataatgaatcccttaagtgtgaacgtctaaaggcccagaagatcagaaggcgcccagaatcttgtcatggcttccatcctgaggagaatgcaagggagtgtgggggtgcgccgagtctccaagcccagacagtcctccttctgctccctctgcttttgatgctcttctcaaggtgacactgactgagatgttctcttactgactgagatgttctcttggcatgctaaatcatggataaactgtgaaccaaaatatggtgcaacatacgagacatgaatatagtccaaccatcagcatctcatcatgattttaaactgtgcgtgatataaactcttaaagatatgttgacaaaaagttatctatcatctttttactttgccagtcatgcaaatgtgagtttgccacatgataatcacccttcatcagaaatgggaccgcaagtggtaggcagtgtcccttctgcttgaaacctattgaaaccaatttaaaactgtgtactttttaaataaagtatattaaaatcataa

SEQ ID NO: 4126 - DNA, 1972 bp, Homo sapiens
gttacatatcttcctgtgccccttctccctgtagggtgaagctctgggcctcggcttttggtggggagataaaatccattgctgctaagtactccggttcccagcttctgcaaaagaaatacaaagagtatgagaaagacgttgccatagaagaaattgatggcctccaactggtaaagaagctggcaaagaacatggaagagatgtttcacaagaagtctgaggccgtcaggcgtctggtggaggctgcagaagaagcacacctgaaacatgaatttgatgcagacttacagtatgaatacttcaatgctgtgctgataaatgaaagggacaaagacgggaattttttggagctgggaaaggaattcatcttagccccaaatgaccattttaataatttgcctgtgaacatcagtctaagtgacgtccaagtaccaacgaacatgtacaacaaagaccctgcaattgtcaatggggtttattggtctgaatctctaaacaaagtttttgtagataactttgaccgtgacccatctctcatatggcagtactttggaagtgcaaagggcttttttaggcagtatccggggattaaatgggaaccagatgagaatggagtcattgccttcgactgcaggaaccgaaaatggtacatccaggcagcaacttctccgaaagacgtggtcattttagttgacgtcagtggcagcatgaaaggactccgtctgactatcgcgaagcaaacagtctcatccattttggatacacttggggatgatgacttcttcaacataattgcttataatgaggagcttcactatgtggaaccttgcctgaatggaactttggtgcaagccgacaggacaaacaaagagcacttcagggagcatctggacaaacttttcgccaaaggaattggaatgttggatatagctctgaatgaggccttcaacattctgagtgatttcaaccacacgggacaaggaagtatctgcagtcaggccatcatgctcataactgatggggcggtggacacctatgatacaatctttgcaaaatacaattggccagatcgaaaggttcgcatcttcacatacctcattggacgagaggctgcgtttgcagacaatctaaagtggatggcctgtgccaacaaaggattttttacccagatctccaccttggctgatgtgcaggagaatgtcatggaataccttcacgtgcttagccggcccaaagtcatcgaccaggagcatgatgtggtgtggaccgaagcttacattgacagcactctccctcaggcacaaaagctgactgatgatcagggccccgtcctgatgaccactgtagccatgcctgtgtttagtaagcagaacgaaaccagatcgaagggcattcttctgggagtggttggcacagatgtcccagtgaaagaacttctgaagaccatccccaaatacaagttagggattcacggttatgcctttgcaatcacaaataatggatatatcctgacgcatccggaactcaggctgctgtacgaagaaggaaaaaagcgaaggaaacctaactatagtagcgttgacctctctgaggtggagtgggaagaccgagatgacgtgttgagaaatgctatggtgaatcgaaagacggggaagttttccatggaggtgaagaagacagtggacaaagggtttaggtgtggcgctttccagaggtcatgggaaatatttcttccgagggaatgtaaccatcgaagaaggcctgcatgacttagaacatcccgatgtgtccttggcagatgaatggtcctactgcaacactgacctacaccctgagcaccgccatctgtctcagttagaagcgattaagctctacctaaaaggcaaagaacctctgctccagtgtgataaagaattgatccaagaagtcctttttgacgcggtggtgagtgcccccattgaagcgtatt

SEQ ID NO: 4127 - DNA, 3557 bp, Homo sapiens
gttgactgtgacacgggtgttacatatcttcctgtgccccttctccctgtagggtgaagctctgggcctcggcttttggtggggagataaaatccattgctgctaagtactccggttcccagcttctgcaaaagaaatacaaagagtatgagaaagacgttgccatagaagaaattgatggcctccaactggtaaagaagctggcaaagaacatggaagagatgtttcacaagaagtctgaggccgtcaggcgtctggtggaggctgcagaagaagcacacctgaaacatgaatttgatgcagacttacagtatgaatacttcaatgctgtgctgataaatgaaagggacaaagacgggaattttttggagctgggaaaggaattcatcttagccccaaatgaccattttaataatttgcctgtgaacatcagtctaagtgacgtccaagtaccaacgaacatgtacaacaaagaccctgcaattgtcaatggggtttattggtctgaatctctaaacaaagtttttgtagataactttgaccgtgacccatctctcatatggcagtactttggaagtgcaaagggcttttttaggcagtatccggggattaaatgggaaccagatgagaatggagtcattgccttcgactgcaggaaccgaaaatggtacatccaggcagcaacttctccgaaagacgtggtcattttagttgacgtcagtggcagcatgaaaggactccgtctgactatcgcgaagcaaacagtctcatccattttggatacacttggggatgatgacttcttcaacataattgcttataatgaggagcttcactatgtggaaccttgcctgaatggaactttggtgcaagccgacaggacaaacaaagagcacttcagggagcatctggacaaacttttcgccaaaggaattggaatgttggatatagctctgaatgaggccttcaacattctgagtgatttcaaccacacgggacaaggaagtatctgcagtcaggccatcatgctcataactgatggggcggtggacacctatgatacaatctttgcaaaatacaattggccagatcgaaaggttcgcatcttcacatacctcattggacgagaggctgcgtttgcagacaatctaaagtggatggcctgtgccaacaaaggattttttacccagatctccaccttggctgatgtgcaggagaatgtcatggaataccttcacgtgcttagccggcccaaagtcatcgaccaggagcatgatgtggtgtggaccgaagcttacattgacagcactctccctcaggcacaaaagctgactgatgatcagggccccgtcctgatgaccactgtagccatgcctgtgtttagtaagcagaacgaaaccagatcgaagggcattcttctgggagtggttggcacagatgtcccagtgaaagaacttctgaagaccatccccaaatacaagttagggattcacggttatgcctttgcaatcacaaataatggatatatcctgacgcatccggaactcaggctgctgtacgaagaaggaaaaaagcgaaggaaacctaactatagtagcgttgacctctctgaggtggagtgggaagaccgagatgacgtgttgagaaatgctatggtgaatcgaaagacggggaagttttccatggaggtgaagaagacagtggacaaagggaaacgggttttggtgatgacaaatgactactattatacagacatcaagggtactcctttcagtttaggtgtggcgctttccagaggtcatgggaaatatttcttccgagggaatgtaaccatcgaagaaggcctgcatgacttagaacatcccgatgtgtccttggcagatgaatggtcctactgcaacactgacctacaccctgagcaccgccatctgtctcagttagaagcgattaagctctacctaaaaggcaaagaacctctgctccagtgtgataaagaattgatccaagaagtcctttttgacgcggtggtgagtgcccccattgaagcgtattggaccagcctggccctcaacaaatctgaaaattctgacaagggcgtggaggttgccttcctcggcactcgcacgggcctctccagaatcaacctgtttgtcggggctgagcagctcaccaatcaggacttcctgaaagctggcgacaaggagaacatttttaacgcagaccatttccctctctggtaccgaagagccgctgagcagattccagggagcttcgtctactcgatcccattcagcactggaccagtcaataaaagcaatgtggtgacagcaagtacatccatccagctcctggatgaacggaaatctcctgtggtggcagctgtaggcattcagatgaaacttgaatttttccaaaggaagttctggactgccagcagacagtgtgcttccctggatggcaaatgctccatcagctgtgatgatgagactgtgaattgttacctcatagacaataatggatttattttggtgtctgaagactacacacagactggagacttttttggtgagatcgagggagctgtgatgaacaaattgctaacaatgggctcctttaaaagaattaccctttatgactaccaagccatgtgtagagccaacaaggaaagcagcgatggcgcccatggcctcctggatccttataatgccttcctctctgcagtaaaatggatcatgacagaacttgtcttgttcctggtggaatttaacctctgcagttggtggcactccgatatgacagctaaagcccagaaattgaaacagaccctggagccttgtgatactgaatatccagcattcgtctctgagcgcaccatcaaggagactacagggaatattgcttgtgaagactgctccaagtcctttgtcatccagcaaatcccaagcagcaacctgttcatggtggtggtggacagcagctgcctctgtgaatctgtggcccccatcaccatggcacccattgaaatcaggtataatgaatcccttaagtgtgaacgtctaaaggcccagaagatcagaaggcgcccagaatcttgtcatggcttccatcctgaggagaatgcaagggagtgtgggggtgcgccgagtctccaagcccagacagtcctccttctgctccctctgcttttgatgctcttctcaaggtgacactgactgagatgttctcttactgactgagatgttctcttggcatgctaaatcatggataaactgtgaaccaaaatatggtgcaacatacgagacatgaatatagtccaaccatcagcatctcatcatgattttaaactgtgcgtgatataaactcttaaagatatgttgacaaaaagttatctatcatctttttactttgccagtcatgcaaatgtgagtttgccacatgataatcacccttcatcagaaatgggaccgcaagtggtaggcagtgtcccttctgcttgaaacctattgaaaccaatttaaaactgtgtactttttaaataaagtatattaaaatcataa

SEQ ID NO: 4128 - DNA, 559 bp, Homo sapiens
cccctatatttatctttaacctcaagtgaatgttgctgcctttgtagttcatgagcaatgtatactcttgaattccagctctgtgaaatcggtagaaaatgagaaatacaaagagtatgagaaagacgttgccatagaagaaattgatggcctccaactggtaaagaagctggcaaagaacatggaagagatgtttcacaagaagtctgaggccgtcaggcgtctggtggaggctgcagaagaagcacacctgaaacatgaatttgatgcagacttacagtatgaatacttcaatgctgtgctgataaatgaaagggacaaagacgggaattttttggagctgggaaaggaattcatcttagccccaaatgaccattttaataatttgcctgtgaacatcagtctaagtgacgtccaagtaccaacgaacatgtacaacaaagaccctgcaattgtcaatggggtttattggtctgaatctctaaacaaagtttttgtagataactttgaccgtgacccatctctcatatggcagtactttggaagtgcaaagggcttt

SEQ ID NO: 4129 - DNA, 5934 bp, Homo sapiens
acagcctctcccccagtccctgtctccgaggcctgcttgctaggtggggcgactcttctgtgagctgcagctgtggggcagagagaagccctccccacccaggactgagaggctggagaccccaggctcgccaaggcacggaagacaaaggcctggggcgtcctggggtctgggaggaaggcagacagagctcatggtctgtggctgctctgccctccttcccctccccaaccccaggcccaccatgcctgcaactcccaacttcctcgcaaaccccagctccagcagccgctggattcccctccagccaatgcccgtggcctgggcctttgtgcagaagacctcggccctcctgtggctgctgcttctaggcacctccctgtcccctgcgtggggacaggccaagattcctctggaaacagtgaagctatgggctgacaccttcggcggggacctgtataacactgtgaccaaatactcaggctctctcttgctgcagaagaagtacaaggatgtggagtccagtctgaagatcgaggaggtggatggcttggagctggtgaggaagttctcagaggacatggagaacatgctgcggaggaaagtcgaggcggtccagaatctggtggaagctgccgaggaggccgacctgaaccacgaattcaatgaatccctggtgttcgactattacaactcggtcctgatcaacgagagggacgagaagggcaacttcgtggagctgggcgccgagttcctcctggagtccaatgctcacttcagcaacctgccggtgaacacctccatcagcagcgtgcagctgcccaccaacgtgtacaacaaagacccagatattttaaatggagtctacatgtctgaagccttgaatgctgtcttcgtggagaacttccagagagacccaacgttgacctggcaatattttggcagtgcaactggattcttcaggatctatccaggtataaaatggacacctgatgagaatggagtcattacttttgactgccgaaaccgcggctggtacattcaagctgctacttctcccaaggacatagtgattttggtggacgtgagcggcagtatgaaggggctgaggatgactattgccaagcacaccatcaccaccatcttggacaccctgggggagaatgacttcattaatatcatagcgtacaatgactacgtccattacatcgagccttgttttaaagggatcctcgtccaggcggaccgagacaatcgagagcatttcaaactgctggtggaggagttgatggtcaaaggtgtgggggtcgtggaccaagccctgagagaagccttccagatcctgaagcagttccaagaggccaagcaaggaagcctctgcaaccaggccatcatgctcatcagcgacggcgccgtggaggactacgagccggtgtttgagaagtataactggccagactgtaaggtccgagttttcacttacctcattgggagagaagtgtcttttgctgaccgcatgaagtggattgcatgcaacaacaaaggctactacacgcagatctcaacgctggcggacacccaggagaacgtgatggaatacctgcacgtgctcagccgccccatggtcatcaaccacgaccacgacatcatctggacagaggcctacatggacagcaagctcctcagctcgcaggctcagagcctgacactgctcaccactgtggccatgccagtcttcagcaagaagaacgaaacgcgatcccatggcattctcctgggtgtggtgggctcagatgtggccctgagagagctgatgaagctggcgccccggtacaagcttggagtgcacggatacgcctttctgaacaccaacaatggctacatcctctcccatcccgacctccggcccctgtacagagaggggaagaaactaaaacccaaacctaactacaacagtgtggatctctccgaagtggagtgggaagaccaggctgaatctctgagaacagccatgatcaatagggaaacaggtactctctcgatggatgtgaaggttccgatggataaagggaagcgagttcttttcctgaccaatgactacttcttcacggacatcagcgacacccctttcagtttgggggtggtgctgtcccggggccacggagaatacatccttctggggaacacgtctgtggaagaaggcctgcatgacttgcttcacccagacctggccctggccggtgactggatctactgcatcacagatattgacccagaccaccggaagctcagccagctagaggccatgatccgcttcctcaccaggaaggacccagacctggagtgtgacgaggagctggtccgggaggtgctgtttgacgcggtggtgacagcccccatggaagcctactggacagcgctggccctcaacatgtccgaggagtctgaacacgtggtggacatggccttcctgggcacccgggctggcctcctgagaagcagcttgttcgtgggctccgagaaggtctccgacaggaagttcctgacacctgaggacgaggccagcgtgttcaccctggaccgcttcccgctgtggtaccgccaggcctcagagcatcctgctggcagcttcgtcttcaacctccgctgggcagaaggaccagaaagtgcgggtgaacccatggtggtgacggcaagcacagctgtggcggtgaccgtggacaagaggacagccattgctgcagccgcgggcgtccaaatgaagctggaattcctccagcgcaaattctgggcggcaacgcggcagtgcagcactgtggatgggccgtgcacacagagctgcgaggacagtgatctggactgcttcgtcatcgacaacaacgggttcattctgatctccaagaggtcccgagagacgggaagatttctgggggaggtggatggtgctgtcctgacccagctgctcagcatgggggtgttcagccaagtgactatgtatgactatcaggccatgtgcaaaccctcgagtcaccaccacagtgcagcccagcccctggtcagcccaatttctgccttcttgacggcgaccaggtggctgctgcaggagctggtgctgtgagtgggggtagacacggggctggtggagggctgcatgcgagggtggcttaggagggtgtccttgagcaggaggctgcaaggtctccaggacaacccacttgctaccagaccccggggaaggagggcacaatccctgggcatggacgccacctcttccctgcatgctgcccctgggagggacctcattgctcaaccagagccctcaagcagggaagagggtgtcctggaggagaggggatgggccgggggctgtcagggatactccagctccttgggaacccaagtcgggagggctcagaggtctccgagattcagtcctgtgtctgacaggttcctgctggagtggagtgtctggggctcctggtacgacagaggggccgagggtgagtgcacggagctgcagggccatgtgctgaagagcagtggcattttggtccactaacgtgagaccattccctgtggggtgggtgacagtggggataggtgaccctgaagcatcgttgttcacatctcaccctgcgtggccttctctcatcacatccctcactcctggctctgtgtgtgacatcatcttgggacaccgccactccatgtgccatcatcaccaccccatgacatcctgccctcatgtgccaccatgttttcctgtgccgtgtccaccctgtgctgggcttatgttccggccagccaaaagtgtcttccatcactcccacaaacacaagaagcaggacccgctgcagccctgcgacacggagtaccccgtgttcgtgtaccagccggccatccgggaggccaacgggatcgtggagtgcgggccctgccagaaggtatttgtggtgcagcagattcccaacagtaacctcctcctcctggtgacagaccccacctgtgactgcagcatcttcccaccagtgctgcaggaggcgacagaagtcaaataatgcctctgtcaaatgtgaccggatgcgctcccagaagctccgccggcgaccagactcctgccacgccttccatccagaggagaatgcccaggactgcggcggcgcctcggacacctcagcctcgccgcccctactcctgctgcctgtgtgtgcctgggggctactgccccaactcctgcggtgacaccacccagcctgacctgtgttttggcaaggtgatccttccagagccatcccaaaaagtcagcactgacatgggatgcagctaactgcagttgggtcgcccccaggccaacgctcctctcaatcctgggctggtggcccctggctccggagaatgctggatggaacaggaaaccaatcacctggcaccactttcaagatgcttcatggtgcccggtaccatctgccctaggtctcaacatgagcatacttctgacctaaccttcctgtctcctcttcgggaagccagcgtgagctcagcttggaccaagacaaaataatttagttcttcctgtactccagagtccagacccagccaagaaagggtcagttgtttctgaccctttctgtcggagtggtctctggtagaacccaaggacttctgggtactgagaagcagcagcagaatgaggccaaatgcagagatgaggctaaggcaagaatatgccccaactaaagcatagattccccaaagtgaggctcatggtgggaggccactcaccttcctagctgctgctcgaaaaggttttgactgtgttggggtgggggttgggtaagggaatggtcaagactgagaaaggaatgaaatccattcaggaaatatcgacagggctacacgtgatgtccccaaactgctgctattgaagaacttcccaaaacttctttacaaagccctaaaggaaagtttgcatctatgaaaagccaataggctgagacatccaattgctgcatggaaattgatgtacattcaggggacggcaaaaatagctgtaaaatagtgaaaaagagcagtggttgtgctcttttctggccaatgatttacaaaagaatctacttgactctgtccctggagtgaaatccttagggttggaacttgtgggaacattccaacttgctaagcagggtccactgggagggaagctctatctgggaactcacccccagcgcacacacatctcccccagggtcccaaggccccgcagcttcctcccccgaccaaaccccaagacctggatcccaggagacaacagtctccacagtgagagcaacattaagggcaaagccatggagaaatgtgggagaggccggcctcaaatctttccatttaacaaaccccagtgatgggtatggacagcatgcagggcttttggggcgcttccccccgctcctccatcaccctcagcctccacacttcaaagttcaagttcaaagctgttcaagtttcctaccagcaaatagccctaacttgcctctagagtaggccaaatgccaactctgtaaaacacacttacattatcggttacagaatgtcactcttaccgtcatgtcttgcaacaaccctgtgagggcagtattaatgcccccttacagcagaagacactgcagctcgaagacagcttaagtggcagaataatgctagaacagctaaggtttacatgtaccaaataacatgtttcagctcattccatcctcacaacagccccctgaaagtgggtactatcattagtcccatgttatagaaactgcagcagagttgaaaattgcctccaaattaccggaagagtgtatgaagattgaatgtgatgtattcacgtaacatgcttgaaactgcctggcatatactaaacgctaaataaatacatgctaactgcga

SEQ ID NO: 4130 - DNA, 4601 bp, Homo sapiens
cacaggaacggggctgcctctttaaagcagaggggtgcactatagccctgagggaaccagctgcagttgtggtaatcttgggaggcagctccccaccccctgccaccccctccctgctgtcaggagaggattagaggagaggccagcggattaaagggtttcatgttgccacagcctctcccccagtccctgtctccgaggcctgcttgctaggtggggcgactcttctgtgagctgcagctgtggggcagagagaagccctccccacccaggactgagaggctggagaccccaggctcgccaaggcacggaagacaaaggcctggggcgtcctggggtctgggaggaaggcagacagagctcatggtctgtggctgctctgccctccttcccctccccaaccccaggcccaccatgcctgcaactcccaacttcctcgcaaaccccagctccagcagccgctggattcccctccagccaatgcccgtggcctgggcctttgtgcagaagacctcggccctcctgtggctgctgcttctaggcacctccctgtcccctgcgtggggacaggccaagattcctctggaaacagtgaagctatgggctgacaccttcggcggggacctgtataacactgtgaccaaatactcaggctctctcttgctgcagaagaagtacaaggatgtggagtccagtctgaagatcgaggaggtggatggcttggagctggtgaggaagttctcagaggacatggagaacatgctgcggaggaaagtcgaggcggtccagaatctggtggaagctgccgaggaggccgacctgaaccacgaattcaatgaatccctggtgttcgactattacaactcggtcctgatcaacgagagggacgagaagggcaacttcgtggagctgggcgccgagttcctcctggagtccaatgctcacttcagcaacctgccggtgaacacctccatcagcagcgtgcagctgcccaccaacgtgtacaacaaagacccagatattttaaatggagtctacatgtctgaagccttgaatgctgtcttcgtggagaacttccagagagacccaacgttgacctggcaatattttggcagtgcaactggattcttcaggatctatccaggtataaaatggacacctgatgagaatggagtcattacttttgactgccgaaaccgcggctggtacattcaagctgctacttctcccaaggacatagtgattttggtggacgtgagcggcagtatgaaggggctgaggatgactattgccaagcacaccatcaccaccatcttggacaccctgggggagaatgacttcattaatatcatagcgtacaatgactacgtccattacatcgagccttgttttaaagggatcctcgtccaggcggaccgagacaatcgagagcatttcaaactgctggtggaggagttgatggtcaaaggtgtgggggtcgtggaccaagccctgagagaagccttccagatcctgaagcagttccaagaggccaagcaaggaagcctctgcaaccaggccatcatgctcatcagcgacggcgccgtggaggactacgagccggtgtttgagaagtataactggccagactgtaaggtccgagttttcacttacctcattgggagagaagtgtcttttgctgaccgcatgaagtggattgcatgcaacaacaaaggctactacacgcagatctcaacgctggcggacacccaggagaacgtgatggaatacctgcacgtgctcagccgccccatggtcatcaaccacgaccacgacatcatctggacagaggcctacatggacagcaagctcctcagctcgcaggctcagagcctgacactgctcaccactgtggccatgccagtcttcagcaagaagaacgaaacgcgatcccatggcattctcctgggtgtggtgggctcagatgtggccctgagagagctgatgaagctggcgccccggtacaagcttggagtgcacggatacgcctttctgaacaccaacaatggctacatcctctcccatcccgacctccggcccctgtacagagaggggaagaaactaaaacccaaacctaactacaacagtgtggatctctccgaagtggagtgggaagaccaggctgaatctctgagaacagccatgatcaatagggaaacaggtactctctcgatggatgtgaaggttccgatggataaagggaagcgagttcttttcctgaccaatgactacttcttcacggacatcagcgacacccctttcagtttgggggtggtgctgtcccggggccacggagaatacatccttctggggaacacgtctgtggaagaaggcctgcatgacttgcttcacccagacctggccctggccggtgactggatctactgcatcacagatattgacccagaccaccggaagctcagccagctagaggccatgatccgcttcctcaccaggaaggacccagacctggagtgtgacgaggagctggtccgggaggtgctgtttgacgcggtggtgacagcccccatggaagcctactggacagcgctggccctcaacatgtccgaggagtctgaacacgtggtggacatggccttcctgggcacccgggctggcctcctgagaagcagcttgttcgtgggctccgagaaggtctccgacaggaagttcctgacacctgaggacgaggccagcgtgttcaccctggaccgcttcccgctgtggtaccgccaggcctcagagcatcctgctggcagcttcgtcttcaacctccgctgggcagaaggaccagaaagtgcgggtgaacccatggtggtgacggcaagcacagctgtggcggtgaccgtggacaagaggacagccattgctgcagccgcgggcgtccaaatgaagctggaattcctccagcgcaaattctgggcggcaacgcggcagtgcagcactgtggatgggccgtgcacacagagctgcgaggacagtgatctggactgcttcgtcatcgacaacaacgggttcattctgatctccaagaggtcccgagagacgggaagatttctgggggaggtggatggtgctgtcctgacccagctgctcagcatgggggtgttcagccaagtgactatgtatgactatcaggccatgtgcaaaccctcgagtcaccaccacagtgcagcccagcccctggtcagcccaatttctgccttcttgacggcgaccaggtggctgctgcaggagctggtgctgttcctgctggagtggagtgtctggggctcctggtacgacagaggggccgaggccaaaagtgtcttccatcactcccacaaacacaagaagcaggacccgctgcagccctgcgacacggagtaccccgtgttcgtgtaccagccggccatccgggaggccaacgggatcgtggagtgcgggccctgccagaaggtatttgtggtgcagcagattcccaacagtaacctcctcctcctggtgacagaccccacctgtgactgcagcatcttcccaccagtgctgcaggaggcgacagaagtcaaatataatgcctctgtcaaatgtgaccggatgcgctcccagaagctccgccggcgaccagactcctgccacgccttccatccagaggagaatgcccaggactgcggcggcgcctcggacacctcagcctcgccgcccctactcctgctgcctgtgtgtgcctgggggctactgccccaactcctgcggtgacaccacccagcctgacctgtgttttggcaaggtgatccttccagagccatcccaaaaagtcagcactgacatgggatgcagctaactgcagttgggtcgcccccaggccaacgctcctctcaatcctgggctggtggcccctggctccggagaatgctggatggaacaggaaaccaatcacctggcaccactttcaagatgcttcatggtgcccggtaccatctgccctaggtctcaacatgagcatacttctgacctaaccttcctgtctcctcttcgggaagccagcgtgagctcagcttggaccaagacaaaataatttagttcttcctgtactccagagtccagacccagccaagaaagggtcagttgtttctgaccctttctgtcggagtggtctctggtagaacccaaggacttctgggtactgagaagcagcagcagaatgaggccaaatgcagagatgaggctaaggcaagaatatgccccaactaaagcatagattccccaaagtgaggctcatggtgggaggccactcaccttcctagctgctgctcgaaaaggttttgactgtgttggggtgggggttgggtaagggaatggtcaagactgagaaaggaatgaaatccattcaggaaatatcgacagggctacacgtgatgtccccaaactgctgctattgaagaacttcccaaaacttctttacaaagccctaaaggaaagtttgcatctatgaaaagccaataggctgagacatccaattgctgcatggaaattgatgtacattcaggggacggcaaaaatagctgtaaaatagtgaaaaa

SEQ ID NO: 4131 - DNA, 4920 bp, Homo sapiens
atggctgtagctttagggacaaggaggagggacagagtgaagctatgggctgacaccttcggcggggacctgtataacactgtgaccaaatactcaggctctctcttgctgcagaagaagtacaaggatgtggagtccagtctgaagatcgaggaggtggatggcttggagctggtgaggaagttctcagaggacatggagaacatgctgcggaggaaagtcgaggcggtccagaatctggtggaagctgccgaggaggccgacctgaaccacgaattcaatgaatccctggtgttcgactattacaactcggtcctgatcaacgagagggacgagaagggcaacttcgtggagctgggcgccgagttcctcctggagtccaatgctcacttcagcaacctgccggtgaacacctccatcagcagcgtgcagctgcccaccaacgtgtacaacaaagacccagatattttaaatggagtctacatgtctgaagccttgaatgctgtcttcgtggagaacttccagagagacccaacgttgacctggcaatattttggcagtgcaactggattcttcaggatctatccaggtataaaatggacacctgatgagaatggagtcattacttttgactgccgaaaccgcggctggtacattcaagctgctacttctcccaaggacatagtgattttggtggacgtgagcggcagtatgaaggggctgaggatgactattgccaagcacaccatcaccaccatcttggacaccctgggggagaatgacttcattaatatcatagcgtacaatgactacgtccattacatcgagccttgttttaaagggatcctcgtccaggcggaccgagacaatcgagagcatttcaaactgctggtggaggagttgatggtcaaaggtgtgggggtcgtggaccaagccctgagagaagccttccagatcctgaagcagttccaagaggccaagcaaggaagcctctgcaaccaggccatcatgctcatcagcgacggcgccgtggaggactacgagccggtgtttgagaagtataactggccagactgtaaggtccgagttttcacttacctcattgggagagaagtgtcttttgctgaccgcatgaagtggattgcatgcaacaacaaaggctactacacgcagatctcaacgctggcggacacccaggagaacgtgatggaatacctgcacgtgctcagccgccccatggtcatcaaccacgaccacgacatcatctggacagaggcctacatggacagcaagctcctcagctcgcaggctcagagcctgacactgctcaccactgtggccatgccagtcttcagcaagaagaacgaaacgcgatcccatggcattctcctgggtgtggtgggctcagatgtggccctgagagagctgatgaagctggcgccccggtacaagcttggagtgcacggatacgcctttctgaacaccaacaatggctacatcctctcccatcccgacctccggcccctgtacagagaggggaagaaactaaaacccaaacctaactacaacagtgtggatctctccgaagtggagtgggaagaccaggctgaatctctgagaacagccatgatcaatagggaaacaggtactctctcgatggatgtgaaggttccgatggataaagggaagcgagttcttttcctgaccaatgactacttcttcacggacatcagcgacacccctttcagtttgggggtggtgctgtcccggggccacggagaatacatccttctggggaacacgtctgtggaagaaggcctgcatgacttgcttcacccagacctggccctggccggtgactggatctactgcatcacagatattgacccagaccaccggaagctcagccagctagaggccatgatccgcttcctcaccaggaaggacccagacctggagtgtgacgaggagctggtccgggaggtgctgtttgacgcggtggtgacagcccccatggaagcctactggacagcgctggccctcaacatgtccgaggagtctgaacacgtggtggacatggccttcctgggcacccgggctggcctcctgagaagcagcttgttcgtgggctccgagaaggtctccgacaggaagttcctgacacctgaggacgaggccagcgtgttcaccctggaccgcttcccgctgtggtaccgccaggcctcagagcatcctgctggcagcttcgtcttcaacctccgctgggcagaaggaccagaaagtgcgggtgaacccatggtggtgacggcaagcacagctgtggcggtgaccgtggacaagaggacagccattgctgcagccgcgggcgtccaaatgaagctggaattcctccagcgcaaattctgggcggcaacgcggcagtgcagcactgtggatgggccgtgcacacagagctgcgaggacagtgatctggactgcttcgtcatcgacaacaacgggttcattctgatctccaagaggtcccgagagacgggaagatttctgggggaggtggatggtgctgtcctgacccagctgctcagcatgggggtgttcagccaagtgactatgtatgactatcaggccatgtgcaaaccctcgagtcaccaccacagtgcagcccagcccctggtcagcccaatttctgccttcttgacggcgaccaggtggctgctgcaggagctggtgctgttcctgctggagtggagtgtctggggctcctggtacgacagaggggccgaggccaaaagtgtcttccatcactcccacaaacacaagaagcaggacccgctgcagccctgcgacacggagtaccccgtgttcgtgtaccagccggccatccgggaggccaacgggatcgtggagtgcgggccctgccagaaggtatttgtggtgcagcagattcccaacagtaacctcctcctcctggtgacagaccccacctgtgactgcagcatcttcccaccagtgctgcaggaggcgacagaagtcaaatataatgcctctgtcaaatgtgaccggatgcgctcccagaagctccgccggcgaccagactcctgccacgccttccatccagaggagaatgcccaggactgcggcggcgcctcggacacctcagcctcgccgcccctactcctgctgcctgtgtgtgcctgggggctactgccccaactcctgcggtgacaccacccagcctgacctgtgttttggcaaggtgatccttccagagccatcccaaaaagtcagcactgacatgggatgcagctaactgcagttgggtcgcccccaggccaacgctcctctcaatcctgggctggtggcccctggctccggagaatgctggatggaacaggaaaccaatcacctggcaccactttcaagatgcttcatggtgcccggtaccatctgccctaggtctcaacatgagcatacttctgacctaaccttcctgtctcctcttcgggaagccagcgtgagctcagcttggaccaagacaaaataatttagttcttcctgtactccagagtccagacccagccaagaaagggtcagttgtttctgaccctttctgtcggagtggtctctggtagaacccaaggacttctgggtactgagaagcagcagcagaatgaggccaaatgcagagatgaggctaaggcaagaatatgccccaactaaagcatagattccccaaagtgaggctcatggtgggaggccactcaccttcctagctgctgctcgaaaaggttttgactgtgttggggtgggggttgggtaagggaatggtcaagactgagaaaggaatgaaatccattcaggaaatatcgacagggctacacgtgatgtccccaaactgctgctattgaagaacttcccaaaacttctttacaaagccctaaaggaaagtttgcatctatgaaaagccaataggctgagacatccaattgctgcatggaaattgatgtacattcaggggacggcaaaaatagctgtaaaatagtgaaaaagagcagtggttgtgctcttttctggccaatgatttacaaaagaatctacttgactctgtccctggagtgaaatccttagggttggaacttgtgggaacattccaacttgctaagcagggtccactgggagggaagctctatctgggaactcacccccagcgcacacacatctcccccagggtcccaaggccccgcagcttcctcccccgaccaaaccccaagacctggatcccaggagacaacagtctccacagtgagagcaacattaagggcaaagccatggagaaatgtgggagaggccggcctcaaatctttccatttaacaaaccccagtgatgggtatggacagcatgcagggcttttggggcgcttccccccgctcctccatcaccctcagcctccacacttcaaagttcaagttcaaagctgttcaagtttcctaccagcaaatagccctaacttgcctctagagtaggccaaatgccaactctgtaaaacacacttacattatcggttacagaatgtcactcttaccgtcatgtcttgcaacaaccctgtgagggcagtattaatgcccccttacagcagaagacactgcagctcgaagacagcttaagtggcagaataatgctagaacagctaaggtttacatgtaccaaataacatgtttcagctcattccatcctcacaacagccccctgaaagtgggtactatcattagtcccatgttatagaaactgcagcagagttgaaaattgcctccaaattaccggaagagtgtatgaagattgaatgtgatgtattcacgtaacatgcttgaaactgcctggcatatactaaacgctaaataaatacatgctaactgcgatcatta

SEQ ID NO: 4132 - DNA, 2876 bp, Homo sapiens
ggagctggtccgggaggtgctgtttgacgcggtggtgacagcccccatggaagcctactggacagcgctggccctcaacatgtccgaggagtctgaacacgtggtggacatggccttcctgggcacccgggctggcctcctgagaagcagcttgttcgtgggctccgagaaggtctccgacaggaagttcctgacacctgaggacgaggccagcgtgttcaccctggaccgcttcccgctgtggtaccgccaggcctcagagcatcctgctggcagcttcgtcttcaacctccgctgggcagaaggaccagaaagtgcgggtgaacccatggtggtgacggcaagcacagctgtggcggtgaccgtggacaagaggacagccattgctgcagccgcgggcgtccaaatgaagctggaattcctccagcgcaaattctgggcggcaacgcggcagtgcagcactgtggatgggccgtgcacacagagctgcgaggacagtgatctggactgcttcgtcatcgacaacaacgggttcattctgatctccaagaggtcccgagagagtgactatgtatgactatcaggccatgtgcaaaccctcgagtcaccaccacagtgcagcccagcccctggtcagcccaatttctgccttcttgacggcgaccaggtggctgctgcaggagctggtgctgttcctgctggagtggagtgtctggggctcctggtacgacagaggggccgaggccaaaagtgtcttccatcactcccacaaacacaagaagcaggacccgctgcagccctgcgacacggagtaccccgtgttcgtgtaccagccggccatccgggaggccaacgggatcgtggagtgcgggccctgccagaaggtatttgtggtgcagcagattcccaacagtaacctcctcctcctggtgacagaccccacctgtgactgcagcatcttcccaccagtgctgcaggaggcgacagaagtcaaatataatgcctctgtcaaatgtgaccggatgcgctcccagaagctccgccggcgaccagactcctgccacgccttccatccagaggagaatgcccaggactgcggcggcgcctcggacacctcagcctcgccgcccctactcctgctgcctgtgtgtgcctgggggctactgccccaactcctgcggtgacaccacccagcctgacctgtgttttggcaaggtgatccttccagagccatcccaaaaagtcagcactgacatgggatgcagctaactgcagttgggtcgcccccaggccaacgctcctctcaatcctgggctggtggcccctggctccggagaatgctggatggaacaggaaaccaatcacctggcaccactttcaagatgcttcatggtgcccggtaccatctgccctaggtctcaacatgagcatacttctgacctaaccttcctgtctcctcttcgggaagccagcgtgagctcagcttggaccaagacaaaataatttagttcttcctgtactccagagtccagacccagccaagaaagggtcagttgtttctgaccctttctgtcggagtggtctctggtagaacccaaggacttctgggtactgagaagcagcagcagaatgaggccaaatgcagagatgaggctaaggcaagaatatgccccaactaaagcatagattccccaaagtgaggctcatggtgggaggccactcaccttcctagctgctgctcgaaaaggttttgactgtgttggggtgggggttgggtaagggaatggtcaagactgagaaaggaatgaaatccattcaggaaatatcgacagggctacacgtgatgtccccaaactgctgctattgaagaacttcccaaaacttctttacaaagccctaaaggaaagtttgcatctatgaaaagccaataggctgagacatccaattgctgcatggaaattgatgtacattcaggggacggcaaaaatagctgtaaaatagtgaaaaagagcagtggttgtgctcttttctggccaatgatttacaaaagaatctacttgactctgtccctggagtgaaatccttagggttggaacttgtgggaacattccaacttgctaagcagggtccactgggagggaagctctatctgggaactcacccccagcgcacacacatctcccccagggtcccaaggccccgcagcttcctcccccgaccaaaccccaagacctggatcccaggagacaacagtctccacagtgagagcaacattaagggcaaagccatggagaaatgtgggagaggccggcctcaaatctttccatttaacaaaccccagtgatgggtatggacagcatgcagggcttttggggcgcttccccccgctcctccatcaccctcagcctccacacttcaaagttcaagttcaaagctgttcaagtttcctaccagcaaatagccctaacttgcctctagagtaggccaaatgccaactctgtaaaacacacttacattatcggttacagaatgtcactcttaccgtcatgtcttgcaacaaccctgtgagggcagtattaatgcccccttacagcagaagacactgcagctcgaagacagcttaagtggcagaataatgctagaacagctaaggtttacatgtaccaaataacatgtttcagctcattccatcctcacaacagccccctgaaagtgggtactatcattagtcccatgttatagaaactgcagcagagttgaaaattgcctccaaattaccggaagagtgtatgaagattgaatgtgatgtattcacgtaacatgcttgaaactgcctggcatatactaaacgctaaataaatacatgctaactgcga

SEQ ID NO: 4133 - DNA, 1498 bp, Homo sapiens
aacttgactctatttttttctctccccgtctcttccctggccttgccctctctctttctgccctgtagccgcgggcgtccaaatgaagctggaattcctccagcgcaaattctgggcggcaacgcggcaggatctggactgcttcgtcatcgacaacaacgggttcattctgatctccaagaggtcccgagagacgggaagatttctgggggaggtggatggtgctgtcctgacccagctgctcagcatgggggtgttcagccaagtgactatgtatgactatcaggccatgtgcaaaccctcgagtcaccaccacagtgcagcccagcccctggtcagcccaatttctgccttcttgacggcgaccaggtggctgctgcaggagctggtgctgttcctgctggagtggagtgtctggggctcctggtacgacagaggggccgaggccaaaagtgtcttccatcactcccacaaacacaagaagcaggacccgctgcagccctgcgacacggagtaccccgtgttcgtgtaccagccggccatccgggaggccaacgggatcgtggagtgcgggccctgccagaaggtatttgtggtgcagcagattcccaacagtaacctcctcctcctggtgacagaccccacctgtgactgcagcatcttcccaccagtgctgcaggaggcgacagaagtcaaatataatgcctctgtcaaatgtgaccggatgcgctcccagaagctccgccggcgaccagactcctgccacgccttccatccagaggagaatgcccaggactgcggcggcgcctcggacacctcagcctcgccgcccctactcctgctgcctgtgtgtgcctgggggctactgccccaactcctgcggtgacaccacccagcctgacctgtgttttggcaaggtgatccttccagagccatcccaaaaagtcagcactgacatgggatgcagctaactgcagttgggtcgcccccaggccaacgctcctctcaatcctgggctggtggcccctggctccggagaatgctggatggaacaggaaaccaatcacctggcaccactttcaagatgcttcatggtgcccggtaccatctgccctaggtctcaacatgagcatacttctgacctaaccttcctgtctcctcttcgggaagccagcgtgagctcagcttggaccaagacaaaataatttagttcttcctgtactccagagtccagacccagccaagaaagggtcagttgtttctgaccctttctgtcggagtggtctctggtagaacccaaggacttctgggtactgagaagcagcagcagaatgaggccaaatgcagagatgaggctaaggcaagaatatgccccaactaaagcatagattccccaaagtgaggctcatggtgggaggccactcaccttcctagctgctgctcgaaaaggttttgactgtgttggggtgggggttgggtaagggaatggtcaagactg

SEQ ID NO: 4134 - DNA, 1498 bp, Homo sapiens; identical to SEQ ID NO: 4133

SEQ ID NO: 4135 - DNA, 1619 bp, Homo sapiens
gtagccgcgggcgtccaaatgaagctggaattcctccagcgcaaattctgggcggcaacgcggcaggatctggactgcttcgtcatcgacaacaacgggttcattctgatctccaagaggtcccgagagagtgactatgtatgactatcaggccatgtgcaaaccctcgagtcaccaccacagtgcagcccagcccctggtcagcccaatttctgccttcttgacggcgaccaggtggctgctgcaggagctggtgctgttcctgctggagtggagtgtctggggctcctggtacgacagaggggccgaggccaaaagtgtcttccatcactcccacaaacacaagaagcaggacccgctgcagccctgcgacacggagtaccccgtgttcgtgtaccagccggccatccgggaggccaacgggatcgtggagtgcgggccctgccagaaggtatttgtggtgcagcagattcccaacagtaacctcctcctcctggtgacagaccccacctgtgactgcagcatcttcccaccagtgctgcaggaggcgacagaagtcaaatataatgcctctgtcaaatgtgaccggatgcgctcccagaagctccgccggcgaccagactcctgccacgccttccatccagaggagaatgcccaggactgcggcggcgcctcggacacctcagcctcgccgcccctactcctgctgcctgtgtgtgcctgggggctactgccccaactcctgcggtgacaccacccagcctgacctgtgttttggcaaggtgatccttccagagccatcccaaaaagtcagcactgacatgggatgcagctaactgcagttgggtcgcccccaggccaacgctcctctcaatcctgggctggtggcccctggctccggagaatgctggatggaacaggaaaccaatcacctggcaccactttcaagatgcttcatggtgcccggtaccatctgccctaggtctcaacatgagcatacttctgacctaaccttcctgtctcctcttcgggaagccagcgtgagctcagcttggaccaagacaaaataatttagttcttcctgtactccagagtccagacccagccaagaaagggtcagttgtttctgaccctttctgtcggagtggtctctggtagaacccaaggacttctgggtactgagaagcagcagcagaatgaggccaaatgcagagatgaggctaaggcaagaatatgccccaactaaagcatagattccccaaagtgaggctcatggtgggaggccactcaccttcctagctgctgctcgaaaaggttttgactgtgttggggtgggggttgggtaagggaatggtcaagactgagaaaggaatgaaatccattcaggaaatatcgacagggctacacgtgatgtccccaaactgctgctattgaagaacttcccaaaacttctttacaaagccctaaaggaaagtttgcatctatgaaaagccaataggctgagacatccaattgctgcatggaaattgatgtacattcaggggacggcaaaaatagctgtaaaatagtgaaaaagagcagtggttgtgctcttttctggccaatgatttacaaaagaa

SEQ ID NO: 4136 - DNA, 1835 bp, Homo sapiens
cgagggaaggcaggaaggaggcagccgaaggccgagctgggtggctggaccgggtgctggctgcgccgcgctgctttcggctcccacggcctctcccatgcgctgagggagcccggctgggccgggccggcggcgggaggggaggctcctctccatggtccagaagaccagcatgtcccggggcccttacccaccctcccaggagatccccatggaggtcttcgaccccagcccgcagggcaaatacagcaagaggaaagggcgattcaaacggtcagatgggagcacgtcctcggataccacatccaacagctttgtccgccagggctcagcggagtcctacaccagccgtccatcagactctgatgtatctctggaggaggaccgggaagccttaaggaaggaagcagagcgccaggcattagcgcagctcgagaaggccaagaccaagccagtggcatttgctgtgcggacaaatgttggctacaatccgtctccaggggatgaggtgcctgtgcagggagtggccatcaccttcgagcccaaagacttcctgcacatcaaggagaaatacaataatgactggtggatcgggcggctggtgaaggagggctgtgaggttggcttcattcccagccccgtcaaactggacagccttcgcctgctgcaggaacagaagctgcgccagaaccgcctcggctccagcaaatcaggcgataactccagttccagtctgggagatgtggtgactggcacccgccgccccacaccccctgccagtggtaatgaaatgactaacttagcctttgaactagaccccctagagttagaggaggaagaggctgagcttggtgagcagagtggctctgccaagactagtgttagcagtgtcaccaccccgccaccccatggcaaacgcatccccttctttaagaagacagagcatgtgcccccctatgacgtggtgccttccatgaggcccatcatcctggtgggaccgtcgctcaagggctacgaggttacagacatgatgcagaaagctttatttgacttcttgaagcatcggtttgatggcaggatctccatcactcgtgtgacggcagatatttccctggctaagcgctcagttctcaacaaccccagcaaacacatcatcattgagcgctccaacacacgctccagcctggctgaggtgcagagtgaaatcgagcgaatcttcgagctggcccggacccttcagttggtcgctctggatgctgacaccatcaatcacccagcccagctgtccaagacctcgctggcccccatcattgtttacatcaagatcacctctcccaaggtacttcaaaggctcatcaagtcccgaggaaagtctcagtccaaacacctcaatgtccaaatagcggcctcggaaaagctggcacagtgcccccctgaaatgtttgacatcatcctggatgagaaccaattggaggatgcctgcgagcatctggcggagtacttggaagcctattggaaggccacacacccgcccagcagcacgccacccaatccgctgctgaaccgcaccatggctaccgcagccctggctgccagccctgcccctgtctccaacctccaggtacaggtgctcacctcgctcaggagaaacctcggcttctggggcgggctggagtcctcacagcggggcagtgtggtgccccaggagcaggaacatgccatgtagtgggcgccctgcccgtcttccctcctgctctggggtcggaactggagtgcagggaacatggaggaggaagggaagagctttattttgtaaaaaaataagatgagcggca

SEQ ID NO: 4137 - DNA, 3343 bp, Homo sapiens
cgagggaaggcaggaaggaggcagccgaaggccgagctgggtggctggaccgggtgctggctgcgccgcgctgctttcggctcccacggcctctcccatgcgctgagggagcccggctgggccgggccggcggcgggaggggaggctcctctccatggtccagaagaccagcatgtcccggggcccttacccaccctcccaggagatccccatggaggtcttcgaccccagcccgcagggcaaatacagcaagaggaaagggcgattcaaacggtcagatgggagcacgtcctcggataccacatccaacagctttgtccgccagggctcagcggagtcctacaccagccgtccatcagactctgatgtatctctggaggaggaccgggaagccttaaggaaggaagcagagcgccaggcattagcgcagctcgagaaggccaagaccaagccagtggcatttgctgtgcggacaaatgttggctacaatccgtctccaggggatgaggtgcctgtgcagggagtggccatcaccttcgagcccaaagacttcctgcacatcaaggagaaatacaataatgactggtggatcgggcggctggtgaaggagggctgtgaggttggcttcattcccagccccgtcaaactggacagccttcgcctgctgcaggaacagaagctgcgccagaaccgcctcggctccagcaaatcaggcgataactccagttccagtctgggagatgtggtgactggcacccgccgccccacaccccctgccagtgccaaacagaagcagaagtcgacagagcatgtgcccccctatgacgtggtgccttccatgaggcccatcatcctggtgggaccgtcgctcaagggctacgaggttacagacatgatgcagaaagctttatttgacttcttgaagcatcggtttgatggcaggatctccatcactcgtgtgacggcagatatttccctggctaagcgctcagttctcaacaaccccagcaaacacatcatcattgagcgctccaacacacgctccagcctggctgaggtgcagagtgaaatcgagcgaatcttcgagctggcccggacccttcagttggtcgctctggatgctgacaccatcaatcacccagcccagctgtccaagacctcgctggcccccatcattgtttacatcaagatcacctctcccaaggtacttcaaaggctcatcaagtcccgaggaaagtctcagtccaaacacctcaatgtccaaatagcggcctcggaaaagctggcacagtgcccccctgaaatgtttgacatcatcctggatgagaaccaattggaggatgcctgcgagcatctggcggagtacttggaagcctattggaaggccacacacccgcccagcagcacgccacccaatccgctgctgaaccgcaccatggctaccgcagccctggctgccagccctgcccctgtctccaacctccagggaccctaccttgcttccggggaccagccactggaacgggccaccggggagcacgccagcatgcacgagtacccaggggagctgggccagcccccaggcctttaccccagcagccacccaccaggccgggcaggcacgctacgggcactgtcccgccaagacacttttgatgccgacacccccggcagccgaaactctgcctacacggagctgggagactcatgtgtggacatggagactgacccctcagaggggccagggcttggagaccctgcagggggcggcacgcccccagcccgacagggatcctgggaggacgaggaagaagactatgaggaagagctgaccgacaaccggaaccggggccggaataaggcccgctactgcgctgagggtgggggtccagttttggggcgcaacaagaatgagctggagggctggggacgaggcgtctacattcgctgagaggcaggggccacacggcgggaggaagggctctgagcccaggggaggggagggagcgaggggctcacacctgacatgtattcgcctccagggggcgctgtctccctcctttcagatgcctttgctcaaagcttggggtttctttggtgttaccatcccagctcccgggaggcccttaagccccagctgtcggtttttacctgcctgttgtggatggatgggggatacccacctttctgaagtgtcccctttctcccatcttaaggggctctcctccctcaccctcctagagaaaaggtgcacttccttaactctttctactcggggccctaagtgacggtcctaagtgggatggctctccttctcccaagctgcagtactggggaagggctgggcgcttttcctggaaagggaggccacagattctttcccatgggggctctcttccccagaccccagatccaaggtccctcaccctgcctgccccttcctcccagcttcctggcagcatcgtctggtcggtgaaagccatagcatggacaccccatggggagcttgtcttggggagggttctgggtggaagctggcaggcatacagcaccctctaccctccgtggccatggcaacgtccagggcccagaaccctgaggagtgagcggccgagacgctgctccccaccccccacctccatgcctcagcctttgcctaccccaggaatgagcttggcctccaacatcccttgcctgctgccattagtagagggggcccctctgcatctgagccccccatccctgtgccacctgggtgtggagcccatggaacactctggtccgcctcattttaaaccaaaaaactgctccttcaccctcaccctgaggccccaggggagaggacccgtgggatggtgcccaggggttgccttgggacctcggatctcctctggggggcttggctgctgctgttgctgctctgtatttgcctctcgtgattctgtttgttacccatgttcacttcccccaggagaggccttggtaccccctctcccctggggcatccctttgccttggcatccctgtagcccagcaaccctgcccctccccagcatcccagctgggccagagagagccgagtgtgccaacaaggactggggcctgcccggctgcccgcctcagggatgggcacctcatgcctgtctcgccacctcctgtgccaatgtcccaccctccacctgggggtggggtgcagcttccacttactgattagaagacaccactgccctcccttcccccctccctgtctggtgtcctgtgcccccatctgtctgtctatatttgtctgtactcccctaggagaagtattttgccatatataaaaccactgtcctgtcctttg

SEQ ID NO: 4138 - DNA, 1699 bp, Homo sapiens
gagggaaggcaggaaggaggcagccgaaggccgagctgggtggctggaccgggtgctggctgcgccgcgctgctttcggctcccacggcctctcccatgcgctgagggagcccggctgggccgggccggcggcgggaggggaggctcctctccatggtccagaagaccagcatgtcccggggcccttacccaccctcccaggagatccccatggaggtcttcgaccccagcccgcagggcaaatacagcaagaggaaagggcgattcaaacggtcagatgggagcacgtcctcggataccacatccaacagctttgtccgccagggctcagcggagtcctacaccagccgtccatcagactctgatgtatctctggaggaggaccgggaagccttaaggaaggaagcagagcgccaggcattagcgcagctcgagaaggccaagaccaagccagtggcatttgctgtgcggacaaatgttggctacaatccgtctccaggggatgaggtgcctgtgcagggagtggccatcaccttcgagcccaaagacttcctgcacatcaaggagaaatacaataatgactggtggatcgggcggctggtgaaggagggctgtgaggttggcttcattcccagccccgtcaaactggacagccttcgcctgctgcaggaacagaagctgcgccagaaccgcctcggctccagcaaatcaggcgataactccagttccagtctgggagatgtggtgactggcacccgccgccccacaccccctgccagtgccaaacagaagcagaagtcgacagagcatgtgcccccctatgacgtggtgccttccatgaggcccatcatcctggtgggaccgtcgctcaagggctacgaggttacagacatgatgcagaaagctttatttgacttcttgaagcatcggtttgatggcaggatctccatcactcgtgtgacggcagatatttccctggctaagcgctcagttctcaacaaccccagcaaacacatcatcattgagcgctccaacacacgctccagcctggctgaggtgcagagtgaaatcgagcgaatcttcgagctggcccggacccttcagttggtcgctctggatgctgacaccatcaatcacccagcccagctgtccaagacctcgctggcccccatcattgtttacatcaagatcacctctcccaaggtacttcaaaggctcatcaagtcccgaggaaagtctcagtccaaacacctcaatgtccaaatagcggcctcggaaaagctggcacagtgcccccctgaaatgtttgacatcatcctggatgagaaccaattggaggatgcctgcgagcatctggcggagtacttggaagcctattggaaggccacacacccgcccagcagcacgccacccaatccgctgctgaaccgcaccatggctaccgcagccctggctgccagccctgcccctgtctccaacctccaggtacaggtgctcacctcgctcaggagaaacctcggcttctggggcgggctggagtcctcacagcggggcagtgtggtgccccaggagcaggaacatgccatgtagtgggcgccctgcccgtcttccctcctgctctggggtcggaactggagtgcagggaacatggaggaggaagggaagagctttattttgtaaaaaaataagatgagcggca

SEQ ID NO: 4139 - DNA, 1417 bp, Homo sapiens
aggcactgagggtgccgggatggaggcgcccagccggaccgtggtggtgggctcagcggagtcctacaccagccgtccatcagactctgatgtatctctggaggaggaccgggaagccttaaggaaggaagcagagcgccaggcattagcgcagctcgagaaggccaagaccaagccagtggcatttgctgtgcggacaaatgttggctacaatccgtctccaggggatgaggtgcctgtgcagggagtggccatcaccttcgagcccaaagacttcctgcacatcaaggagaaatacaataatgactggtggatcgggcggctggtgaaggagggctgtgaggttggcttcattcccagccccgtcaaactggacagccttcgcctgctgcaggaacagaagctgcgccagaaccgcctcggctccagcaaatcaggcgataactccagttccagtctgggagatgtggtgactggcacccgccgccccacaccccctgccagtgactctccggtccagacagagcatgtgcccccctatgacgtggtgccttccatgaggcccatcatcctggtgggaccgtcgctcaagggctacgaggttacagacatgatgcagaaagctttatttgacttcttgaagcatcggtttgatggcaggatctccatcactcgtgtgacggcagatatttccctggctaagcgctcagttctcaacaaccccagcaaacacatcatcattgagcgctccaacacacgctccagcctggctgaggtgcagagtgaaatcgagcgaatcttcgagctggcccggacccttcagttggtcgctctggatgctgacaccatcaatcacccagcccagctgtccaagacctcgctggcccccatcattgtttacatcaagatcacctctcccaaggtacttcaaaggctcatcaagtcccgaggaaagtctcagtccaaacacctcaatgtccaaatagcggcctcggaaaagctggcacagtgcccccctgaaatgtttgacatcatcctggatgagaaccaattggaggatgcctgcgagcatctggcggagtacttggaagcctattggaaggccacacacccgcccagcagcacgccacccaatccgctgctgaaccgcaccatggctaccgcagccctggctgccagccctgcccctgtctccaacctccaggtacaggtgctcacctcgctcaggagaaacctcggcttctggggcgggctggagtcctcacagcggggcagtgtggtgccccaggagcaggaacatgccatgtagtgggcgccctgcccgtcttccctcctgctctggggtcggaactggagtgcagggaacatggaggaggaagggaagagctttattttgtaaaaaaataagatgagcggc

SEQ ID NO: 4140 - DNA, 3384 bp, Homo sapiens
tctggctctctctattttcagggctcagcggagtcctacaccagccgtccatcagactctgatgtatctctggaggaggaccgggaagccttaaggaaggaagcagagcgccaggcattagcgcagctcgagaaggccaagaccaagccagtggcatttgctgtgcggacaaatgttggctacaatccgtctccaggggatgaggtgcctgtgcagggagtggccatcaccttcgagcccaaagacttcctgcacatcaaggagaaatacaataatgactggtggatcgggcggctggtgaaggagggctgtgaggttggcttcattcccagccccgtcaaactggacagccttcgcctgctgcaggaacagaagctgcgccagaaccgcctcggctccagcaaatcaggcgataactccagttccagtctgggagatgtggtgactggcacccgccgccccacaccccctgccagtggtaagagccatcgccatgcaacagagcatgtgcccccctatgacgtggtgccttccatgaggcccatcatcctggtgggaccgtcgctcaagggctacgaggttacagacatgatgcagaaagctttatttgacttcttgaagcatcggtttgatggcaggatctccatcactcgtgtgacggcagatatttccctggctaagcgctcagttctcaacaaccccagcaaacacatcatcattgagcgctccaacacacgctccagcctggctgaggtgcagagtgaaatcgagcgaatcttcgagctggcccggacccttcagttggtcgctctggatgctgacaccatcaatcacccagcccagctgtccaagacctcgctggcccccatcattgtttacatcaagatcacctctcccaaggtacttcaaaggctcatcaagtcccgaggaaagtctcagtccaaacacctcaatgtccaaatagcggcctcggaaaagctggcacagtgcccccctgaaatgtttgacatcatcctggatgagaaccaattggaggatgcctgcgagcatctggcggagtacttggaagcctattggaaggccacacacccgcccagcagcacgccacccaatccgctgctgaaccgcaccatggctaccgcagccctggctgccagccctgcccctgtctccaacctccagggaccctaccttgcttccggggaccagccactggaacgggccaccggggagcacgccagcatgcacgagtacccaggggagctgggccagcccccaggcctttaccccagcagccacccaccaggccgggcaggcacgctacgggcactgtcccgccaagacacttttgatgccgacacccccggcagccgaaactctgcctacacggagctgggagactcatgtgtggacatggagactgacccctcagaggggccagggcttggagaccctgcagggggcggcacgcccccagcccgacagggatcctgggaggacgaggaagaagactatgaggaagagctgaccgacaaccggaaccggggccggaataaggcccgctactgcgctgagggtgggggtccagttttggggcgcaacaagaatgagctggagggctggggacgaggcgtctacattcgctgagaggcaggggccacacggcgggaggaagggctctgagcccaggggaggggagggagcgaggggctcacacctgacatgtattcgcctccagggggcgctgtctccctcctttcagatgcctttgctcaaagcttggggtttctttggtgttaccatcccagctcccgggaggcccttaagccccagctgtcggtttttacctgcctgttgtggatggatgggggatacccacctttctgaagtgtcccctttctcccatcttaaggggctctcctccctcaccctcctagagaaaaggtgcacttccttaactctttctactcggggccctaagtgacggtcctaagtgggatggctctccttctcccaagctgcagtactggggaagggctgggcgcttttcctggaaagggaggccacagattctttcccatgggggctctcttccccagaccccagatccaaggtccctcaccctgcctgccccttcctcccagcttcctggcagcatcgtctggtcggtgaaagccatagcatggacaccccatggggagcttgtcttggggagggttctgggtggaagctggcaggcatacagcaccctctaccctccgtggccatggcaacgtccagggcccagaaccctgaggagtgagcggccgagacgctgctccccaccccccacctccatgcctcagcctttgcctaccccaggaatgagcttggcctccaacatcccttgcctgctgccattagtagagggggcccctctgcatctgagccccccatccctgtgccacctgggtgtggagcccatggaacactctggtccgcctcattttaaaccaaaaaactgctccttcaccctcaccctgaggccccaggggagaggacccgtgggatggtgcccaggggttgccttgggacctcggatctcctctggggggcttggctgctgctgttgctgctctgtatttgcctctcgtgattctgtttgttacccatgttcacttcccccaggagaggccttggtaccccctctcccctggggcatccctttgccttggcatccctgtagcccagcaaccctgcccctccccagcatcccagctgggccagagagagccgagtgtgccaacaaggactggggcctgcccggctgcccgcctcagggatgggcacctcatgcctgtctcgccacctcctgtgccaatgtcccaccctccacctgggggtggggtgcagcttccacttactgattagaagacaccactgccctcccttcccccctccctgtctggtgtcctgtgcccccatctgtctgtctatatttgtctgtactcccctaggagaagtattttgccatatataaaaccactgtcctgtcctttgtggctgcctcccaagcctgcttctttgtcctcgccacatagtcgtcagcgtaggcacctgggagctgctgatatgcacggggagttgaaagggtgggtgcctgaagatgttgtgccctgagtcattgactcaaaagaaaagatgatcctttgattttggccctctgatgtattgtgcccaagccaggagctgcttgggcagtcccagctccacactggccctgagccccttcacttacctgtctctccacaagtagagccaaaggcaatgggaagctcaatgttgctcagtgggtgagatccagacccactggtgcaatgtcttaaatacacatgactgtttttc

SEQ ID NO: 4141 - DNA, 3524 bp, Homo sapiens
cacctcctcccctcgtcgcctgcccaccctctgctcctctcctggcgccggggaccctgcccctttgcgccttttcctggctctgcctcggcttccatttttctctgcttccgaaaagccagtggggaagggcgggggagacctgccagtcctcccagacttctcccgggttgctccagctggccctcctcgccccttcccgggagaggcacatggagagacatgaatcaggggagtggactggacctgctgaagatctcatatggaaaaggagccagaaggaaaaacagatttaaaggatctgatggaagcacgtcatctgatactacctcaaatagttttgttcgccagggttcggcagactcctacactagccgtccatccgattccgatgtatctctggaggaggaccgggaggcagtgcgcagagaagcggagcggcaggcccaggcacagttggaaaaagcaaagacaaagcccgttgcatttgcggttcggacaaatgtcagctacagtgcggcccatgaagatgatgttccagtgcctggcatggccatctcattcgaagcaaaagattttctgcatgttaaggaaaaatttaacaatgactggtggatagggcgattggtaaaagaaggctgtgaaatcggattcattccaagcccagtcaaactagaaaacatgaggctgcagcatgaacagagagccaagcaagggaaattctactccagtaaatcaggaggaaattcatcatccagtttgggtgacatagtacctagttccagaaaatcaacacctccatcatctgctatagacatagatgctactggcttagatgcagaagaaaatgatattccagcaaaccaccgctcccctaaacccagtgcaaacagtgtaacgtcaccccactccaaagagaaaagaatgcccttctttaagaagacagagcacactcctccgtatgatgtggtaccttccatgcgaccagtggtcctagtgggcccttctctgaagggctacgaggtcacagatatgatgcaaaaagcgctgtttgattttttaaaacacagatttgaagggcggatatccatcacaagggtcaccgctgacatctcgcttgccaaacgctcggtattaaacaatcccagtaagcacgcaataatagaaagatccaacacaaggtcaagcttagcggaagttcagagtgaaatcgaaaggatttttgaacttgcaagaacattgcagttggtggtccttgacgcggatacaattaatcatccagctcaactcagtaaaacctccttggcccctattatagtatatgtaaagatttcttctcctaaggttttacaaaggttaataaaatctcgagggaaatctcaagctaaacacctcaacgtccagatggtagcagctgataaactggctcagtgtcctccagagctgttcgatgtgatcttggatgagaaccagcttgaggatgcctgtgagcaccttgccgactatctggaggcctactggaaggccacccatcctcccagcagtagcctccccaaccctctccttagccgtacattagccacttcaagtctgcctcttagccccaccctagcctctaattcacagggttctcaaggtgatcagaggactgatcgctccgctcctatccgttctgcttcccaagctgaagaagaacctagtgtggaaccagtcaagaaatcccagcaccgctcttcctcctcagccccacaccacaaccatcgcagtgggacaagtcgcggcctctccaggcaagagacatttgactcggaaacccaggagagtcgagactctgcctacgtagagccaaaggaagattattcccatgaccacgtggaccactatgcctcacaccgtgaccacaaccacagagacgagacccacgggagcagtgaccacagacacagggagtcccggcaccgttcccgggacgtggatcgagagcaggaccacaacgagtgcaacaagcagcgcagccgtcataaatccaaggatcgctactgtgaaaaggatggagaagtgatatcaaaaaaacggaatgaggctggggagtggaacagggatgtttacatccgccaatgagttttgcccgtttgtgtttttttttttttttttttgaagtcttgtataactaacagcatccccaaaacaaagtctttggggtctacactgcaatcatatgtgatctgtcttgtaatattttgtattattgctgttgcttgaatagcaatagcatggatagagtattgagatactttttcttttgtaagtgctacataaattggcctggtatggctgcagtcctccggttgcatactggactcttcaaaaactgttttgggtagctgccacttgaacaaaatctgttgccacccaggtgatgttagtgttttaagaaatgtagttgatgtatccaacaagccagaatcagcacagataaaaagtggaatttcttgtttctccagatttttaatacgttaatacgcaggcatctgatttgcatattcattcatggaccactgtttcttgcttgtacctctggctgactaaatttggggacagattcagtcttgccttacacaaaggggatcataaagttagaatctattttctatgtactagtactgtgtactgtatagacagtttgtaaatgttatttctgcaaacaaacaccttcttattatatatataatatatatatatatcagtttgatcacactattttagagtcttaatgccaagtcagcagatttgctttatgaattacagggactagaaatgcccacattcaggaaatttgtaataacattgtctagacacctatcctcattctagtagaaagtgtgtacatactgtaaatatgtgtgattgcttgacttgaaaaggtttgaattctgaatgttataccatccttgtaagtaagtttgtaatttccaccataaattatggtaaatataaaactccagaggttgttctactccatacagttcacactgattgtgacacattcttagtagctagtgtctgttctagtcactgcactggagtctacgagccggaactcgctatatgcacgtgtgtgtgtccgtatgtaagaaagtgtgcaccgagtgactgaatggttgagatgaattggaatgctgaagactaacgaagaaactagagactgatatcgagcattctgcccacctcgctctgtatttaattaattgtgctatatgttgctttaacaacccattgagcagtcagggaatgtgagtaagcttgctgccaaaggtaactaggaaagcattcatctgctgcctccttgtttttgctcctagagagtgaaaatacaggcaattttactgtgagtgtttcactggaaatgtacaatctttgtgtgttagagtatttgttttagtaagaaatgtttacacagcttgtggaattatttcgtgggaaaataaatttttataacttctcccacttcaatttctaacctt

SEQ ID NO: 4142 - DNA, 3446 bp, Homo sapiens
gaggaggaggggacccgccgccgggggctggctgcttcgctccgagccgacttttcgccaatggtccaaagggacatgtccaagtcgcctcccacagcggcggcggcggtggcgcaggagatccagatggaactgctagagaacgtggctcccgcgggggcgctcggagccgccgcacagtcatatggaaaaggagccagaaggaaaaacagatttaaaggatctgatggaagcacgtcatctgatactacctcaaatagttttgttcgccagggttcggcagactcctacactagccgtccatccgattccgatgtatctctggaggaggaccgggaggcagtgcgcagagaagcggagcggcaggcccaggcacagttggaaaaagcaaagacaaagcccgttgcatttgcggttcggacaaatgtcagctacagtgcggcccatgaagatgatgttccagtgcctggcatggccatctcattcgaagcaaaagattttctgcatgttaaggaaaaatttaacaatgactggtggatagggcgattggtaaaagaaggctgtgaaatcggattcattccaagcccagtcaaactagaaaacatgaggctgcagcatgaacagagagccaagcaagggaaattctactccagtaaatcaggaggaaattcatcatccagtttgggtgacatagtacctagttccagaaaatcaacacctccatcatctgctatagacatagatgctactggcttagatgcagaagaaaatgatattccagcaaaccaccgctcccctaaacccagtgcaaacagtgtaacgtcaccccactccaaagagaaaagaatgcccttctttaagaagacagagcacactcctccgtatgatgtggtaccttccatgcgaccagtggtcctagtgggcccttctctgaagggctacgaggtcacagatatgatgcaaaaagcgctgtttgattttttaaaacacagatttgaagggcggatatccatcacaagggtcaccgctgacatctcgcttgccaaacgctcggtattaaacaatcccagtaagcacgcaataatagaaagatccaacacaaggtcaagcttagcggaagttcagagtgaaatcgaaaggatttttgaacttgcaagaacattgcagttggtggtccttgacgcggatacaattaatcatccagctcaactcagtaaaacctccttggcccctattatagtatatgtaaagatttcttctcctaaggttttacaaaggttaataaaatctcgagggaaatctcaagctaaacacctcaacgtccagatggtagcagctgataaactggctcagtgtcctccagagctgttcgatgtgatcttggatgagaaccagcttgaggatgcctgtgagcaccttgccgactatctggaggcctactggaaggccacccatcctcccagcagtagcctccccaaccctctccttagccgtacattagccacttcaagtctgcctcttagccccaccctagcctctaattcacagggttctcaaggtgatcagaggactgatcgctccgctcctatccgttctgcttcccaagctgaagaagaacctagtgtggaaccagtcaagaaatcccagcaccgctcttcctcctcagccccacaccacaaccatcgcagtgggacaagtcgcggcctctccaggcaagagacatttgactcggaaacccaggagagtcgagactctgcctacgtagagccaaaggaagattattcccatgaccacgtggaccactatgcctcacaccgtgaccacaaccacagagacgagacccacgggagcagtgaccacagacacagggagtcccggcaccgttcccgggacgtggatcgagagcaggaccacaacgagtgcaacaagcagcgcagccgtcataaatccaaggatcgctactgtgaaaaggatggagaagtgatatcaaaaaaacggaatgaggctggggagtggaacagggatgtttacatccgccaatgagttttgcccgtttgtgtttttttttttttttttttgaagtcttgtataactaacagcatccccaaaacaaagtctttggggtctacactgcaatcatatgtgatctgtcttgtaatattttgtattattgctgttgcttgaatagcaatagcatggatagagtattgagatactttttcttttgtaagtgctacataaattggcctggtatggctgcagtcctccggttgcatactggactcttcaaaaactgttttgggtagctgccacttgaacaaaatctgttgccacccaggtgatgttagtgttttaagaaatgtagttgatgtatccaacaagccagaatcagcacagataaaaagtggaatttcttgtttctccagatttttaatacgttaatacgcaggcatctgatttgcatattcattcatggaccactgtttcttgcttgtacctctggctgactaaatttggggacagattcagtcttgccttacacaaaggggatcataaagttagaatctattttctatgtactagtactgtgtactgtatagacagtttgtaaatgttatttctgcaaacaaacaccttcttattatatatataatatatatatatatcagtttgatcacactattttagagtcttaatgccaagtcagcagatttgctttatgaattacagggactagaaatgcccacattcaggaaatttgtaataacattgtctagacacctatcctcattctagtagaaagtgtgtacatactgtaaatatgtgtgattgcttgacttgaaaaggtttgaattctgaatgttataccatccttgtaagtaagtttgtaatttccaccataaattatggtaaatataaaactccagaggttgttctactccatacagttcacactgattgtgacacattcttagtagctagtgtctgttctagtcactgcactggagtctacgagccggaactcgctatatgcacgtgtgtgtgtccgtatgtaagaaagtgtgcaccgagtgactgaatggttgagatgaattggaatgctgaagactaacgaagaaactagagactgatatcgagcattctgcccacctcgctctgtatttaattaattgtgctatatgttgctttaacaacccattgagcagtcagggaatgtgagtaagcttgctgccaaaggtaactaggaaagcattcatctgctgcctccttgtttttgctcctagagagtgaaaatacaggcaattttactgtgagtgtttcactggaaatgtacaatctttgtgtgttagagtatttgttttagtaagaaatgtttacacagcttgtggaattatttcgtgggaaaataaatttttataacttctcccacttcaatttctaacctt

SEQ ID NO: 4143 - DNA, 1911 bp, Homo sapiens
atggtccaaagggacatgtccaagtcgcctcccacagcggcggcggcggtggcgcaggagatccagatggaactgctagagaacgtggctcccgcgggggcgctcggagccgccgcacagtcatatggaaaaggagccagaaggaaaaacagatttaaaggatctgatggaagcacgtcatctgatactacctcaaatagttttgttcgccagggttcggcagactcctacactagccgtccatccgattccgatgtatctctggaggaggaccgggaggcagtgcgcagagaagcggagcggcaggcccaggcacagttggaaaaagcaaagacaaagcccgttgcatttgcggttcggacaaatgtcagctacagtgcggcccatgaagatgatgttccagtgcctggcatggccatctcattcgaagcaaaagattttctgcatgttaaggaaaaatttaacaatgactggtggatagggcgattggtaaaagaaggctgtgaaatcggattcattccaagcccagtcaaactagaaaacatgaggctgcagcatgaacagagagccaagcaagggaaattctactccagtaaatcaggaggaaattcatcatccagtttgggtgacatagtacctagttccagaaaatcaacacctccatcatctggtgcaaaatctgcagatgaacaagaccagtggaaaactgcaggcttgttttggcggtttactacagagcacactcctccgtatgatgtggtaccttccatgcgaccagtggtcctagtgggcccttctctgaagggctacgaggtcacagatatgatgcaaaaagcgctgtttgattttttaaaacacagatttgaagggcggatatccatcacaagggtcaccgctgacatctcgcttgccaaacgctcggtattaaacaatcccagtaagcacgcaataatagaaagatccaacacaaggtcaagcttagcggaagttcagagtgaaatcgaaaggatttttgaacttgcaagaacattgcagttggtggtccttgacgcggatacaattaatcatccagctcaactcagtaaaacctccttggcccctattatagtatatgtaaagatttcttctcctaaggttttacaaaggttaataaaatctcgagggaaatctcaagctaaacacctcaacgtccagatggtagcagctgataaactggctcagtgtcctccagagctgttcgatgtgatcttggatgagaaccagcttgaggatgcctgtgagcaccttgccgactatctggaggcctactggaaggccacccatcctcccagcagtagcctccccaaccctctccttagccgtacattagccacttcaagtctgcctcttagccccaccctagcctctaattcacagggttctcaaggtgatcagaggactgatcgctccgctcctatccgttctgcttcccaagctgaagaagaacctagtgtggaaccagtcaagaaatcccagcaccgctcttcctcctcagccccacaccacaaccatcgcagtgggacaagtcgcggcctctccaggcaagagacatttgactcggaaacccaggagagtcgagactctgcctacgtagagccaaaggaagattattcccatgaccacgtggaccactatgcctcacaccgtgaccacaaccacagagacgagacccacgggagcagtgaccacagacacagggagtcccggcaccgttcccgggacgtggatcgagagcaggaccacaacgagtgcaacaagcagcgcagccgtcataaatccaaggatcgctactgtgaaaaggatggagaagtgatatcaaaaaaacggaatgaggctggggagtggaacagggatgtttacatccgccaatga

SEQ ID NO: 4144 - DNA, 3461 bp, Homo sapiens
gtgtgttttcagcccctcctggaatgggaaaataagaatctccctggatgggagtcctctggggcagggagtgaaagccccggaggcagaaagggacggagaacaggggcttgcccagagcatggataggaaaggagctggggttctccggggctcagcgcgcactgagaacctgtgcccggggctgcagctgcggacgataaaggcgctgtctggctcatgaaggccacctggatcaggcttctgaaaagagccaagggaggaaggctgaagaattctgatatctgtggttcggcagactcctacactagccgtccatccgattccgatgtatctctggaggaggaccgggaggcagtgcgcagagaagcggagcggcaggcccaggcacagttggaaaaagcaaagacaaagcccgttgcatttgcggttcggacaaatgtcagctacagtgcggcccatgaagatgatgttccagtgcctggcatggccatctcattcgaagcaaaagattttctgcatgttaaggaaaaatttaacaatgactggtggatagggcgattggtaaaagaaggctgtgaaatcggattcattccaagcccagtcaaactagaaaacatgaggctgcagcatgaacagagagccaagcaagggaaattctactccagtaaatcaggaggaaattcatcatccagtttgggtgacatagtacctagttccagaaaatcaacacctccatcatctgctatagacatagatgctactggcttagatgcagaagaaaatgatattccagcaaaccaccgctcccctaaacccagtgcaaacagtgtaacgtcaccccactccaaagagaaaagaatgcccttctttaagaagacagagcacactcctccgtatgatgtggtaccttccatgcgaccagtggtcctagtgggcccttctctgaagggctacgaggtcacagatatgatgcaaaaagcgctgtttgattttttaaaacacagatttgaagggcggatatccatcacaagggtcaccgctgacatctcgcttgccaaacgctcggtattaaacaatcccagtaagcacgcaataatagaaagatccaacacaaggtcaagcttagcggaagttcagagtgaaatcgaaaggatttttgaacttgcaagaacattgcagttggtggtccttgacgcggatacaattaatcatccagctcaactcagtaaaacctccttggcccctattatagtatatgtaaagatttcttctcctaaggttttacaaaggttaataaaatctcgagggaaatctcaagctaaacacctcaacgtccagatggtagcagctgataaactggctcagtgtcctccagagctgttcgatgtgatcttggatgagaaccagcttgaggatgcctgtgagcaccttgccgactatctggaggcctactggaaggccacccatcctcccagcagtagcctccccaaccctctccttagccgtacattagccacttcaagtctgcctcttagccccaccctagcctctaattcacagggttctcaaggtgatcagaggactgatcgctccgctcctatccgttctgcttcccaagctgaagaagaacctagtgtggaaccagtcaagaaatcccagcaccgctcttcctcctcagccccacaccacaaccatcgcagtgggacaagtcgcggcctctccaggcaagagacatttgactcggaaacccaggagagtcgagactctgcctacgtagagccaaaggaagattattcccatgaccacgtggaccactatgcctcacaccgtgaccacaaccacagagacgagacccacgggagcagtgaccacagacacagggagtcccggcaccgttcccgggacgtggatcgagagcaggaccacaacgagtgcaacaagcagcgcagccgtcataaatccaaggatcgctactgtgaaaaggatggagaagtgatatcaaaaaaacggaatgaggctggggagtggaacagggatgtttacatccgccaatgagttttgcccgtttgtgtttttttttttttttttttgaagtcttgtataactaacagcatccccaaaacaaagtctttggggtctacactgcaatcatatgtgatctgtcttgtaatattttgtattattgctgttgcttgaatagcaatagcatggatagagtattgagatactttttcttttgtaagtgctacataaattggcctggtatggctgcagtcctccggttgcatactggactcttcaaaaactgttttgggtagctgccacttgaacaaaatctgttgccacccaggtgatgttagtgttttaagaaatgtagttgatgtatccaacaagccagaatcagcacagataaaaagtggaatttcttgtttctccagatttttaatacgttaatacgcaggcatctgatttgcatattcattcatggaccactgtttcttgcttgtacctctggctgactaaatttggggacagattcagtcttgccttacacaaaggggatcataaagttagaatctattttctatgtactagtactgtgtactgtatagacagtttgtaaatgttatttctgcaaacaaacaccttcttattatatatataatatatatatatatcagtttgatcacactattttagagtcttaatgccaagtcagcagatttgctttatgaattacagggactagaaatgcccacattcaggaaatttgtaataacattgtctagacacctatcctcattctagtagaaagtgtgtacatactgtaaatatgtgtgattgcttgacttgaaaaggtttgaattctgaatgttataccatccttgtaagtaagtttgtaatttccaccataaattatggtaaatataaaactccagaggttgttctactccatacagttcacactgattgtgacacattcttagtagctagtgtctgttctagtcactgcactggagtctacgagccggaactcgctatatgcacgtgtgtgtgtccgtatgtaagaaagtgtgcaccgagtgactgaatggttgagatgaattggaatgctgaagactaacgaagaaactagagactgatatcgagcattctgcccacctcgctctgtatttaattaattgtgctatatgttgctttaacaacccattgagcagtcagggaatgtgagtaagcttgctgccaaaggtaactaggaaagcattcatctgctgcctccttgtttttgctcctagagagtgaaaatacaggcaattttactgtgagtgtttcactggaaatgtacaatctttgtgtgttagagtatttgttttagtaagaaatgtttacacagcttgtggaattatttcgtgggaaaataaatttttataacttctcccacttcaatttctaacctt

SEQ ID NO: 4145 - DNA, 3116 bp, Homo sapiens
cccctcttcatgcagtgctgcgggctggtgcatcgccggcgagtacgggtgtcctatggttcggcagactcctacactagccgtccatccgattccgatgtatctctggaggaggaccgggaggcagtgcgcagagaagcggagcggcaggcccaggcacagttggaaaaagcaaagacaaagcccgttgcatttgcggttcggacaaatgtcagctacagtgcggcccatgaagatgatgttccagtgcctggcatggccatctcattcgaagcaaaagattttctgcatgttaaggaaaaatttaacaatgactggtggatagggcgattggtaaaagaaggctgtgaaatcggattcattccaagcccagtcaaactagaaaacatgaggctgcagcatgaacagagagccaagcaagggaaattctactccagtaaatcaggaggaaattcatcatccagtttgggtgacatagtacctagttccagaaaatcaacacctccatcatctgctaagcagaagcagaaatcgacagagcacactcctccgtatgatgtggtaccttccatgcgaccagtggtcctagtgggcccttctctgaagggctacgaggtcacagatatgatgcaaaaagcgctgtttgattttttaaaacacagatttgaagggcggatatccatcacaagggtcaccgctgacatctcgcttgccaaacgctcggtattaaacaatcccagtaagcacgcaataatagaaagatccaacacaaggtcaagcttagcggaagttcagagtgaaatcgaaaggatttttgaacttgcaagaacattgcagttggtggtccttgacgcggatacaattaatcatccagctcaactcagtaaaacctccttggcccctattatagtatatgtaaagatttcttctcctaaggttttacaaaggttaataaaatctcgagggaaatctcaagctaaacacctcaacgtccagatggtagcagctgataaactggctcagtgtcctccagagctgttcgatgtgatcttggatgagaaccagcttgaggatgcctgtgagcaccttgccgactatctggaggcctactggaaggccacccatcctcccagcagtagcctccccaaccctctccttagccgtacattagccacttcaagtctgcctcttagccccaccctagcctctaattcacagggttctcaaggtgatcagaggactgatcgctccgctcctatccgttctgcttcccaagctgaagaagaacctagtgtggaaccagtcaagaaatcccagcaccgctcttcctcctcagccccacaccacaaccatcgcagtgggacaagtcgcggcctctccaggcaagagacatttgactcggaaacccaggagagtcgagactctgcctacgtagagccaaaggaagattattcccatgaccacgtggaccactatgcctcacaccgtgaccacaaccacagagacgagacccacgggagcagtgaccacagacacagggagtcccggcaccgttcccgggacgtggatcgagagcaggaccacaacgagtgcaacaagcagcgcagccgtcataaatccaaggatcgctactgtgaaaaggatggagaagtgatatcaaaaaaacggaatgaggctggggagtggaacagggatgtttacatccgccaatgagttttgcccgtttgtgtttttttttttttttttttgaagtcttgtataactaacagcatccccaaaacaaagtctttggggtctacactgcaatcatatgtgatctgtcttgtaatattttgtattattgctgttgcttgaatagcaatagcatggatagagtattgagatactttttcttttgtaagtgctacataaattggcctggtatggctgcagtcctccggttgcatactggactcttcaaaaactgttttgggtagctgccacttgaacaaaatctgttgccacccaggtgatgttagtgttttaagaaatgtagttgatgtatccaacaagccagaatcagcacagataaaaagtggaatttcttgtttctccagatttttaatacgttaatacgcaggcatctgatttgcatattcattcatggaccactgtttcttgcttgtacctctggctgactaaatttggggacagattcagtcttgccttacacaaaggggatcataaagttagaatctattttctatgtactagtactgtgtactgtatagacagtttgtaaatgttatttctgcaaacaaacaccttcttattatatatataatatatatatatatcagtttgatcacactattttagagtcttaatgccaagtcagcagatttgctttatgaattacagggactagaaatgcccacattcaggaaatttgtaataacattgtctagacacctatcctcattctagtagaaagtgtgtacatactgtaaatatgtgtgattgcttgacttgaaaaggtttgaattctgaatgttataccatccttgtaagtaagtttgtaatttccaccataaattatggtaaatataaaactccagaggttgttctactccatacagttcacactgattgtgacacattcttagtagctagtgtctgttctagtcactgcactggagtctacgagccggaactcgctatatgcacgtgtgtgtgtccgtatgtaagaaagtgtgcaccgagtgactgaatggttgagatgaattggaatgctgaagactaacgaagaaactagagactgatatcgagcattctgcccacctcgctctgtatttaattaattgtgctatatgttgctttaacaacccattgagcagtcagggaatgtgagtaagcttgctgccaaaggtaactaggaaagcattcatctgctgcctccttgtttttgctcctagagagtgaaaatacaggcaattttactgtgagtgtttcactggaaatgtacaatctttgtgtgttagagtatttgttttagtaagaaatgtttacacagcttgtggaattatttcgtgggaaaataaatttttataacttctcccacttcaatttctaacctt

SEQ ID NO: 4146 - DNA, 3396 bp, Homo sapiens
ttgtgatccgacgaactttagaaagtcacactaactaagactacacaccccaagccagcaagaaaaaggaaagcagttgctatgctgttcagcaaagcaagacttggctgccttttagctagtcctgaattcttgctcctgtgaagaaaattcctgctggagtgctgggcgcacttggaattggtctagcatgcttgacagacgccttatagctcctcaaactaaatacattattcctgggggttcggcagactcctacactagccgtccatccgattccgatgtatctctggaggaggaccgggaggcagtgcgcagagaagcggagcggcaggcccaggcacagttggaaaaagcaaagacaaagcccgttgcatttgcggttcggacaaatgtcagctacagtgcggcccatgaagatgatgttccagtgcctggcatggccatctcattcgaagcaaaagattttctgcatgttaaggaaaaatttaacaatgactggtggatagggcgattggtaaaagaaggctgtgaaatcggattcattccaagcccagtcaaactagaaaacatgaggctgcagcatgaacagagagccaagcaagggaaattctactccagtaaatcaggaggaaattcatcatccagtttgggtgacatagtacctagttccagaaaatcaacacctccatcatctgctatagacatagatgctactggcttagatgcagaagaaaatgatattccagcaaaccaccgctcccctaaacccagtgcaaacagtgtaacgtcaccccactccaaagagaaaagaatgcccttctttaagaagacagagcacactcctccgtatgatgtggtaccttccatgcgaccagtggtcctagtgggcccttctctgaagggctacgaggtcacagatatgatgcaaaaagcgctgtttgattttttaaaacacagatttgaagggcggatatccatcacaagggtcaccgctgacatctcgcttgccaaacgctcggtattaaacaatcccagtaagcacgcaataatagaaagatccaacacaaggtcaagcttagcggaagttcagagtgaaatcgaaaggatttttgaacttgcaagaacattgcagttggtggtccttgacgcggatacaattaatcatccagctcaactcagtaaaacctccttggcccctattatagtatatgtaaagatttcttctcctaaggttttacaaaggttaataaaatctcgagggaaatctcaagctaaacacctcaacgtccagatggtagcagctgataaactggctcagtgtcctccagagctgttcgatgtgatcttggatgagaaccagcttgaggatgcctgtgagcaccttgccgactatctggaggcctactggaaggccacccatcctcccagcagtagcctccccaaccctctccttagccgtacattagccacttcaagtctgcctcttagccccaccctagcctctaattcacagggttctcaaggtgatcagaggactgatcgctccgctcctatccgttctgcttcccaagctgaagaagaacctagtgtggaaccagtcaagaaatcccagcaccgctcttcctcctcagccccacaccacaaccatcgcagtgggacaagtcgcggcctctccaggcaagagacatttgactcggaaacccaggagagtcgagactctgcctacgtagagccaaaggaagattattcccatgaccacgtggaccactatgcctcacaccgtgaccacaaccacagagacgagacccacgggagcagtgaccacagacacagggagtcccggcaccgttcccgggacgtggatcgagagcaggaccacaacgagtgcaacaagcagcgcagccgtcataaatccaaggatcgctactgtgaaaaggatggagaagtgatatcaaaaaaacggaatgaggctggggagtggaacagggatgtttacatccgccaatgagttttgcccgtttgtgtttttttttttttttttttgaagtcttgtataactaacagcatccccaaaacaaagtctttggggtctacactgcaatcatatgtgatctgtcttgtaatattttgtattattgctgttgcttgaatagcaatagcatggatagagtattgagatactttttcttttgtaagtgctacataaattggcctggtatggctgcagtcctccggttgcatactggactcttcaaaaactgttttgggtagctgccacttgaacaaaatctgttgccacccaggtgatgttagtgttttaagaaatgtagttgatgtatccaacaagccagaatcagcacagataaaaagtggaatttcttgtttctccagatttttaatacgttaatacgcaggcatctgatttgcatattcattcatggaccactgtttcttgcttgtacctctggctgactaaatttggggacagattcagtcttgccttacacaaaggggatcataaagttagaatctattttctatgtactagtactgtgtactgtatagacagtttgtaaatgttatttctgcaaacaaacaccttcttattatatatataatatatatatatatcagtttgatcacactattttagagtcttaatgccaagtcagcagatttgctttatgaattacagggactagaaatgcccacattcaggaaatttgtaataacattgtctagacacctatcctcattctagtagaaagtgtgtacatactgtaaatatgtgtgattgcttgacttgaaaaggtttgaattctgaatgttataccatccttgtaagtaagtttgtaatttccaccataaattatggtaaatataaaactccagaggttgttctactccatacagttcacactgattgtgacacattcttagtagctagtgtctgttctagtcactgcactggagtctacgagccggaactcgctatatgcacgtgtgtgtgtccgtatgtaagaaagtgtgcaccgagtgactgaatggttgagatgaattggaatgctgaagactaacgaagaaactagagactgatatcgagcattctgcccacctcgctctgtatttaattaattgtgctatatgttgctttaacaacccattgagcagtcagggaatgtgagtaagcttgctgccaaaggtaactaggaaagcattcatctgctgcctccttgtttttgctcctagagagtgaaaatacaggcaattttactgtgagtgtttcactggaaatgtacaatctttgtgtgttagagtatttgttttagtaagaaatgtttacacagcttgtggaattatttcgtgggaaaataaatttttataacttctccc

SEQ ID NO: 4147 - DNA, 1827 bp, Homo sapiens
atgaatcaggggagtggactggacctgctgaagatctcatatggaaaaggagccagaaggaaaaacagatttaaaggatctgatggaagcacgtcatctgatactacctcaaatagttttgttcgccagggttcggcagactcctacactagccgtccatccgattccgatgtatctctggaggaggaccgggaggcagtgcgcagagaagcggagcggcaggcccaggcacagttggaaaaagcaaagacaaagcccgttgcatttgcggttcggacaaatgtcagctacagtgcggcccatgaagatgatgttccagtgcctggcatggccatctcattcgaagcaaaagattttctgcatgttaaggaaaaatttaacaatgactggtggatagggcgattggtaaaagaaggctgtgaaatcggattcattccaagcccagtcaaactagaaaacatgaggctgcagcatgaacagagagccaagcaagggaaattctactccagtaaatcaggaggaaattcatcatccagtttgggtgacatagtacctagttccagaaaatcaacacctccatcatctggtgcaaaatctgcagatgaacaagaccagtggaaaactgcaggcttgttttggcggtttactacagagcacactcctccgtatgatgtggtaccttccatgcgaccagtggtcctagtgggcccttctctgaagggctacgaggtcacagatatgatgcaaaaagcgctgtttgattttttaaaacacagatttgaagggcggatatccatcacaagggtcaccgctgacatctcgcttgccaaacgctcggtattaaacaatcccagtaagcacgcaataatagaaagatccaacacaaggtcaagcttagcggaagttcagagtgaaatcgaaaggatttttgaacttgcaagaacattgcagttggtggtccttgacgcggatacaattaatcatccagctcaactcagtaaaacctccttggcccctattatagtatatgtaaagatttcttctcctaaggttttacaaaggttaataaaatctcgagggaaatctcaagctaaacacctcaacgtccagatggtagcagctgataaactggctcagtgtcctccagagctgttcgatgtgatcttggatgagaaccagcttgaggatgcctgtgagcaccttgccgactatctggaggcctactggaaggccacccatcctcccagcagtagcctccccaaccctctccttagccgtacattagccacttcaagtctgcctcttagccccaccctagcctctaattcacagggttctcaaggtgatcagaggactgatcgctccgctcctatccgttctgcttcccaagctgaagaagaacctagtgtggaaccagtcaagaaatcccagcaccgctcttcctcctcagccccacaccacaaccatcgcagtgggacaagtcgcggcctctccaggcaagagacatttgactcggaaacccaggagagtcgagactctgcctacgtagagccaaaggaagattattcccatgaccacgtggaccactatgcctcacaccgtgaccacaaccacagagacgagacccacgggagcagtgaccacagacacagggagtcccggcaccgttcccgggacgtggatcgagagcaggaccacaacgagtgcaacaagcagcgcagccgtcataaatccaaggatcgctactgtgaaaaggatggagaagtgatatcaaaaaaacggaatgaggctggggagtggaacagggatgtttacatccgccaatga

SEQ ID NO: 4148 - DNA, 4464 bp, Homo sapiens
cagcagcgtgctaagaagcagtcacataaacagcagcaggagtaggcctcctgcttttcaaaagcagagtactgcagggtcgcgaaatgcaagacactcagatgtttgaaaatctcccgagttgagaatggctactgtaaaagcgtcaccaagaaactctgacgatctggacagtcctaactctgtgttagcaatacttacttccggaaaattaatgctacttcttgtagatttttgcaaataggaaacccccttgaagaagatctcaaattacgccccccacccccaaaaaaagacaaacaggggagaacaaagttttggcatgcctgcaggaacggtggcttttttagaaactacctaggaggcagaagctaagtgatttgctcatgcctcttacctgggagtagaaggtgggaagaaatggaccgaggctgtgacgagaagacaaggcacagtgcagcttggtgaagccacacgctgactgcgttctgccccctcttcatgcagtgctgcgggctggtgcatcgccggcgagtacgggtgtcctatggttcggcagactcctacactagccgtccatccgattccgatgtatctctggaggaggaccgggaggcagtgcgcagagaagcggagcggcaggcccaggcacagttggaaaaagcaaagacaaagcccgttgcatttgcggttcggacaaatgtcagctacagtgcggcccatgaagatgatgttccagtgcctggcatggccatctcattcgaagcaaaagattttctgcatgttaaggaaaaatttaacaatgactggtggatagggcgattggtaaaagaaggctgtgaaatcggattcattccaagcccagtcaaactagaaaacatgaggctgcagcatgaacagagagccaagcaagggaaattctactccagtaaatcaggaggaaattcatcatccagtttgggtgacatagtacctagttccagaaaatcaacacctccatcatctgctatagacatagatgctactggcttagatgcagaagaaaatgatattccagcaaaccaccgctcccctaaacccagtgcaaacagtgtaacgtcaccccactccaaagagaaaagaatgcccttctttaagaagacagagcacactcctccgtatgatgtggtaccttccatgcgaccagtggtcctagtgggcccttctctgaagggctacgaggtcacagatatgatgcaaaaagcgctgtttgattttttaaaacacagatttgaagggcggatatccatcacaagggtcaccgctgacatctcgcttgccaaacgctcggtattaaacaatcccagtaagcacgcaataatagaaagatccaacacaaggtcaagcttagcggaagttcagagtgaaatcgaaaggatttttgaacttgcaagaacattgcagttggtggtccttgacgcggatacaattaatcatccagctcaactcagtaaaacctccttggcccctattatagtatatgtaaagatttcttctcctaaggttttacaaaggttaataaaatctcgagggaaatctcaagctaaacacctcaacgtccagatggtagcagctgataaactggctcagtgtcctccagagctgttcgatgtgatcttggatgagaaccagcttgaggatgcctgtgagcaccttgccgactatctggaggcctactggaaggccacccatcctcccagcagtagcctccccaaccctctccttagccgtacattagccacttcaagtctgcctcttagccccaccctagcctctaattcacagggttctcaaggtgatcagaggactgatcgctccgctcctatccgttctgcttcccaagctgaagaagaacctagtgtggaaccagtcaagaaatcccagcaccgctcttcctcctcagccccacaccacaaccatcgcagtgggacaagtcgcggcctctccaggcaagagacatttgactcggaaacccaggagagtcgagactctgcctacgtagagccaaaggaagattattcccatgaccacgtggaccactatgcctcacaccgtgaccacaaccacagagacgagacccacgggagcagtgaccacagacacagggagtcccggcaccgttcccgggacgtggatcgagagcaggaccacaacgagtgcaacaagcagcgcagccgtcataaatccaaggatcgctactgtgaaaaggatggagaagtgatatcaaaaaaacggaatgaggctggggagtggaacagggatgtttacatccgccaatgagttttgcccgtttgtgtttttttttttttttttttgaagtcttgtataactaacagcatccccaaaacaaagtctttggggtctacactgcaatcatatgtgatctgtcttgtaatattttgtattattgctgttgcttgaatagcaatagcatggatagagtattgagatactttttcttttgtaagtgctacataaattggcctggtatggctgcagtcctccggttgcatactggactcttcaaaaactgttttgggtagctgccacttgaacaaaatctgttgccacccaggtgatgttagtgttttaagaaatgtagttgatgtatccaacaagccagaatcagcacagataaaaagtggaatttcttgtttctccagatttttaatacgttaatacgcaggcatctgatttgcatattcattcatggaccactgtttcttgcttgtacctctggctgactaaatttggggacagattcagtcttgccttacacaaaggggatcataaagttagaatctattttctatgtactagtactgtgtactgtatagacagtttgtaaatgttatttctgcaaacaaacaccttcttattatatatataatatatatatatatcagtttgatcacactattttagagtcttaatgccaagtcagcagatttgctttatgaattacagggactagaaatgcccacattcaggaaatttgtaataacattgtctagacacctatcctcattctagtagaaagtgtgtacatactgtaaatatgtgtgattgcttgacttgaaaaggtttgaattctgaatgttataccatccttgtaagtaagtttgtaatttccaccataaattatggtaaatataaaactccagaggttgttctactccatacagttcacactgattgtgacacattcttagtagctagtgtctgttctagtcactgcactggagtctacgagccggaactcgctatatgcacgtgtgtgtgtccgtatgtaagaaagtgtgcaccgagtgactgaatggttgagatgaattggaatgctgaagactaacgaagaaactagagactgatatcgagcattctgcccacctcgctctgtatttaattaattgtgctatatgttgctttaacaacccattgagcagtcagggaatgtgagtaagcttgctgccaaaggtaactaggaaagcattcatctgctgcctccttgtttttgctcctagagagtgaaaatacaggcaattttactgtgagtgtttcactggaaatgtacaatctttgtgtgttagagtatttgttttagtaagaaatgtttacacagcttgtggaattatttcgtgggaaaataaatttttataacttctcccacttcaatttctaaccttgcctattgttcctgttgtttgtttacctcccagttacctaccattcctccccaccaccgactccagcaggttcactgtctgtcagaacccagaagtgcttcttataaccaaagtttctgttcttcagaagaaatcagggcaaaatggggtgacttgaagtgaataaaatgttaagaatattatcctacataagacatgtacacagaaggggaaccttgaagacattatctccatgcctcaattacactgctgtaagaagcttacaatgtcatcatgtttaaggctaagaccttttccgtgtctcaagtgtatattttgtccagttataactggatggtaagacagtattaagagtgcaagtacctggcacttgaagtttgtcccaggaaaatgcctgtgtataattacctaacttcagatctgcacattaacttatttaacaaaataaatcagccgggcgcagtggctcatgcctgtaatcccagcaatttgggaggctgaggagggtggatcacctgaggtcaggagttcaagaccagcctggccaacgtggcgaaaccccgtctctactaaaaagataaaaaattagccaggtgtggtggtgcacacctgtaatcccagctacttgggaggctgaggcaggagaattgcttgaacccaggaggtggagcctgcagtaagccaagatcacaccactgtactccagcctgggtgacagagtgagactccatctccaaaaaag

SEQ ID NO: 4149 - DNA, 2696 bp, Homo sapiens
gtggggggagcggtgatctgagctccgagcagctggtcttcgcggctcgctccctccttcgcgctctctcgctccctgccgccgcccgcagggctgcggggctcggtggcatctcccgggcgcggcccgcagtccttgcccctgcctccgggccgctcccgcccccggcgccgctcgctcccccgacccggactcccccatgtatgacgactcctacgtgcccgggtttgaggactcggaggcgggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagaagtacagcaatgactggtggatcgggcggctagtgaaagagggcggggacatcgccttcatccccagcccccagcgcctggagagcatccggctcaaacaggagcagaaggccaggagatctgggaacccttccagcctgagtgacattggcaaccgacgctcccctccgccatctctagccaagcagaagcaaaagcaggcggaacatgttcccccatatgacgtggtgccctccatgcggcctgtggtgctggtgggaccctctctgaaaggttatgaggtcacagacatgatgcagaaggctctcttcgacttcctcaaacacagatttgatggcaggatctccatcacccgagtcacagccgacctctccctggcaaagcgatctgtgctcaacaatccgggcaagaggaccatcattgagcgctcctctgcccgctccagcattgcggaagtgcagagtgagatcgagcgcatatttgagctggccaaatccctgcagctagtagtgttggacgctgacaccatcaaccacccagcacagctggccaagacctcgctggcccccatcatcgtctttgtcaaagtgtcctcaccaaaggtactccagcgtctcattcgctcccgggggaagtcacagatgaagcacctgaccgtacagatgatggcatatgataagctggttcagtgcccaccggagtcatttgatgtgattctggatgagaaccagctggaggatgcctgtgagcacctggctgagtacctggaggtttactggcgggccacgcaccacccagcccctggccccggacttctgggtcctcccagtgccatccccggacttcagaaccagcagctgctgggggagcgtggcgaggagcactccccccttgagcgggacagcttgatgccctctgatgaggccagcgagagctcccgccaagcctggacaggatcttcacagcgtagctcccgccacctggaggaggactatgcagatgcctaccaggacctgtaccagcctcaccgccaacacacctcggggctgcctagtgctaacgggcatgacccccaagaccggcttctagcccaggactcagagcacaaccacagtgaccggaactggcagcgcaaccggccttggcccaaggatagctactgacagcctcctgctgccctaccctggcaggcacaggcgcagctggctggggggcccactccaggcagggtggcgttagactggcatcaggctggcactaggctcagcccccaaaaccccctgcccagccccagcttcagggctgcctgtggtcccaaggttctgggagaaacaggggaccccctcacctcctgggcagtgacccctactaggctcccattccaggtactagctgtgtgttctgcacccctggcaccttcctctcctcccacacaggaagctgccccactgggcagtgccctcaggccaggatccccttagcagggtccttcccaccagactcagggaagggatgccccattaaagtgacaaaagggtggggtgtgggcaccatggcatgaggaagaaacaaggtccctgagcaggcacaagtcctgacagtcaagggactgctttggcatccagggcctccagtcacctcactgccatacattagaaatgagacaatcaaagcccccccagggtggcacacccatctgtttgctggggtgtggcagccacatccaagactggagcagcaggctggccacgctcgggccagagagagctcacagctgaagctcttggagggaagggctctcctcaccctgccaggaagcttcttaacatgtgacaggaccagggaccaggagcatggtgaagccaagtggcagatgggagccaacctggatgggggtttggggaaggagggcatgtgtagcagagaacttaggggggcctccttgcctttctcattcttttgccctgcatcctgtcatttctgttcttgtccctcatacatctttggagaaccgggctccagactttgttccctgactcatagctgccgcttgttaggttagggttagatggggagagacagggcacagaggacctgtctccccggctactcttgccttatggctctagtgtgtgacctacagagcatgctccacaagcccctgcctcacctcactgtcatcactaataaacatcatgcacagtc

SEQ ID NO: 4150 - DNA, 1566 bp, Homo sapiens
atgtcctcctcctcctacgccaagaacgggaccgcggacgggccgcactcccccacctcgcaggtggcccgaggcaccacaacccggaggagcaggttgaaaagatccgatggcagcaccacttcgaccagcttcatcctcagacagggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagttaaaatggtattaaaaattcatacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttga

SEQ ID NO: 4151 - DNA, 8055 bp, Homo sapiens
agtctgtggttgaggaagggttttgctttttgtgctctgtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagttaaaatggtattaaaaattcatacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatctggggggaaaaaaaaaaaactaataagaaaatcgaaataccaatagaagccaaatccagctttggtatttatttgctggaagctaaatttacacttaaagttggagtgtataaacattttaatatatgttaatgttgccagaatgacttttcagacttaccaaatgtattgatagtgccaaaaaaaaaatctcagaaatcttaatgcagaaattatatagtctcctcagattttaatatttttatttctttcctggcacagctgttgtattcaaagtgttttgctttttgtttggtcagtactgttagctcatttgaagttggcaaaaacaaatacaaacaagcaaaaaacctcaaatttttttcagcagtgagagagaatagtaaagagaggcccaagcatagctggttatgtgaaatataaaatggggtgttgttctccctttaatcaatctgagcacaactacatacatccaggaatctgaagtcagatagtaaggatgtggtaccaatcctcccgagtgcaatgctaaacacttccaggtgggaattcatctatttcacttaacacaaacgcagggtctgtatttcctgccaacaagattgagtatctttccattgcttctctcagtctctgtctttgaatatctgaatgttctggcccttcaacaaattctttaaatcatgctaaggaatttcgttttatgtggacacactcaactttgatattcaggagatgtttttacaaaatgactaattgaaaaaagttgaaacaaatgattttaaaagcttgcagtaaaaaataaactcatagattcagcaaatatttgttgactaaaattatagcatttttaatgcagaaaattataaagaatttggagattgagctgccttatttctaatgaacactcctcttcatcttattaagtcttcacagtttttccagtggctataattatggaattggtgacctatgttttatattatcaaggaagccttagattcactctgatctaagaaattattgaaattgaccctttttacacaaatgtctttaaaaaaaaaaacttatttctaaatgtccatagtgcatgcattttctaaaaccccaataagtccagccataaaagttcttttctgctagtacatgtcatgaagcctatttttgaaaataatgataattaattttatagtatcttcttttctccccaagcctttcagtattcaggcactcaaagcatgcaccagttcagtaatcttcttgaccatggaaataagttccacattactgatgagttatatatatatcttgaaccccattacaacctcaccacatccccctgcatttatgttcagtgtttgtaccccattatgaacctgtttagctgataatgaggatacctataattctgtaagtcatttcaaatatttgatacaattaaaaaatatgggcttagtaaattttaaaagttaacatgtgatactggcttgtgagattcttctgtcatctagtgaagcttataaaactttcagttaagacattttaaaagagttatatccattaggcactttaataaacatataacctgccattactgaatactttgttagaacacagaagagcatcttccagcaaacaaaaatatatttattacatgtacagcacatacttgcatgagaaagaaaacattagccaaaacatttttctatatgctttactggtttcttgtttatgcgcattaaagtatttaattgcaaagagtgcaccaaggtgtacaaatttagactagacagctgttcagctttttctgtagtagcattagcagtttggtcatttaactactttaagatacttacattttatggcaggtagctgtaacagcatttaaatatatttcctagtcatcaagattaccatcttctttcaactttttaaaagtcacttgtttttaaaggtttttcaaagccttgtttttagtcttccatgtcatgccgataaagagagtctcattcaatatctgtgcacaaaaccaatctatcaattaccatcagatgtccatacctgttttgctttgcattcttattcaaaagctgacaatcttggaaagggtataatgtatattttattgatggatatatttaaatgtttactttaatttggaatattctttccccttctttctgtaataagtttatcttcctcaaataaggggatatacatcttattttttttaaagacttaagagtttattgtgtaaatgatacttaaaatctagatatatactaaatgaaaagttttatttttgccaagcacaccaagcacctttgaaaaatacatactccatactttgtttttaattaatttcatttaaagatagcaaatgattataagcaagagaaacaagtcttttactgttttgaggctgttttaacttacagtataagccacatactagaattctgtaatttcagtcacagacatataataatgtggactcatgtgacaatgtggaaatgtagttctggaaaaaaacgaatgcaatttgtcaatcctgatgttaattctcaagggtataatgtcactctaatattataaccaacaacattatcttgtttaatatttaaagcaacacttagaaatgtttataaatgatgattctctcttatctttatacagttctattggagagaaggttgaaattgttcacaatttagatgatggtctttcctaataagagtcttaattttgtgactatataagtcattgcagttagtctttaatgaaatgaattttattaatgtaaaacaaattctgagacaattatttgtttcctttaaataatctgctatttaattattattgtcgttgtttgcaaaatgtatttttggaatgttaacctcttttcatacctgcatacttgaacttgtcttttgtgtgggggccttaaaattcataataggaagtggaggcagtgaaaggaagtaagaaaaggaaattatgctaaaagatggtttgcaaatttaaattctttaaatgaacatatcacaaaatgttgttaagacccaggatgtccgttaagaatgtgtcttggcaaccttaatttgcatgttagtatatattttcttagttacacagttttattttggtatttgcttaaaaaatgtaataccattgtagaaattaccctatgtactgatatatttactacctcttctctagagaagacaatctgtctttaaagggaaaaacactggtcaataagtagtgatcaaaattatcactattctggctaaccttgctgcaaagctaaatacatagattattaaaatatgccttccctttagattttaaactgtttccaaaatgctgtttggcaccctttcatttcttccacgttagtgaagttttctttgaattggttcacagtttatcatgaggcaaggttaatttaacaaataagtcatcatagggaacaaaacaaactgcaagggaattgcctttgtgtgcaacttgttataatatctagttctaagtctaaaggagtaaaagtccaaagactttatgtttaagagcagctggtttgcaaattcacattttgttggtccttgacttccacagagcatgacttagccatttactgggtaaggatatgcataatcttggactcccatgtaattggaataaacttcatatcaatgtttcaaataaatgctatgtaccccttattccttttacatttctgcctttgtcttttatgacaatgttgcatgttgtgtttttttaaattatataaaactcatccttgaatgactgtatgaatgaaaaatttataggaaattatgtaataaaatctgttttattagtttctcatacctttaaatactgtcaatactataactgttagtaagttacttactcaagctgtgtctatggggcagagaacagtcctcttctttaaaataatcatgatcaaaccagtcaagtcaatccaattagctgttagacagacaataaggataaccttctttttgacttaagcagtcaagttagtcaaaatagaaaaattggcttatatgggcacccagaactacagcattcaaaaattacttttaaaagtttcttcttttattaaaatggactttcttaaataaaatacatcctctgatagcagctatctctttttacttgtaatgattaattctaaatgcttcatgtaattgagggacattatgagaagactagaaagtatctcatcagataatcctaagggctgtaacttctacttgccataaacaaagtataattaagagtgagtagcaattggtttggggagtcgtagttatatatgaaactttcttttgtttctcatgatgtatgtaaaatgtttgcagaaggatggtagaaaatgttactaatgaatttagagtggtttgggagaatacactgatacttcctcatttgaaaattataaggagttacaaggggaactaagaaccagaagtggctggcctctagcttttcaatacctgataagtgttcttggttatgttttgaacacttaaatttctcaacaaatggctatgtctatatttatgtaggggccacccttgccctacttgcatgccactttgacttttaactgaaatcagtgtgaattctgtatgcataagggatgtaataaagaggcgggatcattaacgctatatcgttgcatactatttttcatatgccttacaatattttctgggatgttattaaaatgaaagcattttattgccaaaataaatctatgttgttacttataatctgcattagcagtagaaaaataatgtagcaaaaacatattgtacagtacaaaattataaaatatatattttgccaataatataaaaatagattgaggagaaagaagcacatttgttatagcacaaacttataacaaaatccaccgttaaatttggcagtcatattttttaaaagtatgtcgatttagttctaagttttgtcagatttacttcatctaccatctttttaacttgctgcttgatacttttccagcaatttatttcatagccttgcaatctgtggatgtaatttcttttgttttattcccttccataaaatttattaaattttattttgtgataacactcataccatattttctcctcttatttcttctctttcaataacaacagcagaaagtcacagcaagtgagctcatagggctcctctgaattttggacatgtgtgagatttttgtatttttcacagcctcgagtcagaatgatcaataaagatgtcccaaccacaaaaaattatattagttagggattctttaatttgttttgtactgaatactactttgaaacataagttaaagccattagctgtgtttttgtagggatggtgggaaggaataaaaaataaatgtattaacataaaacatactaaaacagaaatatggcaaaatgatgtaaaaagatttttcctactattctgagggctgttgaaatcccaggctattgctatatctccattgacaaagtgggataaaaaatgcctttgtcaaataattttttttctttctttaaattttagttatttattttaataatttgtccccttttatttttcttatctaggtatgtgtagcattctacaaggcatgctgggtaaaatatactatgcaaatgtgtacagtgctgcatgttttgttctccctctgctttagtggctttaaagaaaaaaacgtggtgttatttttgtgaataaaaacattaacaaagaaaatgcagagtgcatgcatagagtatcctcatttctatggatttgttttatggaatttaaatgtgtacaaaacaactgcattactttttttcttttatataataaatg

SEQ ID NO: 4152 - DNA, 2181 bp, Homo sapiens
gtgctctgtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatctggggggaaaaaaaaaaaactaataagaaaatcgaaataccaatagaagccaaatcca

SEQ ID NO: 4153 - DNA, 7974 bp, Homo sapiens
agcccagcctcgggggccagccccctccgcccaccgcacacgggctggccatgcggcggctctgaacgatgtcctcctcctcctacgccaagaacgggaccgcggacgggccgcactcccccacctcgcaggtggcccgaggcaccacaacccggaggagcaggttgaaaagatccgatggcagcaccacttcgaccagcttcatcctcagacagggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatctggggggaaaaaaaaaaaactaataagaaaatcgaaataccaatagaagccaaatccagctttggtatttatttgctggaagctaaatttacacttaaagttggagtgtataaacattttaatatatgttaatgttgccagaatgacttttcagacttaccaaatgtattgatagtgccaaaaaaaaaatctcagaaatcttaatgcagaaattatatagtctcctcagattttaatatttttatttctttcctggcacagctgttgtattcaaagtgttttgctttttgtttggtcagtactgttagctcatttgaagttggcaaaaacaaatacaaacaagcaaaaaacctcaaatttttttcagcagtgagagagaatagtaaagagaggcccaagcatagctggttatgtgaaatataaaatggggtgttgttctccctttaatcaatctgagcacaactacatacatccaggaatctgaagtcagatagtaaggatgtggtaccaatcctcccgagtgcaatgctaaacacttccaggtgggaattcatctatttcacttaacacaaacgcagggtctgtatttcctgccaacaagattgagtatctttccattgcttctctcagtctctgtctttgaatatctgaatgttctggcccttcaacaaattctttaaatcatgctaaggaatttcgttttatgtggacacactcaactttgatattcaggagatgtttttacaaaatgactaattgaaaaaagttgaaacaaatgattttaaaagcttgcagtaaaaaataaactcatagattcagcaaatatttgttgactaaaattatagcatttttaatgcagaaaattataaagaatttggagattgagctgccttatttctaatgaacactcctcttcatcttattaagtcttcacagtttttccagtggctataattatggaattggtgacctatgttttatattatcaaggaagccttagattcactctgatctaagaaattattgaaattgaccctttttacacaaatgtctttaaaaaaaaaaacttatttctaaatgtccatagtgcatgcattttctaaaaccccaataagtccagccataaaagttcttttctgctagtacatgtcatgaagcctatttttgaaaataatgataattaattttatagtatcttcttttctccccaagcctttcagtattcaggcactcaaagcatgcaccagttcagtaatcttcttgaccatggaaataagttccacattactgatgagttatatatatatcttgaaccccattacaacctcaccacatccccctgcatttatgttcagtgtttgtaccccattatgaacctgtttagctgataatgaggatacctataattctgtaagtcatttcaaatatttgatacaattaaaaaatatgggcttagtaaattttaaaagttaacatgtgatactggcttgtgagattcttctgtcatctagtgaagcttataaaactttcagttaagacattttaaaagagttatatccattaggcactttaataaacatataacctgccattactgaatactttgttagaacacagaagagcatcttccagcaaacaaaaatatatttattacatgtacagcacatacttgcatgagaaagaaaacattagccaaaacatttttctatatgctttactggtttcttgtttatgcgcattaaagtatttaattgcaaagagtgcaccaaggtgtacaaatttagactagacagctgttcagctttttctgtagtagcattagcagtttggtcatttaactactttaagatacttacattttatggcaggtagctgtaacagcatttaaatatatttcctagtcatcaagattaccatcttctttcaactttttaaaagtcacttgtttttaaaggtttttcaaagccttgtttttagtcttccatgtcatgccgataaagagagtctcattcaatatctgtgcacaaaaccaatctatcaattaccatcagatgtccatacctgttttgctttgcattcttattcaaaagctgacaatcttggaaagggtataatgtatattttattgatggatatatttaaatgtttactttaatttggaatattctttccccttctttctgtaataagtttatcttcctcaaataaggggatatacatcttattttttttaaagacttaagagtttattgtgtaaatgatacttaaaatctagatatatactaaatgaaaagttttatttttgccaagcacaccaagcacctttgaaaaatacatactccatactttgtttttaattaatttcatttaaagatagcaaatgattataagcaagagaaacaagtcttttactgttttgaggctgttttaacttacagtataagccacatactagaattctgtaatttcagtcacagacatataataatgtggactcatgtgacaatgtggaaatgtagttctggaaaaaaacgaatgcaatttgtcaatcctgatgttaattctcaagggtataatgtcactctaatattataaccaacaacattatcttgtttaatatttaaagcaacacttagaaatgtttataaatgatgattctctcttatctttatacagttctattggagagaaggttgaaattgttcacaatttagatgatggtctttcctaataagagtcttaattttgtgactatataagtcattgcagttagtctttaatgaaatgaattttattaatgtaaaacaaattctgagacaattatttgtttcctttaaataatctgctatttaattattattgtcgttgtttgcaaaatgtatttttggaatgttaacctcttttcatacctgcatacttgaacttgtcttttgtgtgggggccttaaaattcataataggaagtggaggcagtgaaaggaagtaagaaaaggaaattatgctaaaagatggtttgcaaatttaaattctttaaatgaacatatcacaaaatgttgttaagacccaggatgtccgttaagaatgtgtcttggcaaccttaatttgcatgttagtatatattttcttagttacacagttttattttggtatttgcttaaaaaatgtaataccattgtagaaattaccctatgtactgatatatttactacctcttctctagagaagacaatctgtctttaaagggaaaaacactggtcaataagtagtgatcaaaattatcactattctggctaaccttgctgcaaagctaaatacatagattattaaaatatgccttccctttagattttaaactgtttccaaaatgctgtttggcaccctttcatttcttccacgttagtgaagttttctttgaattggttcacagtttatcatgaggcaaggttaatttaacaaataagtcatcatagggaacaaaacaaactgcaagggaattgcctttgtgtgcaacttgttataatatctagttctaagtctaaaggagtaaaagtccaaagactttatgtttaagagcagctggtttgcaaattcacattttgttggtccttgacttccacagagcatgacttagccatttactgggtaaggatatgcataatcttggactcccatgtaattggaataaacttcatatcaatgtttcaaataaatgctatgtaccccttattccttttacatttctgcctttgtcttttatgacaatgttgcatgttgtgtttttttaaattatataaaactcatccttgaatgactgtatgaatgaaaaatttataggaaattatgtaataaaatctgttttattagtttctcatacctttaaatactgtcaatactataactgttagtaagttacttactcaagctgtgtctatggggcagagaacagtcctcttctttaaaataatcatgatcaaaccagtcaagtcaatccaattagctgttagacagacaataaggataaccttctttttgacttaagcagtcaagttagtcaaaatagaaaaattggcttatatgggcacccagaactacagcattcaaaaattacttttaaaagtttcttcttttattaaaatggactttcttaaataaaatacatcctctgatagcagctatctctttttacttgtaatgattaattctaaatgcttcatgtaattgagggacattatgagaagactagaaagtatctcatcagataatcctaagggctgtaacttctacttgccataaacaaagtataattaagagtgagtagcaattggtttggggagtcgtagttatatatgaaactttcttttgtttctcatgatgtatgtaaaatgtttgcagaaggatggtagaaaatgttactaatgaatttagagtggtttgggagaatacactgatacttcctcatttgaaaattataaggagttacaaggggaactaagaaccagaagtggctggcctctagcttttcaatacctgataagtgttcttggttatgttttgaacacttaaatttctcaacaaatggctatgtctatatttatgtaggggccacccttgccctacttgcatgccactttgacttttaactgaaatcagtgtgaattctgtatgcataagggatgtaataaagaggcgggatcattaacgctatatcgttgcatactatttttcatatgccttacaatattttctgggatgttattaaaatgaaagcattttattgccaaaataaatctatgttgttacttataatctgcattagcagtagaaaaataatgtagcaaaaacatattgtacagtacaaaattataaaatatatattttgccaataatataaaaatagattgaggagaaagaagcacatttgttatagcacaaacttataacaaaatccaccgttaaatttggcagtcatattttttaaaagtatgtcgatttagttctaagttttgtcagatttacttcatctaccatctttttaacttgctgcttgatacttttccagcaatttatttcatagccttgcaatctgtggatgtaatttcttttgttttattcccttccataaaatttattaaattttattttgtgataacactcataccatattttctcctcttatttcttctctttcaataacaacagcagaaagtcacagcaagtgagctcatagggctcctctgaattttggacatgtgtgagatttttgtatttttcacagcctcgagtcagaatgatcaataaagatgtcccaaccacaaaaaattatattagttagggattctttaatttgttttgtactgaatactactttgaaacataagttaaagccattagctgtgtttttgtagggatggtgggaaggaataaaaaataaatgtattaacataaaacatactaaaacagaaatatggcaaaatgatgtaaaaagatttttcctactattctgagggctgttgaaatcccaggctattgctatatctccattgacaaagtgggataaaaaatgcctttgtcaaataattttttttctttctttaaattttagttatttattttaataatttgtccccttttatttttcttatctaggtatgtgtagcattctacaaggcatgctgggtaaaatatactatgcaaatgtgtacagtgctgcatgttttgttctccctctgctttagtggctttaaagaaaaaaacgtggtgttatttttgtgaataaaaacattaacaaagaaaatgcagagtgcatgcatagagtatcctcatttctatggatttgttttatggaatttaaatgtgtacaaaacaactgcattactttttttcttttatataataaatgaaaaaaacac

SEQ ID NO: 4154 - DNA, 7581 bp, Homo sapiens
ttctattttctttgccagggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccaagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatctggggggaaaaaaaaaaaactaataagaaaatcgaaataccaatagaagccaaatccagctttggtatttatttgctggaagctaaatttacacttaaagttggagtgtataaacattttaatatatgttaatgttgccagaatgacttttcagacttaccaaatgtattgatagtgccaaaaaaaaaatctcagaaatcttaatgcagaaattatatagtctcctcagattttaatatttttatttctttcctggcacagctgttgtattcaaagtgttttgctttttgtttggtcagtactgttagctcatttgaagttggcaaaaacaaatacaaacaagcaaaaaacctcaaatttttttcagcagtgagagagaatagtaaagagaggcccaagcatagctggttatgtgaaatataaaatggggtgttgttctccctttaatcaatctgagcacaactacatacatccaggaatctgaagtcagatagtaaggatgtggtaccaatcctcccgagtgcaatgctaaacacttccaggtgggaattcatctatttcacttaacacaaacgcagggtctgtatttcctgccaacaagattgagtatctttccattgcttctctcagtctctgtctttgaatatctgaatgttctggcccttcaacaaattctttaaatcatgctaaggaatttcgttttatgtggacacactcaactttgatattcaggagatgtttttacaaaatgactaattgaaaaaagttgaaacaaatgattttaaaagcttgcagtaaaaaataaactcatagattcagcaaatatttgttgactaaaattatagcatttttaatgcagaaaattataaagaatttggagattgagctgccttatttctaatgaacactcctcttcatcttattaagtcttcacagtttttccagtggctataattatggaattggtgacctatgttttatattatcaaggaagccttagattcactctgatctaagaaattattgaaattgaccctttttacacaaatgtctttaaaaaaaaaaacttatttctaaatgtccatagtgcatgcattttctaaaaccccaataagtccagccataaaagttcttttctgctagtacatgtcatgaagcctatttttgaaaataatgataattaattttatagtatcttcttttctccccaagcctttcagtattcaggcactcaaagcatgcaccagttcagtaatcttcttgaccatggaaataagttccacattactgatgagttatatatatatcttgaaccccattacaacctcaccacatccccctgcatttatgttcagtgtttgtaccccattatgaacctgtttagctgataatgaggatacctataattctgtaagtcatttcaaatatttgatacaattaaaaaatatgggcttagtaaattttaaaagttaacatgtgatactggcttgtgagattcttctgtcatctagtgaagcttataaaactttcagttaagacattttaaaagagttatatccattaggcactttaataaacatataacctgccattactgaatactttgttagaacacagaagagcatcttccagcaaacaaaaatatatttattacatgtacagcacatacttgcatgagaaagaaaacattagccaaaacatttttctatatgctttactggtttcttgtttatgcgcattaaagtatttaattgcaaagagtgcaccaaggtgtacaaatttagactagacagctgttcagctttttctgtagtagcattagcagtttggtcatttaactactttaagatacttacattttatggcaggtagctgtaacagcatttaaatatatttcctagtcatcaagattaccatcttctttcaactttttaaaagtcacttgtttttaaaggtttttcaaagccttgtttttagtcttccatgtcatgccgataaagagagtctcattcaatatctgtgcacaaaaccaatctatcaattaccatcagatgtccatacctgttttgctttgcattcttattcaaaagctgacaatcttggaaagggtataatgtatattttattgatggatatatttaaatgtttactttaatttggaatattctttccccttctttctgtaataagtttatcttcctcaaataaggggatatacatcttattttttttaaagacttaagagtttattgtgtaaatgatacttaaaatctagatatatactaaatgaaaagttttatttttgccaagcacaccaagcacctttgaaaaatacatactccatactttgtttttaattaatttcatttaaagatagcaaatgattataagcaagagaaacaagtcttttactgttttgaggctgttttaacttacagtataagccacatactagaattctgtaatttcagtcacagacatataataatgtggactcatgtgacaatgtggaaatgtagttctggaaaaaaacgaatgcaatttgtcaatcctgatgttaattctcaagggtataatgtcactctaatattataaccaacaacattatcttgtttaatatttaaagcaacacttagaaatgtttataaatgatgattctctcttatctttatacagttctattggagagaaggttgaaattgttcacaatttagatgatggtctttcctaataagagtcttaattttgtgactatataagtcattgcagttagtctttaatgaaatgaattttattaatgtaaaacaaattctgagacaattatttgtttcctttaaataatctgctatttaattattattgtcgttgtttgcaaaatgtatttttggaatgttaacctcttttcatacctgcatacttgaacttgtcttttgtgtgggggccttaaaattcataataggaagtggaggcagtgaaaggaagtaagaaaaggaaattatgctaaaagatggtttgcaaatttaaattctttaaatgaacatatcacaaaatgttgttaagacccaggatgtccgttaagaatgtgtcttggcaaccttaatttgcatgttagtatatattttcttagttacacagttttattttggtatttgcttaaaaaatgtaataccattgtagaaattaccctatgtactgatatatttactacctcttctctagagaagacaatctgtctttaaagggaaaaacactggtcaataagtagtgatcaaaattatcactattctggctaaccttgctgcaaagctaaatacatagattattaaaatatgccttccctttagattttaaactgtttccaaaatgctgtttggcaccctttcatttcttccacgttagtgaagttttctttgaattggttcacagtttatcatgaggcaaggttaatttaacaaataagtcatcatagggaacaaaacaaactgcaagggaattgcctttgtgtgcaacttgttataatatctagttctaagtctaaaggagtaaaagtccaaagactttatgtttaagagcagctggtttgcaaattcacattttgttggtccttgacttccacagagcatgacttagccatttactgggtaaggatatgcataatcttggactcccatgtaattggaataaacttcatatcaatgtttcaaataaatgctatgtaccccttattccttttacatttctgcctttgtcttttatgacaatgttgcatgttgtgtttttttaaattatataaaactcatccttgaatgactgtatgaatgaaaaatttataggaaattatgtaataaaatctgttttattagtttctcatacctttaaatactgtcaatactataactgttagtaagttacttactcaagctgtgtctatggggcagagaacagtcctcttctttaaaataatcatgatcaaaccagtcaagtcaatccaattagctgttagacagacaataaggataaccttctttttgacttaagcagtcaagttagtcaaaatagaaaaattggcttatatgggcacccagaactacagcattcaaaaattacttttaaaagtttcttcttttattaaaatggactttcttaaataaaatacatcctctgatagcagctatctctttttacttgtaatgattaattctaaatgcttcatgtaattgagggacattatgagaagactagaaagtatctcatcagataatcctaagggctgtaacttctacttgccataaacaaagtataattaagagtgagtagcaattggtttggggagtcgtagttatatatgaaactttcttttgtttctcatgatgtatgtaaaatgtttgcagaaggatggtagaaaatgttactaatgaatttagagtggtttgggagaatacactgatacttcctcatttgaaaattataaggagttacaaggggaactaagaaccagaagtggctggcctctagcttttcaatacctgataagtgttcttggttatgttttgaacacttaaatttctcaacaaatggctatgtctatatttatgtaggggccacccttgccctacttgcatgccactttgacttttaactgaaatcagtgtgaattctgtatgcataagggatgtaataaagaggcgggatcattaacgctatatcgttgcatactatttttcatatgccttacaatattttctgggatgttattaaaatgaaagcattttattgccaaaataaatctatgttgttacttataatctgcattagcagtagaaaaataatgtagcaaaaacatattgtacagtacaaaattataaaatatatattttgccaataatataaaaatagattgaggagaaagaagcacatttgttatagcacaaacttataacaaaatccaccgttaaatttggcagtcatattttttaaaagtatgtcgatttagttctaagttttgtcagatttacttcatctaccatctttttaacttgctgcttgatacttttccagcaatttatttcatagccttgcaatctgtggatgtaatttcttttgttttattcccttccataaaatttattaaattttattttgtgataacactcataccatattttctcctcttatttcttctctttcaataacaacagcagaaagtcacagcaagtgagctcatagggctcctctgaattttggacatgtgtgagatttttgtatttttcacagcctcgagtcagaatgatcaataaagatgtcccaaccacaaaaaattatattagttagggattctttaatttgttttgtactgaatactactttgaaacataagttaaagccattagctgtgtttttgtagggatggtgggaaggaataaaaaataaatgtattaacataaaacatactaaaacagaaatatggcaaaatgatgtaaaaagatttttcctactattctgagggctgttgaaatcccaggctattgctatatctccattgacaaagtgggataaaaaatgcctttgtcaaataattttttttctttctttaaattttagttatttattttaataatttgtccccttttatttttcttatctaggtatgtgtagcattctacaaggcatgctgggtaaaatatactatgcaaatgtgtacagtgctgcatgttttgttctccctctgctttagtggctttaaagaaaaaaacgtggtgttatttttgtgaataaaaacattaacaaagaaaatgcagagtgcatgcatagagtatcctcatttctatggatttgttttatggaatttaaatgtgtacaaaacaactgcattactttttttcttttatataataaatg

SEQ ID NO: 4155 - DNA, 1266 bp, Homo sapiens
cggcttgtcacctgccctaggagacgcagccgccggaccctgcccagggcacccacgcctcggcgaccaccatgtcccagaccaaaatgctgaaggtccgcgtgaccctcttctgcatcctggcaggcatcgtgctggccatgacagccgtggtaaccgaccactgggctgtgctgagcccccacatggagcaccacaacactacctgcgaggcggcccacttcggcctctggcggatttgtaccaagcgcatccccatggacgacagcaagacctgcgggcccatcaccctgcccggggagaagaactgttcctacttcaggcattttaaccccggcgagagctcggagatcttcgaattcaccactcagaaggagtacagcatctcggcagccgccatcgccatcttcagccttggcttcatcatcctgggcagcctctgtgtcctcctgtccctcgggaagaagagggactatctgctgcgacccgcgtccatgttctatgcctttgcaggtctctgcatcctcgtctcggtggaggtcatgcggcagtcggtgaagcgcatgattgacagtgaggacaccgtctggatcgagtactattactcctggtcctttgcctgcgcctgtgccgccttcatcctcctctttctcggcggtctcgccctcctgctgttctccctgcctcgaatgccccggaacccatgggagtcctgcatggatgctgagcccgagcactaaccctcctgcggccctagcgaccctcaggcttcttccccaggaagcggggtcttggcctggaaccttccagagaggaggcgggagcaattttagccccaccctgctcccatctgcccccctgcaacagtcgcaggctgcttcctctctctgagttcctctgggctgccgcaggctcccctgggaatagagcaagacgtgagtcctaacctggccacagttgggggaggcagagccagcaggtggacaggtgtttgcaggggcccaacttcccctggagctcagaggtgtccccactgtaccagcctctgataagctgcctccagttgtcctttatgaacattgcagggacaacctgtgtttgccagctgggtgttccgtgtaaatagccagcctgtctctttctcggtgataaaacacaccctctctggtgagcccagcgtcccctccttggcttccaggagccctgggaagcatttttaactgggtagaatctgactgtggcttgaaataaaaagctctcagaaaa

SEQ ID NO: 4156 - DNA, 2384 bp, Homo sapiens
gcggcgcagggagctgtccggttcagcaccacccgtaatgcagtaggtgggagcgcctccgcgggcgcccagccggtagcgagtggggggcaggcgcgcggcccaccctgcagcaagacgccggctccctcgtttccaggagctttgcagatagggggagggaaatccgcctcgattctccaggagaaaccccctctctcccccacttcgccaacactacccccgccaccaacaacaataaccgccgccgctgctcgtcctgctgccgccgccgccgccgcgcctgcccgccctgccgccgccgccgccgccgccgccgctgcccgggcaaaaccatggaaagcgagacccccgcacctgtgcagctgagctcaagggcttacagaatactgggaagtctggtctgaaacgaaagcgccgagaccccccaaggaagagaactggcgaagcaaaggattttcatggcgcaggccgcagagccgagaacgaagaccgaaggttgcatctcggctctcacagtctctaactgtctaggtcccgaccatgagaaatggtgttgagaattcggctgttccctggttcactgtggaagccatctccaaattaactatcacatatggaaactggagaccagaattttagaaaaagagattaaggcatctcacttgggggggtggggggtgtctttttattttttttttccttttctttttaaaaaaaaaacactgcaactggaacagtttctgatctcaaaaggcaagcctcttcccgtgtgatctttataatttacactcttttccgtgagctttcttacctccctttttttataactctccatattctctattcatacatatatccattatattagtagtggaataatttttatttttatttattttttttggctttagtacttgcaccctcacacacactctcccgagaaccagaagtcggttgggtgtttatataatgaagaattatggggctgtttgatcgaggtgttcaaatgcttttaaccaccgttggtgctttcgctgccttcagcctgatgaccatagctgtgggaaccgactattggctctactccagaggggtttgcaagaccaaaagtgtcagtgagaatgaaaccagcaaaaagaacgaggaagttatgacccattccggattatggagaacctgctgcctagaagggaatttcaaaggtctgtgcaagcaaattgatcacttcccagaggatgcagattacgaagctgacacagcagaatatttcctccgggccgtgagggcctccagcattttcccaatcctgagtgtgattctgcttttcatgggtggcctctgcatcgcagccagcgagttctacaaaactcgacacaacatcatcctgagtgccggcatcttcttcgtgtctgcaggtctgagtaacatcattggcatcatagtgtacatatctgccaatgccggagacccctccaagagcgactccaaaaagaatagttactcatacggctggtccttctacttcggggccctgtccttcatcatcgccgagatggtcggggtgctggcggtgcacatgtttatcgaccggcacaaacagctgcgggccacggcccgcgccacggactacctccaggcctctgccatcacccgcatccccagctaccgctaccgctaccagcgccgcagccgctccagctcgcgctccacggagccctcacactccagggacgcctcccccgtgggcatcaagggcttcaacaccctgccgtccacggagatctccatgtacacgctcagcagggaccccctgaaggccgccaccacgcccaccgccacctacaactccgacagggataacagcttcctccaggttcacaactgtatccagaaggagaacaaggactctctccactccaacacagccaaccgccggaccacccccgtataaagaccgcgggcctcgccagaagaccgcgggaggagggcgcggtccccgggggcggggcggggcggggagacccagaccctccgctgggagaccttccaaaagcaaaaacaaaaaacaaaaaaaacaaaaaaacaaaaaacaaaaaaacacacacacacaaaaaaagagaaaaaacataacaagtaaattttaaaaaaaagaacaaaatataagaggaacaaagaagcaaaacaacaggaaatgtgggaaaatataaacgagggaagaaaacaaactttaaaaaaaagcgagagggataaaaaattaaaaatagaaaataaatctaaaagaaaatgcatgatttcccatgtaccattattttaacatttaataaaaatcaatttaaatgaaaaaataaaagggaaccaagataacattaaagcaaaaaaaa

SEQ ID NO: 4157 - DNA, 3088 bp, Homo sapiens
actttttgcccgcctaagcgagccatagagccgtctccagagctgccggtgcctttaagaagactcggtctttcgggtcttctttttccccaatgggctccagtggtgcccgcagcaaaaggcaaacttgcctggctcatggggtgaaagggaggattgaagaatgccgcgttgggtgggtgctgagggagcgccagagtgcgctacgggcttcgctccccttcccctttccttaacccttcctagagcggaggaaccgggtcgtgctgcagcgcccaggagccagggcgctgactgtcctcggctccagaaactttgcgcggagagtgggcttgactgggcagagccgagccggctggctgacccgggaaggaacgggggaagggcggggtgagggaagaaagaccctttagcaccccgggtttctagcccgggcggcggtgtgcagctgcatgagggagctgtcccttcggcaccacggaccttaaagcctaggcgttaagacgacggaggcggggcaacaggcggggagctgtcccttcagcaccacggaccttggcgcccccagggaaaccagccggcccccgccccaggactctgtcttttctccagtttgagcgggggtgtcgggagcaggcggagagctttcctgcgaggctgtggaagcagtgaacactcttctcagcggctcgcctcccagcagtgctattttttgccatccgccctcacccccagcacacgcgctcgcacacacacgcacgcacgcacacacacacacacacacactcacacagagacctctctgggtttctttgccttgagtctcccggggctgtgagaagccaggcgcatctcaaaccgagctggcagctccaggctccggagccatgccctgcacggaccctcgtctttaccacgctcctgaggaatgaaaggaacccagggaccctcagaaggcagcagtgatgcggaccaaccccccggagcctgcacccttccgagggccataggcgacccagggaactggagagagctccagaaaggaaatcccagctttcccaaagtccctgtggatgctgacaaaaggagacctgaatttttggaagagcctgtactaggttacccggctgcagagtgattttcccctccggcactgactctccccctccaacccccagccgtccagagtaccatgaagaattatgaggatgtgtgacagaggtatccagatgttgatcaccactgtaggagcctttgccgcttttagtttaatgaccattgcagtgggcacggactactggttatattccagaggtgtgtgcaggactaaatctacaagtgataatgaaaccagcaggaagaatgaagaagtaatgacccattcggggctgtggaggacctgctgcctagaaggggctttccgaggcgtgtgcaagaaaatcgatcacttccctgaagatgctgactacgaacaggacacagccgaatatctcctgcgagctgtgagggcctccagtgtcttccccatcctcagtgtcacgctgctgttcttcggcgggctctgcgtggcagccagtgagttccaccgcagcagacacaacgtcattctcagcgcgggcatcttttttgtctctgcagggttaagcaacatcattggcatcatagtttatatatcagccaacgccggagaccccgggcagcgtgactccaaaaaaagttactcctatggttggtccttttatttcggagccttctctttcatcatcgcagaaattgtaggagtggttgccgtgcacatctatattgaaaaacatcagcagttacgagccaaatcccactcggagttcctgaagaaatctacttttgcccgcctcccaccctacaggtatcgattccggaggcggtcaagttctcgctccaccgagcccagatcccgagacctgtcccccatcagcaaaggcttccacaccatcccttccactgacatctcgatgttcaccctctcccgggacccctcaaagatcaccatggggaccctcctcaactccgaccgggaccacgcttttctacagttccacaattccacacccaaagagttcaaagagtcactgcataataatccggccaacaggcgcaccacgcccgtctgaactgacctctgacctctgccccacgcccagcacagccttgggggaagtgtacagagatgtctctgaggttgcatggcatggtccttgtgatggtattactttttacaaagaatgaaaccaaatggactcagccctctcccacattttcccctcaccctccaagtcctaacccctccatcctctctaacttttcaagccaatcccttaatgtcattcctctctctgtgtatctgtgccagatgttttcctttcttccttctttactggaaggacctccacattcttccctccttggaagaggactttactaaaagtcacaggtggtggccaggggggatttccgaatctccatcaggcgcgctcatagttgtccccattgtctacccacacaaatcctcaggaaaccaaccaccgcccaggtggccctgagggaggcattcacctttatgtgttagaaaaacatgaccagaaatcaaagatgtcagagccccgaagcagctaatgtaataagcactcatgttattaaaggttttgccttgtcgtaaccaaccgagccgggggtgttttgtttcttgtgggtgtttcctacacaaactcactcccctgcctccaaactggctcatgtccatcttggaagctgaactttgctcatccacacttgagccactaggaaggatctccctgcacctttggaagctagtaaggcattcccacaaatgtccaaatcaatgcatccttctacttgaattcctggaggctacctgggggtgggtgagtgaatgctggttttcaagatctaactttggcatgcaatagctctagaaccttgggcaagtcacctaagcctcaagcctcagtctcctcatctgtaaaatggaacatgataatagcactctcctccacagagttatgaggtttaaataaaactgtgtgtaaaa

SEQ ID NO: 4158 - DNA, 891 bp, Homo sapiens
atgagtgcctgcgggaggaaggccctgaccctgctgagcagtgtctttgctgtctgtggcttgggcctcctgggtatcgcggtcagcaccgactactggctgtacctggaggagggtgtgattgtgccccagaaccagagcaccgagatcaagatgtccctgcactcaggcctctggcgggtctgcttccttgcaggtgaggagcgggggcgttgcttcaccatagaatatgtgatgcccatgaacacccagctgacatccgagtccacggtcaatgttctaaagatgatccgctcagccacaccattccctctggtcagcctcttcttcatgttcattgggtttatcctgaacaacatcggacacatccgtccccaccggacgatactggcctttgtctctggcatcttctttatcctctcaggcctctctctcgtggtgggcctggtgctctacatctccagcatcaacgatgagatgctcaacaggaccaaggatgcagagacctacttcaactacaagtatgggtggtcgtttgccttcgccgccatctccttccttttaacggaggtaaagcccgtcaccctaagtatggataggctgggcctgggcactgccccactgagccggggagagtggggatgggggagaagggacattccacaaccattttggaccccggaccacccactctacttcccttcctcatcccagaatgtgtcactgtcttacctttctgggtctcctccggccaggatgtccccaggaccctgctcctgtccccacgtccacttcccaccccactcgagctgtgtcctgtgcagaccccagccaagggagatgaggcaggccccagcagcgagcccatcctctgctgtcttctccctgtag

SEQ ID NO: 4159 - DNA, 828 bp, Homo sapiens
atgagtgcctgcgggaggaaggccctgaccctgctgagcagtgtctttgctgtctgtggcttgggcctcctgggtatcgcggtcagcaccgactactggctgtacctggaggagggtgtgattgtgccccagaaccagagcaccgagatcaagatgtccctgcactcaggcctctggcgggtctgcttccttgcaggtgaggagcgggggcgttgcttcaccatagaatatgtgatgcccatgaacacccagctgacatccgagtccacggtcaatgttctaaagatgatccgctcagccacaccattccctctggtcagcctcttcttcatgttcattgggtttatcctgaacaacatcggacacatccgtccccaccggacgatactggcctttgtctctggcatcttctttatcctctcaggcctctctctcgtggtgggcctggtgctctacatctccagcatcaacgatgagatgctcaacaggaccaaggatgcagagacctacttcaactacaagtatgggtggtcgtttgccttcgccgccatctccttccttttaacggagagtgccggggtgatgtctgtgtacctgtttatgaagcggtacaccgcggaggacatgtacaggccccaccctggcttctaccgccctcggctgagcaactgctccgattactcaggccagttcctacacccagacgcctgggtcaggggccgcagcccctccgacatctccagcgaggcctccctgcagatgaacagcaactaccccgccttgctcaagtgccccgactatgatcagatgtcctcttcaccctgctga

SEQ ID NO: 4160 - DNA, 1311 bp, Homo sapiens
attggcgccgagcggttccggctgactggacggggcgggcgtcccgggcagcctagcgcggtacctcccgccccgcgcgcccagccggcgagggacattggaccagggtcgggggtcgcggccgctccagcgagagccgtgggtactgccacctgctcacccactctccctagccccagagcgcagtccgtgctggtgggagcgtggcgactagttgcacagcaacggtccaggaagatgagtgcctgcgggaggaaggccctgaccctgctgagcagtgtctttgctgtctgtggcttgggcctcctgggtatcgcggtcagcaccgactactggctgtacctggaggagggtgtgattgtgccccagaaccagagcaccgagatcaagatgtccctgcactcaggcctctggcgggtctgcttccttgcaggtgaggagcgggggcgttgcttcaccatagaatatgtgatgcccatgaacacccagctgacatccgagtccacggtcaatgttctaaagatgatccgctcagccacaccattccctctggtcagcctcttcttcatgttcattgggtttatcctgaacaacatcggacacatccgtccccaccggacgatactggcctttgtctctggcatcttctttatcctctcaggcctctctctcgtggtgggcctggtgctctacatctccagcatcaacgatgagatgctcaacaggaccaaggatgcagagacctacttcaactacaagtatgggtggtcgtttgccttcgccgccatctccttccttttaacggagagtgccggggtgatgtctgtgtacctgtttatgaagcggtacaccgcggaggacatgtacaggccccaccctggcttctaccgccctcggctgagcaactgctccgattactcaggccagttcctacacccagacgcctgggtcaggggccgcagcccctccgacatctccagcgaggcctccctgcagatgaacagcaactaccccgccttgctcaagtgccccgactatgatcagatgtcctcttcaccctgctgagcctcggccgcccccatccctggactgtgggtggccagacaacccttcctgttctctccaggtgacccctgagccccaggcctgtggttgacaggcccaggccacccatgcttagctgttgtcacttgaccccagtcctctccctgcttctccagaagggctctaactgccccagcatgggtgtgggagtctggagtctgtgggcaagctgattgtctgggaacatgggagaagccccgcccatgt

SEQ ID NO: 4161 - DNA, 1853 bp, Homo sapiens
ccaagtcctctgttctcaaactctgagcccaagggaaccccggccacatctcctccaaacacacacaggacctcaggtcccttcctgggtaccccaaactcttagccctagtggggtgctcagatctctcaggaaaaccagtttcccttttgttaaccccccagcggggaccccaaagcagccccttggagctgcagggagcttcagcgggcaccagttctcattcctctggagctcttggggggactccctcctgggaagccgaattctatctctaaacctcagggtgggggccttgtttttcctctgggccccgtcttctttgccaagttcttgagggcaacctagaccctcctctgaaccccagaggcttccccagccctggggatcatttttctcttctgaaccccagaagcaatctcgactttcgcatttgagattccagacaggactcggctctccctctttcatacccaggggaaactgagtccctcacccccttcaagaccccaggccgctcctcgctcccgcccctcgaggcccttcgccggctctgcctcctcccccttcccgaccccaccggccataagatgatgtggtccaacttcttcctgcaagaggagaaccggcggcggggggccgcgggccggcggcgggcgcacgggcagggcaggtcggggctgacgcccgagcgcgaggggaaggtgaagctggcgctgctgctggccgccgtgggcgccacgctggcggtgctgtccgtgggcaccgagttctgggtggagctcaacacctacaaggccaacggcagcgccgtgtgcgaagcggcccacctggggctgtggaaggcgtgcaccaagcggctgtggcaggcggacgtgcccgtggacagggacacctgcggccccgcggagctgcccggagaagcaaactgcacctattttaaattcttcaccacgggggagaatgcacgcatctttcagagaaccacaaagaaagaggtgaatctggcagctgcggtgatagcagtgctgggcctggcagtcatggccttggggtgcctctgtatcatcatggtgctcagtaaaggtgcagagttcctgctccgagttggagccgtctgctttggcctctcaggcctgctgctcttggtgagcctggaggtgttccggcattccgtgagggccctgctgcagagagtcagcccggagcctcccccggccccacgcctcacctacgagtactcctggtccctgggctgcggcgtgggggccggcctgatcctgctgttgggggccggctgctttctgctgctcacactgccttcctggccctgggggtccctctgtcccaagcgggggcaccgggccacctagagccacgcgtgagacttctctaagcaaccaccgagccctttgaccttctccattgtacccccaagatctttttgccccatctcctagagaaactgtgttctccctgctcgggggcccatgtttttttacacgcctgcctcctgtccccttatcctttctccctctgtaaatacgtttttctctgtggctgtatgtgggttgcttgggggtgggatgggaagaggctctttgcaaacgagggtccccagagaagactggcggggacctgatggggtagctggggtgtggggttgggggatgaggtcagggggtcttgggtgggagttgggggccccttcatttcccaggtctggatcgattcacttgccgggagagactttttacaactcatctgcagctccgggtgcggttgggggagatagcgaagggtctggcctcgctgtgatctgatttgggattaaaggtttggaaatttaacaa

SEQ ID NO: 4162 - DNA, 645 bp, Homo sapiens
atgatgtggtccaacttcttcctgcaagaggagaaccggcggcggggggccgcgggccggcggcgggcgcacgggcagggcaggtcggggctgacgcccgagcgcgaggggaaggtgaagctggcgctgctgctggccgccgtgggcgccacgctggcggtgctgtccgtgggcaccgagttctgggtggagctcaacacctacaaggccaacggcagcgccgtgtgcgaagcggcccacctggggctgtggaaggcgtgcaccaagcggctgtggcaggcggacgtgcccgtggacagggacacctgcggccccgcggagctgcccggagaagcaaactgcacctattttaaattcttcaccacgggggagaatgcacgcatctttcagagaaccacaaagaaaggcctgctgctcttggtgagcctggaggtgttccggcattccgtgagggccctgctgcagagagtcagcccggagcctcccccggccccacgcctcacctacgagtactcctggtccctgggctgcggcgtgggggccggcctgatcctgctgttgggggccggctgctttctgctgctcacactgccttcctggccctgggggtccctctgtcccaagcgggggcaccgggccacctag

SEQ ID NO: 4163 - DNA, 1635 bp, Homo sapiens
ccaagtcctctgttctcaaactctgagcccaagggaaccccggccacatctcctccaaacacacacaggacctcaggtcccttcctgggtaccccaaactcttagccctagtggggtgctcagatctctcaggaaaaccagtttcccttttgttaaccccccagcggggaccccaaagcagccccttggagctgcagggagcttcagcgggcaccagttctcattcctctggagctcttggggggactccctcctgggaagccgaattctatctctaaacctcagggtgggggccttgtttttcctctgggccccgtcttctttgccaagttcttgagggcaacctagaccctcctctgaaccccagaggcttccccagccctggggatcatttttctcttctgaaccccagaagcaatctcgactttcgcatttgagattccagacaggactcggctctccctctttcatacccaggggaaactgagtccctcacccccttcaagaccccaggccgctcctcgctcccgcccctcgaggcccttcgccggctctgcctcctcccccttcccgaccccaccggccataagatgatgtggtccaacttcttcctgcaagaggagaaccggcggcggggggccgcgggccggcggcgggcgcacgggcagggcaggtcggggctgacgcccgagcgcgaggggaaggtgaagctggcgctgctgctggccgccgtgggcgccacgctggcggtgctgtccgtgggcaccgagttctgggtggagctcaacacctacaaggccaacggcagcgccgtgtgcgaagcggcccacctggggctgtggaaggcgtgcaccaagcggctgtggcaggcggacgtgcccgtggacagggacacctgcggccccgcggagctgcccggaggcctgctgctcttggtgagcctggaggtgttccggcattccgtgagggccctgctgcagagagtcagcccggagcctcccccggccccacgcctcacctacgagtactcctggtccctgggctgcggcgtgggggccggcctgatcctgctgttgggggccggctgctttctgctgctcacactgccttcctggccctgggggtccctctgtcccaagcgggggcaccgggccacctagagccacgcgtgagacttctctaagcaaccaccgagccctttgaccttctccattgtacccccaagatctttttgccccatctcctagagaaactgtgttctccctgctcgggggcccatgtttttttacacgcctgcctcctgtccccttatcctttctccctctgtaaatacgtttttctctgtggctgtatgtgggttgcttgggggtgggatgggaagaggctctttgcaaacgagggtccccagagaagactggcggggacctgatggggtagctggggtgtggggttgggggatgaggtcagggggtcttgggtgggagttgggggccccttcatttcccaggtctggatcgattcacttgccgggagagactttttacaactcatctgcagctccgggtgcggttgggggagatagcgaagggtctggcctcgctgtgatctgatttgggattaaaggtttggaaattt

SEQ ID NO: 4164 - DNA, 1016 bp, Homo sapiens
tgctgcatggggtcaagcactctggtcggtcccatggagctctgcactgtagcttcccttccacaggccccgcagggcgccccctgcctctgaggatgagtcactgcagcagccgcgccctgaccctgctgagcagcgtgtttggtgcgtgtggcctgctcctggtaggcatcgcggtcagcactgactactggctgtacatggaagaaggcacagtgctaccgcagaaccagaccaccgaggtcaagatggccctgcacgccggcctctggcgagtctgcttctttgcaggtcgggagaaaggtcgctgtgtggcctcagaatattttcttgaaccggagatcaatttggtgacggaaaacacggagaatattctgaagacagtgcgcacggccacccccttccccatggtcagcctcttcctcgtgttcacggccttcgtcatcagcaacatcggccacatccgcccgcagaggaccattctggcttttgtctctggcatcttcttcatactatcgggcctctccttggtggtgggcttggttctttacatctccagcatcaacgacgaggtcatgaacaggcccagcagctctgagcagtattttcattatcgctacgggtggtcttttgccttcgccgcttcctccttcctactcaaagagggggccggcgtgatgtccgtgtacctgttcaccaagcgctacgcggaggaggagatgtaccgtccacacccggccttctaccgcccgcgtctcagcgactgctccgactactcgggccagttcctgcagcccgaggcgtggcgccgcggccggagcccctccgacatctccagcgacgtgtccatccaaatgacgcagaactaccctcccgccatcaagtacccggaccacctgcacatctccacctcgccctgctgaggcccgcccctcggagctccccctgcctcctcctcctcctcgtcttaggggggtctccctgcaatgcagcgcccccttccgtcctcgggactc

SEQ ID NO: 4165 - DNA, 2688 bp, Homo sapiens
gcggccgcggggggtggggggtgggaggccgggagggggccgggacgccgggctccggggcgggggcggggggcgcgggcaccggcgaccccggtggcggcggcggcggccgggggaagcctcggggccggtcatgcggctgcggggcccgcggcccggagcgtccgcccagccctgagcgaggccccgcagggcgccccctgcctctgaggatgagtcactgcagcagccgcgccctgaccctgctgagcagcgtgtttggtgcgtgtggcctgctcctggtaggcatcgcggtcagcactgactactggctgtacatggaagaaggcacagtgctaccgcagaaccagaccaccgaggtcaagatggccctgcacgccggcctctggcgagtctgcttctttgcaggtcgggagaaaggtcgctgtgtggcctcagaatattttcttgaaccggagatcaatttggtgacggaaaacacggagaatattctgaagacagtgcgcacggccacccccttccccatggtcagcctcttcctcgtgttcacggccttcgtcatcagcaacatcggccacatccgcccgcagaggaccattctggcttttgtctctggcatcttcttcatactatcgggcctctccttggtggtgggcttggttctttacatctccagcatcaacgacgaggtcatgaacaggcccagcagctctgagcagtattttcattatcgctacgggtggtcttttgccttcgccgcttcctccttcctactcaaagagggggccggcgtgatgtccgtgtacctgttcaccaagcgctacgcggaggaggagatgtaccgtccacacccggccttctaccgcccgcgtctcagcgactgctccgactactcgggccagttcctgcagcccgaggcgtggcgccgcggccggagcccctccgacatctccagcgacgtgtccatccaaatgacgcagaactaccctcccgccatcaagtacccggaccacctgcacatctccacctcgccctgctgaggcccgcccctcggagctccccctgcctcctcctcctcctcgtcttaggggggtctccctgcaatgcagcgcccccttccgtcctcgggactcctcgctcccacccggaggaggctgcgccagctttaggccccgccctcctcccaatggctccgcccacagactcccttatttcaatggccgcgccctcttttcccgacctctccttttcattggtccctctcactcccaaatgactcctccccttcgttggcccgcccctttcctctggcccctcctctccaagaaaattagctcctccctcgttctccacctgctctgagctgggagcagccagaggcggtgcaagcgcccagctccccagagctccccaacctcggacctcaccgcaggggcgctgggctggagagcaggttcgggcagccgtcgggaataccgaccatcctcttctcccttctaacctgggcttcctttttccctgcctaatctcacctcctgacctgctgggtcctccggtgcagtgggagggccggcttgctccacccgcagccccggggtggcgtagggaagggggctggaagccacgggtacggttaacctggcccttccctccccatctcccctacttccctggaaggtcccattctttctcaccggctgggctcttttctgcttcctgaaggttacctgccttttagggggctcttgtctaaaggatcttcttgctttctcagctatccttggcttctttttcgtcttcctcctcctttaactctttctctcctttcctcccttcacccgttcgtcccaagcccttgggtgcatcccgccctaggcgcacaccagacggccagaatggggaccctagggtggagggaattcccccacgccatctccgcacctgtgcccgcctctcccccctcgaggccccgtcgagggagggaggggcagtagcgggggtcgacaccccccccaaacctctaagtcttccattttctggctctcctcctcattgacgtccctcttcccccctcagaaccccaactctggcctctttcaagggcccgtccgccccgttggacagattttggggggagaggaggtcaccaggaactcgcccacccccccttattagggaaagaggggcgaggtagcacagtgctgtacacggaaccagaatggcccccggggtggggggaggggggcaggggagggacgggggcttttagtttgcatcttaggtgggaggggggaggggggacccgccgcagttaacctgactttacgcagcgatttttaacgaggctggggggaggggggcactggggtggggacagggtggggtggggggcctggctctgttatttaccgtgtatcatatgtaaatatcgacagaaacttcaataaactttatttcaaacacgtctccgcctgcccggagggaagggattggatagagggggcttagtctgggtctctgcttctagggttgcaggcctaaagtactgcagaatgacgttagatgggtcgttgttaaatgacttaatcatcatcattatcaacggcagcgctttatacttcagtccgtgtaaagcatgcaggaccgtaaatgatactggtcaggatcaataaacgctttctcctggta

SEQ ID NO: 4166 - DNA, 8747 bp, Homo sapiens
ccccgcttctgcctgcgctgtgaacccccccccagccgccggcacggccccgcccccgctgccccggtggtggcccacggccccccggctgcccgtggtcaaactggagtcgctgaagcgctggaacgaagagcggggcctctggtgcgagaagggggtgcaggtgctgctgacgacggtgggcgccttcgccgccttcggcctcatgaccatcgccatcagcactgactactggctctacacgcgcgccctcatctgcaacaccaccaacctcacggccggcggcgacgacgggaccccccaccgcgggggcggcggcgcctcggagaagaaggaccccggcggcctcacgcactcgggcctctggaggatctgctgcctggaagggttgaaaagaggcgtctgcgtgaagatcaatcatttcccggaggacacggactacgaccacgacagcgcggagtatctactccgagttgtccgggcctccagcatcttccccatccttagcgccatcctgctgctgctcgggggtgtgtgcgtggcggcctcccgcgtctacaagtccaagaggaacatcattctgggcgcagggatcctgttcgtggcagcaggcctgagcaacatcatcggcgtgatcgtgtacatctccgccaacgcgggcgagccgggcccgaagcgggacgaggagaagaaaaaccactactcgtacggctggtccttctacttcggcgggctgtcgttcatcctggccgaggtgataggcgtgctggccgtcaacatctacatcgagcgcagccgcgaggcgcactgccagtctcgctcggacctgctcaaggccggcgggggcgcgggcggcagtggcgggagcggcccctcggccatcctccgtctgcccagttaccgcttccgctaccgccgccgctcccgctctagctcccgctccagcgagccgtcgccgtcgcgggacgcgtctcccggcggccccgggggcccgggctttgcctccacggacatctccatgtacacgctcagccgcgacccctccaagggcagcgtggccgcggggctggcgggggccggcggcggcggcggcggcgccgtgggggcgttcggcggcgcggccgggggcgccgggggcggcggcggaggcggcggcggggcgggtgccgagcgggaccgcgggggggcgtccggcttcctcacgctgcacaacgccttccccaaggaggcgggcggcggcgtcacggtcacggtcaccgggccgcccgccccgcccgcgcccgcgccacccgcgccctctgcgcccgcccccgggaccctggccaaggaggccgccgcctccaacaccaacacgctcaacaggaaaaccacgcctgtgtaggggcgcggcgggggagccgaggggcgtgtccggggcgcgtgcgcgggcgcgcgtgcatcgaggctgccggggtcgggggcgcccccgctttcccccgtgagcgcgctggagactgctgggcccgccccacgcccaccctccccgcccccctccccctccgaagcagggaccccgagggagggggcaggggagggagggggccgctgtgagggagcgtcgtgttttatttttttgggggatctatggggaggggggagggccatggtgttttttgcagtttcgagatgttttctttttcatgttttgctgtgtgcatggggggcggggcggggggaggggagggagggactcccagcccagcccaactcctggagaggggcccataatacacgaatacatagttacacccacaaactatatatatgccctatataaagagacacagcgaagggatgcagaaaggcagaaagaagggttggacgcgggcattcattcatttttttcattcattattccacaagggcttattaagcacctactgtgtaccaggcactggtacataagaaggcattggagcaggggacacgaacgaggcacagaaagggccttctcattcattcattcattaccggcaatttatttgtgcgccttaaaaagctaggcattgtgctccgtgctcagcgtgcaggaggcaggaaaacagccaggggccccgacgtctcatagagtaaacatcttgtgcatgagacaggcattaatcgatcatgtacatacacaataaattacagttaggctataggagaaacgagatgctatgaaatgctccatcaggggagcctaacccagttgtgaggaagagatttcagtggacagtgaaaggatgagaagaagccagcagggcggagctggggcaggagtgtggcaggcagagcagcacgtgcaaaggccccggggcaggaaggagcttgcagcgagggctgaagggtagtgaggcaggtgagcggggatcaaggtgaggccggagacacagacagggccagattgtgcaggggctcgtaggtcaggagttcagattttattctaggagtggtgagggccgtggaacgggtttaagcaggacgctaacgtgaatggtgtacaaagggaagacaggaactcggaggcaagagtaggaggcagagatgtgctgaaatacagcatcaaacatgggcacgggcccttggagctcacactcttgtgggaggaagcacgtaattacacagatgctgaagcatagtcatggtgtctggtgtgcaggagaaagccgtggggcttagagactcatgtgtctgtcactcgttcattcagccactcacccattgccatttttggccatctgctaaggtaccaggaagtgtgttaggatccagatccccaggggtgaaacagactctagccctgctctcaagcagtttattgtcatcaaacaccgccatccaggcagggcaatcggtgctggaacccggaccaccgtgggtaccgtggcacacggtggacagagtgaccaactgccaggagtgagcagcacttggggtaggcttcctggagaatatgatgcccattctgggtcttgaagaaatgagtgggcatcttctggttgatgaaaggcatgagaaaggcttgtggggccaaagaacaacttgggtgaaaacgggaggaagtgaacgagcatgatgtattggggtcagtgctaacagttctgggatgctgatgtacaaggtggggctgggagatgaggccgggaaagtagccacaagctagagtgtaaaggtaccagggtggccgggcgcggtggctcatgcctgtaatcccagcgctttgggaggctgaggctggagtatcacttgagcccaggagtttgagaccagcctggataacatggcgaaaccctgtctctacaaaacattaaaaaaaattagccgggcgtggtggagcacacctgtggacacagctactcaggaggctgagggaggaggaccatttgactccaagagttcgaggctgcagtgagctaggatcgcggcactacactccagcctgagcaacagactgagatcctgtctcagaaaaaaagagaaaaaggtgcctgagttccaggcagagggactgaggctcttctaaggatggtgagagaggatgacagctgcgcgggggcaagggctgtgcggtgattggaggggatgggtttgaagttcactgagaaggcagaggggacagcgcccagtaggcttcccttccatatttgctcagcaagtgtttcctgaggcctcccccgaagccttgtgctgggcggtgctgggagtggagaggtgattttgatcttgccctgctctcaaggggctcccagtctggcgggaaaacaggcacagacgcagcttgaggaggacgtggcagcggtggtgccatgctgccaggggctctgcgtgcccttctcttgacggaagggtacagatcagagctgggtgttcagaatttctctccgaggcctgtgtggaaggaccaggaagagagagactgaaggtccctaggaagaattctgccaaggcggtttcaggaagagatgctgggaaatgtaggaaaaggaatacaaatcagtgagacggagaagcgctgagtgagagagacggatacgtggagagaagagggatgccggagcgggtgttaaaagagacaaatctggccgggtgctgtggctcctaatcccagcactttgggagactgaggcaggcagattgagctcaggagttccagaccagccaacatattgaaatcttgtctctaccaaaaatacaaaaattagccgggtgtggtggtgcacgcctgtagtcccggctactcaggaggctgaggtgaaaggatctcgcttgggcctgggagggtgaggctgcagtgacccgtgatggcaccactgcgctccagcctgggcgaaagagcgagactctgtctcaaaaaaaaaaaaaaaattgagagacagcaaatatttgctggaagagggagagggaactggttaggggagaatggattctagagtctgaaggccaaacagaacgagagagagagagagagagagagaaagaatgaggttgagggtaggcaggaggaagagcaagatggggagggagggggagagcaggagagaccaaactagtagagtcacagacagagaaaaagtcaaagacaggaaggtgatacagaggagagagaagaggaagaggagagactgacaggtgcacaaatcagagaagtcccagagatagcagaaacacacacagagacagagatagagagggagaggtaagccggagacagactcagagattcgcacaaaaagcaacgtggagactcagaagcaagcgcagcgtcaaggaatgctccatttctggtgtgttgttttcccagtattcaagaaatatttattgagtgccaacctgttctagacccaatctcggccaggggatgtggtggcaaatagacggacaagggcctgctctcctgaaacacactggagagataaacaataaataatatcatttcagtaaccaaaaagtgctttaaaaattaagctgaaggccgggcgcagtggctcatgcctgtaatcccagcactttgggaggccgaggctggtggatcacttgaggtcaggagttcgagaccagcctggtcaacatggtgaaacttcatctctaccaataaataaataaagtagctgggtgtgctggtgtgcctgtagtcccagctacttgggaggctgagaaagaaggatcacttgaacccaggaggcagaggttgcagtgagctgagatcgcgccactgcactccagcctgggcgacagtgagtggtaacagaatgacagagcaaggatgactttagatgaggtccttggagtagaccttgtggcagaggtcacagagatgtggattgtgagtaggaaagagaggtgagaaagtctgggggccaggcattccacccaccagaggcagccccaaagcccagaaaagtagcaggtcttcgaggaggcctgtgcggtgagcagatccaccataggacagaggcacagggtaggggctgatcagttagggccttggatccttgggaagaaatctgaattttattctagatctgatgggaagtgcttggagggttttgagcacaggcatgccatgatcatatttttattttcttatttatatttattttgaaaaagagtcttgctctgtctcaggctggagtccagtgggctgatctcggctcactgccaacctccgcctcccaagttcaagtgattctcctgcctcagcctcctgagtagctgggattacaggcatgtgccaccacgcctggctaatttttttgtatttttagtaaagacgggatttcaccgtgttggccaggccaatctgaaattcctggcttcaaatgatccacctgcctcggcctcccaaaatgctgggattacaggagtgagccactgcgcccggcctcatatttttatttaaacaagaacagcagaattacattgctgtgctgagcatacgtagacttcaggagtcaaaggggaaggaaggaggtagcgggctgttgccttcctctggttgctggaggcctggaccaaggtggagttagtgggatggaggaagtggaagaaggcatgggattttggaggctagagcctgcattggtggtgaactggatgtcatagaggagggaaggaaaaggaaccaggaagagaagaactctctgaattgggcacgcacatctctgatgggcaccgatgaggattgttaccaggaacgaggagactgggatcaggaaagtggctttgggagggaggaaccaaggcttctcttttggatgtgtcaagatagatctgccttcgagaaatccgagttgtggtatcaaatagccagttggatatgtgagactggagtttgggggaaagagaggccgtggctcaaaaacgtaagttttggaaacgtcaacataaagccacaggattgggtgacgtggcctagcaggggggtggggacagagaagcgaccctggccagagccttggggacatctacatctgggggagaaggggatgtagcaaaacgagcttaggagtgatctcgaggtaggctgaaaccaggagggttacagagggcaaatgcacctttgtgtttcaagaaggagaggagacagccagctgtgccaagggctgctgagacttggacaaggatgcagagagcagagtgaccattaggtctgatgacatggacagggttggtgatcttgataagataagatgtcagttcagtgcagtggtggggacagaagccctgctggagtggaggggagagagaatttggggggaagacagaaggaaagggaattcaggcaagtgtgtgtgtgtgtgtgtgtgtgtgtgtgtgtgtaactgacacaaaggccaggtgcgatggctcacgtgtgtaatcccagcactttgggaggccgaagtgggtggatcacttgaggtcaggagttcgagaccagcctggccaatatggtgaaaccccgtctctactaaaaatacagaaattagacaggtgcggtggtgcacacctgtaatcccagctacttgagaggctgaagcaggagaatctcttgggcccaggaggcagaggttgcagtgagccaagatcacaccactgcactctagcctgggtgacagagcaagactctgtctcaaaaaagaaaaaaggtaaaaaaaaaaaaaaatgaccctgaaaggaagtagggagacatgcagatagggagatgggaggcagaaaattgcatcctgcaattagctgtcacagcaggcaggagcaagagagatggggaagcccagggccaggaggggaagatgaattcagggggcagggaagagaggatgctgtcagctaggctctggcagatcccctagccagggatgctctgcccagctcctgtctcttgctgctgtcagcgccgggcacactctgggattccccctgtagaccctgtcaagacctattgaggtgaaggggaagaacacgttttcatcattcattttcagaaataaacattcactcagttcttggaaatactttctggccaggcttgggggctcatgcctgtaatcccagcactctgggaggccaagacaggaggattgcttgaggcttggcgtttgagaccagcctgggcaatatagtaagaccccgtctctacaaaaatgaaaaatgagctgtggcgtggtggctcacgcctgtagtcctagatactcgggaggctgaggcgggaggattgcttgagtccaggagtttaaggttgcagtgagctatgattgcaccattgcacttcaggctgggccacagagcaagaccctgtctcagaaaacagaaagaaagaaagtcaaagaaataaagtcaaagacaagaaggtgatacagagaagacagaaaaggaggaggagagagactgacaggtacacaaatcagagaagtcccagagataacaaaaacacaaccacagagatagggagacgtaagccggagaaagacccagagattcgcatagaaagcaacgtggagactcagaagcaagcacagcatcaaggaatgatcaataaaaagaaaaaaaaatatttcctgaggacttccaagtacaaggccctgcaatctcaggccacttctgtcccatctctgccttcagagggggggacaggtagtccagacaattagaatacagagggggctgtgttctgacggggccacgcgggcattgaggaaacgcagcaggcccctcccctagctggggcggggatgtctgtgtgccatcatctcactccatctggtcattcctttgcccattcatccatccattcattcaagtcaccccatgcacattttccaagactgcctgtgacctggccctgtgccgggtagagctgaggatgccaaggtgaattcctcctgtgcctggccccggccccagtctgctggaagaaccagacacagacaatcacactgcggggaaacacgtgctccatcggaaaagtccagagcagggggtgggcagagaggcccagcgtgcaccagagcctcgctcaggtcagcgccaggcctgcctggagcagccaactgtgggagaagaaggagttggtgaaaggtgggtcccacctgggccgtccacagaagggctgaggggtagggggtgaggggttgaagatcaggccctgccgccatgccacacggctgtcctctgtccctgctcctgggggagctgaaactgcatggaaggtcccccaggggtgccccgtctaataaactcgatgaagagga

SEQ ID NO: 4167 - DNA, 6634 bp, Homo sapiens
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagcactatttctgtgatgcatggaatacatttgacgccttgattgttgtgggtagcattgttgatatagcaatcaccgaggtaaacccagctgaacatacccaatgctctccctctatggggccctcctgttctcacccccctcttgctgtgctaactgcacctcctgttgccgacgggttccagaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagagggacccagcccatcagaggcccaccaaggggctgaggatcctttccgccctgcagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagtt

SEQ ID NO: 4168 - DNA, 6655 bp, Homo sapiens
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatcctaggcaatgcagactatgtcttcactagtatctttacattagaaattatccttaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagggttactttagtgatccctggaatgtttttgacttcctcatcgtaattggcagcataattgacgtcattctcagtgagactaatcactatttctgtgatgcatggaatacatttgacgccttgattgttgtgggtagcattgttgatatagcaatcaccgaggtaaacccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagtt

SEQ ID NO: 4169 - DNA, 6535 bp, Homo sapiens
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatatcctaggcaatgcagactatgtcttcactagtatctttacattagaaattatccttaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagcactatttctgtgatgcatggaatacatttgacgccttgattgttgtgggtagcattgttgatatagcaatcaccgaggtaaacaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagagggacccagcccatcagaggcccaccaaggggctgaggatcctttccgccctgcagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagtt

SEQ ID NO: 4170 - DNA, 6535 bp, Homo sapiens
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagcactatttctgtgatgcatggaatacatttgacgccttgattgttgtgggtagcattgttgatatagcaatcaccgaggtaaacaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagagggacccagcccatcagaggcccaccaaggggctgaggatcctttccgccctgcagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagtt

SEQ ID NO: 4171 - DNA, 6511 bp, Homo sapiens
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagggttactttagtgatccctggaatgtttttgacttcctcatcgtaattggcagcataattgacgtcattctcagtgagactaatccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagtt

SEQ ID NO: 4172 - DNA, 6511 bp, Homo sapiens
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatatcctaggcaatgcagactatgtcttcactagtatctttacattagaaattatccttaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagcactatttctgtgatgcatggaatacatttgacgccttgattgttgtgggtagcattgttgatatagcaatcaccgaggtaaacccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagtt

SEQ ID NO: 4173 - DNA, 7377 bp, Homo sapiens
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactggatgcaggacgctatgggctatgagttaccctgggtgtattttgtcagtctggtcatctttggatcctttttcgttctaaatctggttctcggtgtgttgagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagggttactttagtgatccctggaatgtttttgacttcctcatcgtaattggcagcataattgacgtcattctcagtgagactaatccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagttaaccggaacagcgtcttcattcatttctgttgggaccagacgcggagcctgggtgcgcgagccgccctccgggaggaaggcgcccggctgcgtctgcagaggcggggagaggaggcggcgagggtcccggggcgcgaggaaggcgcctgccctctcccagctcgcaggccccgggcccggccgcgcctccgcggggagagcaccccggcttcccgcgcgccctcaccaaaaggaccctacagcaaacgggtgtctttcgactctgcttgtagaaaccatttgcacatattctgtacgagcctcgctgtctccctagagccagggccctgcggatttggagaagggagcggggcaggacttccaggaggaccccaacccggcccggagagggaggaggaggcctccaggggcgcggagctctggggatgggcgtcgggccggcagtggtgcggctcactccgtccctgcccacctgcgacgggatcccccgaccggcacgggccacgccgagctcccggccagccgccggcccgcaggcagcgcgagggaggagctgcgccgccggctccgcccaaccaggtggtgctgagcttccgctgagcgctcttttgttttgtggtttgacacttttcttgacagcatgttgcagtttcttttcggttttggttttttttaaatgttttattttgctttcccagcgggaggggaggaagaagagtgtttacaaagtcctgtagccccctcacctttctgttttcacttttgccaatgtacatcgggtttggttttcttgtattatttaaacggttgtggtttcctttttccacggaggttcaatagaagccgctgcaggagagttttaccaa

SEQ ID NO: 4174 - DNA, 6571 bp, Homo sapiens
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatcctaggcaatgcagactatgtcttcactagtatctttacattagaaattatccttaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagcactatttctgtgatgcatggaatacatttgacgccttgattgttgtgggtagcattgttgatatagcaatcaccgaggtaaacccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagtt

SEQ ID NO: 4175 - DNA, 7482 bp, Homo sapiens
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactggatgcaggacgctatgggctatgagttaccctgggtgtattttgtcagtctggtcatctttggatcctttttcgttctaaatctggttctcggtgtgttgagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagggttactttagtgatccctggaatgtttttgacttcctcatcgtaattggcagcataattgacgtcattctcagtgagactaatccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacagggaaaggcacgttccgatgtgtgaggatctggagctcaggagggattcaggctcagcagggactcaggctcactgccttctgctcaggaaagcaaacccctctaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagttaaccggaacagcgtcttcattcatttctgttgggaccagacgcggagcctgggtgcgcgagccgccctccgggaggaaggcgcccggctgcgtctgcagaggcggggagaggaggcggcgagggtcccggggcgcgaggaaggcgcctgccctctcccagctcgcaggccccgggcccggccgcgcctccgcggggagagcaccccggcttcccgcgcgccctcaccaaaaggaccctacagcaaacgggtgtctttcgactctgcttgtagaaaccatttgcacatattctgtacgagcctcgctgtctccctagagccagggccctgcggatttggagaagggagcggggcaggacttccaggaggaccccaacccggcccggagagggaggaggaggcctccaggggcgcggagctctggggatgggcgtcgggccggcagtggtgcggctcactccgtccctgcccacctgcgacgggatcccccgaccggcacgggccacgccgagctcccggccagccgccggcccgcaggcagcgcgagggaggagctgcgccgccggctccgcccaaccaggtggtgctgagcttccgctgagcgctcttttgttttgtggtttgacacttttcttgacagcatgttgcagtttcttttcggttttggttttttttaaatgttttattttgctttcccagcgggaggggaggaagaagagtgtttacaaagtcctgtagccccctcacctttctgttttcacttttgccaatgtacatcgggtttggttttcttgtattatttaaacggttgtggtttcctttttccacggaggttcaatagaagccgctgcaggagagttttaccaa

SEQ ID NO: 4176 - DNA, 6568 bp, Homo sapiens
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagcactatttctgtgatgcatggaatacatttgacgccttgattgttgtgggtagcattgttgatatagcaatcaccgaggtaaacccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagagggacccagcccatcagaggcccaccaaggggctgaggatcctttccgccctgcagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagtt

SEQ ID NO: 4177 - DNA, 6562 bp, Homo sapiens
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatatcctaggcaatgcagactatgtcttcactagtatctttacattagaaattatccttaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagggttactttagtgatccctggaatgtttttgacttcctcatcgtaattggcagcataattgacgtcattctcagtgagactaatcactatttctgtgatgcatggaatacatttgacgccttgattgttgtgggtagcattgttgatatagcaatcaccgaggtaaacaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagtt

SEQ ID NO: 4178 - DNA, 7590 bp, Homo sapiens
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactggatgcaggacgctatgggctatgagttaccctgggtgtattttgtcagtctggtcatctttggatcctttttcgttctaaatctggttctcggtgtgttgagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagcactatttctgtgatgcatggaatacatttgacgccttgattgttgtgggtagcattgttgatatagcaatcaccgaggtaaacccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggatgcactgctgtgacatgctggatggtgggaccttccctcccgccctgggcccccgcagggctcctccctgtctgcatcagcagctccagggttccctggcggggctgagagaggacacaccctgcatcgtgcctggccacgcttcactgtgctgctcttccagagtaggagagtggctcccagcaggctgcacagccccccagcatgccaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagttaaccggaacagcgtcttcattcatttctgttgggaccagacgcggagcctgggtgcgcgagccgccctccgggaggaaggcgcccggctgcgtctgcagaggcggggagaggaggcggcgagggtcccggggcgcgaggaaggcgcctgccctctcccagctcgcaggccccgggcccggccgcgcctccgcggggagagcaccccggcttcccgcgcgccctcaccaaaaggaccctacagcaaacgggtgtctttcgactctgcttgtagaaaccatttgcacatattctgtacgagcctcgctgtctccctagagccagggccctgcggatttggagaagggagcggggcaggacttccaggaggaccccaacccggcccggagagggaggaggaggcctccaggggcgcggagctctggggatgggcgtcgggccggcagtggtgcggctcactccgtccctgcccacctgcgacgggatcccccgaccggcacgggccacgccgagctcccggccagccgccggcccgcaggcagcgcgagggaggagctgcgccgccggctccgcccaaccaggtggtgctgagcttccgctgagcgctcttttgttttgtggtttgacacttttcttgacagcatgttgcagtttcttttcggttttggttttttttaaatgttttattttgctttcccagcgggaggggaggaagaagagtgtttacaaagtcctgtagccccctcacctttctgttttcacttttgccaatgtacatcgggtttggttttcttgtattatttaaacggttgtggtttcctttttccacggaggttcaatagaagccgctgcaggagagttttaccaa

SEQ ID NO: 4179 - DNA, 6568 bp, Homo sapiens
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatatcctaggcaatgcagactatgtcttcactagtatctttacattagaaattatccttaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagcactatttctgtgatgcatggaatacatttgacgccttgattgttgtgggtagcattgttgatatagcaatcaccgaggtaaacccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagagggacccagcccatcagaggcccaccaaggggctgaggatcctttccgccctgcagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagtt

SEQ ID NO: 4180 - DNA, 6595 bp, Homo sapiens
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagggttactttagtgatccctggaatgtttttgacttcctcatcgtaattggcagcataattgacgtcattctcagtgagactaatcactatttctgtgatgcatggaatacatttgacgccttgattgttgtgggtagcattgttgatatagcaatcaccgaggtaaacccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagtt

SEQ ID NO: 4181 - DNA, 6511 bp, Homo sapiens
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactggatgcaggacgctatgggctatgagttaccctgggtgtattttgtcagtctggtcatctttggatcctttttcgttctaaatctggttctcggtgtgttgagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatatcctaggcaatgcagactatgtcttcactagtatctttacattagaaattatccttaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagcactatttctgtgatgcatggaatacatttgacgccttgattgttgtgggtagcattgttgatatagcaatcaccgaggtaaacccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagtt

SEQ ID NO: 4182 - DNA, 6511 bp, Homo sapiens
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatatcctaggcaatgcagactatgtcttcactagtatctttacattagaaattatccttaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagggttactttagtgatccctggaatgtttttgacttcctcatcgtaattggcagcataattgacgtcattctcagtgagactaatccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagtt

SEQ ID NO: 4183 - DNA, 6529 bp, Homo sapiens
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagcactatttctgtgatgcatggaatacatttgacgccttgattgttgtgggtagcattgttgatatagcaatcaccgagaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagagggacccagcccatcagaggcccaccaaggggctgaggatcctttccgccctgcagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagtt

SEQ ID NO: 4184 - DNA, 8425 bp, Homo sapiens
ggaaggggcccggatgtactgaggatgcgttacagtttcactcgaggaggcagtagtggaaaggagcagtttttggggtttgatgccataatgggaatcaggtaatcgtcggcggggaagaagaaacgctgcagaccacggcttcctcgaatcttgcgcgaaagccgccggcctcggaggagggattaatccagacccgccggggggtgttttcacatttcttcctcttcgtggctgctcctcctattaaaaccatttttggtccatggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagcactatttctgtgatgcatggaatacatttgacgccttgattgttgtgggtagcattgttgatatagcaatcaccgaggtaaacccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagttaaccggaacagcgtcttcattcatttctgttgggaccagacgcggagcctgggtgcgcgagccgccctccgggaggaaggcgcccggctgcgtctgcagaggcggggagaggaggcggcgagggtcccggggcgcgaggaaggcgcctgccctctcccagctcgcaggccccgggcccggccgcgcctccgcggggagagcaccccggcttcccgcgcgccctcaccaaaaggaccctacagcaaacgggtgtctttcgactctgcttgtagaaaccatttgcacatattctgtacgagcctcgctgtctccctagagccagggccctgcggatttggagaagggagcggggcaggacttccaggaggaccccaacccggcccggagagggaggaggaggcctccaggggcgcggagctctggggatgggcgtcgggccggcagtggtgcggctcactccgtccctgcccacctgcgacgggatcccccgaccggcacgggccacgccgagctcccggccagccgccggcccgcaggcagcgcgagggaggagctgcgccgccggctccgcccaaccaggtggtgctgagcttccgctgagcgctcttttgttttgtggtttgacacttttcttgacagcatgttgcagtttcttttcggttttggttttttttaaatgttttattttgctttcccagcgggaggggaggaagaagagtgtttacaaagtcctgtagccccctcacctttctgttttcacttttgccaatgtacatcgggtttggttttcttgtattatttaaacggttgtggtttcctttttccacggaggttcaatagaagccgctgcaggagagttttaccaaccattgtgtatgcccaataatttgttatcatttccttaggtagtaacctatttttgttctggtttggttcggttatctaatggaaaggtaactggcaatgcacttgatgtggtcttgcacatgtgggtgatagagttgggttcctttttatgctgggtgtacaggtgggtttgggagagaggagcatgcgcgagagagtctccgagtgtgtgcgacgcgtgtgtgtgtggtgggttgtctgtgtgcatatgtcctgcccgtgtatatgcacccacaccatgtgcccgtgcacaccagtgactacgcagtcccccctttctggtttagctgtgggaagatctgaatctggggccgtttgaaagcaaaaacaaaccactgtctctgcttctgaaacgggaatcagtaactctttgcattttctgtcccacaagatatgcaaaaacaatgcaataatattcatttaaaaatacaattgtgagttgtgttggcattaaaactgtattttaaaaaaagacagaaatttaagggaaaaacacaagaaggcattttgcttcaatatattccgtgtaatgttttattgcattgataatgtttctgttgaagaaaccgttatacttgaattcaggtcagtttcagtatttttcaaatatttttttaaaactgaattgcaattgtgccaagcgaatataatgaattgaattaagttggttttcggattcacttcttgtatattttgctgcatgtaaagtaaatcattttgtatttggagtgtgacaagcttta

SEQ ID NO: 4185 - DNA, 6568 bp, Homo sapiens
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagggttactttagtgatccctggaatgtttttgacttcctcatcgtaattggcagcataattgacgtcattctcagtgagactaatccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagagggacccagcccatcagaggcccaccaaggggctgaggatcctttccgccctgcagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagtt

SEQ ID NO: 4186 - DNA, 7590 bp, Homo sapiens
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactggatgcaggacgctatgggctatgagttaccctgggtgtattttgtcagtctggtcatctttggatcctttttcgttctaaatctggttctcggtgtgttgagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagggttactttagtgatccctggaatgtttttgacttcctcatcgtaattggcagcataattgacgtcattctcagtgagactaatccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggatgcactgctgtgacatgctggatggtgggaccttccctcccgccctgggcccccgcagggctcctccctgtctgcatcagcagctccagggttccctggcggggctgagagaggacacaccctgcatcgtgcctggccacgcttcactgtgctgctcttccagagtaggagagtggctcccagcaggctgcacagccccccagcatgccaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagttaaccggaacagcgtcttcattcatttctgttgggaccagacgcggagcctgggtgcgcgagccgccctccgggaggaaggcgcccggctgcgtctgcagaggcggggagaggaggcggcgagggtcccggggcgcgaggaaggcgcctgccctctcccagctcgcaggccccgggcccggccgcgcctccgcggggagagcaccccggcttcccgcgcgccctcaccaaaaggaccctacagcaaacgggtgtctttcgactctgcttgtagaaaccatttgcacatattctgtacgagcctcgctgtctccctagagccagggccctgcggatttggagaagggagcggggcaggacttccaggaggaccccaacccggcccggagagggaggaggaggcctccaggggcgcggagctctggggatgggcgtcgggccggcagtggtgcggctcactccgtccctgcccacctgcgacgggatcccccgaccggcacgggccacgccgagctcccggccagccgccggcccgcaggcagcgcgagggaggagctgcgccgccggctccgcccaaccaggtggtgctgagcttccgctgagcgctcttttgttttgtggtttgacacttttcttgacagcatgttgcagtttcttttcggttttggttttttttaaatgttttattttgctttcccagcgggaggggaggaagaagagtgtttacaaagtcctgtagccccctcacctttctgttttcacttttgccaatgtacatcgggtttggttttcttgtattatttaaacggttgtggtttcctttttccacggaggttcaatagaagccgctgcaggagagttttaccaa

SEQ ID NO: 4187 - DNA, 6811 bp, Homo sapiens
ctcctattaaaaccatttttggtccatggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatatcctaggcaatgcagactatgtcttcactagtatctttacattagaaattatccttaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaaggtaggcctctgagaaagacctttgattcccaggcatcaggggtggacagaacggggaggtggggtgcaggtattgaaggcagaatgaggggaagagggaaaaaggcatcggtgaaggaccatccctgctccgatggtcagtgccccaactcctacacctgcccagagctgaaccaggccaactccaggaaacactctcagctctcagtgttgaccctggctggcatgcacaagctgcagattcctcgctgagctgaacctctgagcctctcctaggagaggcaggtgatggtctttctcctatgtcccatcctctagtacataacctgttaatagaagaaactatgctcatagactggcagaccaaacctctccaggcccagccccccagatccactcaggcctctgttccaccctcctcccatttcatcagccacacagaccaacctcatataaaacattcagccagggctggatttgctcagggctcaggactgagggctccagcccatgggcactcctgttccctgcctaagaggctatggcattgctccttacatgctctggggcaggaagaacaattaccagcaaatttctctgctttgttccttgtgtaagggcaagaagattaggcctgctgctgaatgaggcagggtcagaattcctgttctttggatcatctgtgcccttcctagccagtcacccccattgtcctcagtggtggaggagcagacactggtatgagccacaccttccaccctgggcctctgtagatgggtcagaatcacgggtatccactggccgggattcaccaccaggacagctgcttctgagggaggctataagagcaactgagcagcccccaggctaccataacaccttttggagaaggatgagaaggaacgagttctaggagcatcatgcagttacagacttgagacaatctctccagcttactgagccttcccctccctcctttggtagttttcccagaggcaacacagatcaacaggaggccaagagcaagaatccctggccatatcttctattttcattcaagtttttactggtctcaagattaattgggggtgggggagggtccagctcggcctttgaatccatgttcattgaggagatatccacagccttctttgaatgaatattcactcacactttggattccatatcatgtgctacatgtatatcatcgcacgtcattctcaaaacgtccctttaaagtaggtattagcatccctctgtggagaagggggaagggaggctcaaacaattaagtgcccaggattaattgatccactgctaagaactggcagaacggagactggaatccggcacctctgacttcactgtattttccaccacactgaggttaactatcattttcccatgtcaagtgttctgcgggtattttttagcaagagggaaacaaccttggagggacttaaaagataagacaatattcctacaatgcagattcttctgtcactcaaagaatgcctggggatcccagctgattttcatagaggaagtctcctaagggacatcctttggtgatagaacggtggtttcctgccttctccagagaagcaagtacactctttttcaccttcctgtacaagtcccatttaggaggacagatcttgtcctgacctagagaggacccctgcgttgccctgacaccttccttagggtacacggtgtctgtgcccacacatggtcctattccaagccctgcagcccaggagctctgacagttcgccacccacagcagcatgaccagctgaggccaggagtgcagtcactgcctagccgagcctcagtctcggatgactcctctcagtggggaaactggcatcattttcatacagtgtcacgagacatatggtttaaatatttcaaagccttgagtcattccacagttgactcagatgtgtttctgacgatgtctgaggcagtctggagagcctgcagtggactttctgaatcatgcctcctgagcacgggagacatacagacaaccttccctgggaagtgcatgaaattgacacctgcaggagcctccgtcctccgtctaaaagacactccacctaaatcctgccaatcaaggaacaagccagtttcctaggaagtaaccattgcgagtggtctaaactgtaaagtgcctcctaatttcctctgtccctggttttctattgtgagaagatggggcaagataacagagacttttacccaagaaggaagacagccatcctgggcccatttgcatttcacattccagggtacatctatggtgtaaagagaaaggaaaatggatctttccctgtgaatttccctaaaggggctctggcaagagggggataaaggtcaccacccagttaggagcatcatggagcacagctgagtccctggattcttactgagctatgttcttcattcacaaatagactccaggtaaagcagctccaaaattttcaggcagaaaaccaaactggaaaaacttgaagctctggaagaatatccagctggatctggcccaagaaccagtggcttctaaccatgacctgaatccatgacaactttcatttcccaccattaagtaggactctgtgctgcactttttatttcactggcatggttgtttgtgtatgacccagatgagcatcagcatttgctgtgaaaggatggctaggaaccaaggatgttgaagacagtctgaagttgtcactgcttatgtttcgtctctgcaactggctggttggttggtccatcagccggtcaacttgtattcttgcttcattctttcattgttttcatggtcatggatgttcccaatttcttcatttctgtgtgttctcctcaccactccatggaaaataaatttactcaagtaagtccctgccttaaatctaaccatcccactccttaaattcatactctgttc

SEQ ID NO: 4188 - DNA, 7721 bp, Homo sapiens
agaataagggcagggaccgcggctcctacctcttggtgatccccttccccattccgcccccgcctcaacgcccagcacagtgccctgcacacagtagtcgctcaataaatgttcgtggatgatgatgatgatgatgatgaaaaaaatgcagcatcaacggcagcagcaagcggaccacgcgaacgaggcaaactatgcaagaggcaccagacttcctctttctggtgaaggaccaacttctcagccgaatagctccaagcaaactgtcctgtcttggcaagctgcaatcgatgctgctagacaggccaaggctgcccaaactatgagcacctctgcacccccacctgtaggatctctctcccaaagaaaacgtcagcaatacgccaagagcaaaaaacagggtaactcgtccaacagccgacctgcccgcgcccttttctgtttatcactcaataaccccatccgaagagcctgcattagtatagtggaatggaaaccatttgacatatttatattattggctatttttgccaattgtgtggccttagctatttacatcccattccctgaagatgattctaattcaacaaatcataacttggaaaaagtagaatatgccttcctgattatttttacagtcgagacatttttgaagattatagcgtatggattattgctacatcctaatgcttatgttaggaatggatggaatttactggattttgttatagtaatagtaggattgtttagtgtaattttggaacaattaaccaaagaaacagaaggcgggaaccactcaagcggcaaatctggaggctttgatgtcaaagccctccgtgcctttcgagtgttgcgaccacttcgactagtgtcaggagtgcccagtttacaagttgtcctgaactccattataaaagccatggttcccctccttcacatagcccttttggtattatttgtaatcataatctatgctattataggattggaactttttattggaaaaatgcacaaaacatgtttttttgctgactcagatatcgtagctgaagaggacccagctccatgtgcgttctcagggaatggacgccagtgtactgccaatggcacggaatgtaggagtggctgggttggcccgaacggaggcatcaccaactttgataactttgcctttgccatgcttactgtgtttcagtgcatcaccatggagggctggacagatgtgctctactgggtaaatgatgcgataggatgggaatggccatgggtgtattttgttagtctgatcatccttggctcatttttcgtccttaacctggttcttggtgtccttagtggagaattctcaaaggaaagagagaaggcaaaagcacggggagatttccagaagctccgggagaagcagcagctggaggaggatctaaagggctacttggattggatcacccaagctgaggacatcgatccggagaatgaggaagaaggaggagaggaaggcaaacgaaatactagcatgcccaccagcgagactgagtctgtgaacacagagaacgtcagcggtgaaggcgagaaccgaggctgctgtggaagtctctggtgctggtggagacggagaggcgcggccaaggcggggccctctgggtgtcggcggtggggtcaagccatctcaaaatccaaactcagccgacgctggcgtcgctggaaccgattcaatcgcagaagatgtagggccgccgtgaagtctgtcacgttttactggctggttatcgtcctggtgtttctgaacaccttaaccatttcctctgagcactacaatcagccagattggttgacacagattcaagatattgccaacaaagtcctcttggctctgttcacctgcgagatgctggtaaaaatgtacagcttgggcctccaagcatatttcgtctctcttttcaaccggtttgattgcttcgtggtgtgtggtggaatcactgagacgatcttggtggaactggaaatcatgtctcccctggggatctctgtgtttcggtgtgtgcgcctcttaagaatcttcaaagtgaccaggcactggacttccctgagcaacttagtggcatccttattaaactccatgaagtccatcgcttcgctgttgcttctgctttttctcttcattatcatcttttccttgcttgggatgcagctgtttggcggcaagtttaattttgatgaaacgcaaaccaagcggagcacctttgacaatttccctcaagcacttctcacagtgttccagatcctgacaggcgaagactggaatgctgtgatgtacgatggcatcatggcttacgggggcccatcctcttcaggaatgatcgtctgcatctacttcatcatcctcttcatttgtggtaactatattctactgaatgtcttcttggccatcgctgtagacaatttggctgatgctgaaagtctgaacactgctcagaaagaagaagcggaagaaaaggagaggaaaaagattgccagaaaagagagcctagaaaataaaaagaacaacaaaccagaagtcaaccagatagccaacagtgacaacaaggttacaattgatgactatagagaagaggatgaagacaaggacccctatccgccttgcgatgtgccagtaggggaagaggaagaggaagaggaggaggatgaacctgaggttcctgccggaccccgtcctcgaaggatctcggagttgaacatgaaggaaaaaattgcccccatccctgaagggagcgctttcttcattcttagcaagaccaacccgatccgcgtaggctgccacaagctcatcaaccaccacatcttcaccaacctcatccttgtcttcatcatgctgagcagcgctgccctggccgcagaggaccccatccgcagccactccttccggaacacgatactgggttactttgactatgccttcacagccatctttactgttgagatcctgttgaagatgacaacttttggagctttcctccacaaaggggccttctgcaggaactacttcaatttgctggatatgctggtggttggggtgtctctggtgtcatttgggattcaatccagtgccatctccgttgtgaagattctgagggtcttaagggtcctgcgtcccctcagggccatcaacagagcaaaaggacttaagcacgtggtccagtgcgtcttcgtggccatccggaccatcggcaacatcatgatcgtcaccaccctcctgcagttcatgtttgcctgtatcggggtccagttgttcaaggggaagttctatcgctgtacggatgaagccaaaagtaaccctgaagaatgcaggggacttttcatcctctacaaggatggggatgttgacagtcctgtggtccgtgaacggatctggcaaaacagtgatttcaacttcgacaacgtcctctctgctatgatggcgctcttcacagtctccacgtttgagggctggcctgcgttgctgtataaagccatcgactcgaatggagagaacatcggcccaatctacaaccaccgcgtggagatctccatcttcttcatcatctacatcatcattgtagctttcttcatgatgaacatctttgtgggctttgtcatcgttacatttcaggaacaaggagaaaaagagtataagaactgtgagctggacaaaaatcagcgtcagtgtgttgaatacgccttgaaagcacgtcccttgcggagatacatccccaaaaacccctaccagtacaagttctggtacgtggtgaactcttcgcctttcgaatacatgatgtttgtcctcatcatgctcaacacactctgcttggccatgcagcactacgagcagtccaagatgttcaatgatgccatggacattctgaacatggtcttcaccggggtgttcaccgtcgagatggttttgaaagtcatcgcatttaagcctaaggggtattttagtgacgcctggaacacgtttgactccctcatcgtaatcggcagcattatagacgtggccctcagcgaagcagacccaactgaaagtgaaaatgtccctgtcccaactgctacacctgggaactctgaagagagcaatagaatctccatcacctttttccgtcttttccgagtgatgcgattggtgaagcttctcagcaggggggaaggcatccggacattgctgtggacttttattaagtcctttcaggcgctcccgtatgtggccctcctcatagccatgctgttcttcatctatgcggtcattggcatgcagatgtttgggaaagttgccatgagagataacaaccagatcaataggaacaataacttccagacgtttccccaggcggtgctgctgctcttcaggtgtgcaacaggtgaggcctggcaggagatcatgctggcctgtctcccagggaagctctgtgaccctgagtcagattacaaccccggggaggagtatacatgtgggagcaactttgccattgtctatttcatcagtttttacatgctctgtgcatttctgatcatcaatctgtttgtggctgtcatcatggataatttcgactatctgacccgggactggtctattttggggcctcaccatttagatgaattcaaaagaatatggtcagaatatgaccctgaggcaaagggaaggataaaacaccttgatgtggtcactctgcttcgacgcatccagcctcccctggggtttgggaagttatgtccacacagggtagcgtgcaagagattagttgccatgaacatgcctctcaacagtgacgggacagtcatgtttaatgcaaccctgtttgctttggttcgaacggctcttaagatcaagaccgaagggaacctggagcaagctaatgaagaacttcgggctgtgataaagaaaatttggaagaaaaccagcatgaaattacttgaccaagttgtccctccagctggtgatgatgaggtaaccgtggggaagttctatgccactttcctgatacaggactactttaggaaattcaagaaacggaaagaacaaggactggtgggaaagtaccctgcgaagaacaccacaattgccctacaggcgggattaaggacactgcatgacattgggccagaaatccggcgtgctatatcgtgtgatttgcaagatgacgagcctgaggaaacaaaacgagaagaagaagatgatgtgttcaaaagaaatggtgccctgcttggaaaccatgtcaatcatgttaatagtgataggagagattcccttcagcagaccaataccacccaccgtcccctgcatgtccaaaggccttcaattccacctgcaagtgatactgagaaaccgctgtttcctccagcaggaaattcggtgtgtcataaccatcataaccataattccataggaaagcaagttcccacctcaacaaatgccaatctcaataatgccaatatgtccaaagctgcccatggaaagcggcccagcattgggaaccttgagcatgtgtctgaaaatgggcatcattcttcccacaagcatgaccgggagcctcagagaaggtccagtgtgaaaagaacccgctattatgaaacttacattaggtccgactcaggagatgaacagctcccaactatttgccgggaagacccagagatacatggctatttcagggacccccactgcttgggggagcaggagtatttcagtagtgaggaatgctacgaggatgacagctcgcccacctggagcaggcaaaactatggctactacagcagatacccaggcagaaacatcgactctgagaggccccgaggctaccatcatccccaaggattcttggaggacgatgactcgcccgtttgctatgattcacggagatctccaaggagacgcctactacctcccaccccagcatcccaccggagatcctccttcaactttgagtgcctgcgccggcagagcagccaggaagaggtcccgtcgtctcccatcttcccccatcgcacggccctgcctctgcatctaatgcagcaacagatcatggcagttgccggcctagattcaagtaaagcccagaagtactcaccgagtcactcgacccggtcgtgggccacccctccagcaacccctccctaccgggactggacaccgtgctacacccccctgatccaagtggagcagtcagaggccctggaccaggtgaacggcagcctgccgtccctgcaccgcagctcctggtacacagacgagcccgacatctcctaccggactttcacaccagccagcctgactgtccccagcagcttccggaacaaaaacagcgacaagcagaggagtgcggacagcttggtggaggcagtcctgatatccgaaggcttgggacgctatgcaagggacccaaaatttgtgtcagcaacaaaacacgaaatcgctgatgcctgtgacctcaccatcgacgagatggagagtgcagccagcaccctgcttaatgggaacgtgcgtccccgagccaacggggatgtgggccccctctcacaccggcaggactatgagctacaggactttggtcctggctacagcgacgaagagccagaccctgggagggatgaggaggacctggcggatgaaatgatatgcatcaccaccttgtagcccccagcgaggggcagactggctctggcctcaggtggggcgcaggagagccaggggaaaagtgcctcatagttaggaaagtttaggcactagttgggagtaatattcaattaattagacttttgtataagagatgtcatgcctcaagaaagccataaacctggtaggaacaggtcccaagcggttgagcctggcagagtaccatgcgctcggccccagctgcaggaaacagcaggccccgccctctcacagaggatgggtgaggaggccagacctgccctgccccattgtccagatgggcactgctgtggagtctgcttctcccatgtaccagggcaccaggcccacccaactgaaggcatggcggcggggtgcaggggaaagttaaaggtgatgacgatcatcacacctgtgtcgttacctcagccatcggtctagcatatcagtcactgggcccaacatatccatttttaaaccctttcccccaaatacactgcgtcctggttcctgtttagctgttctgaaatacggtgtgtaagtaagtcagaacccagctaccagtgattattgcgagggcaatgggacctcataaataaggttttctgtgatgtgacgccagtttacataagagaatatcactccgatggtcggtttctgactgtcacgctaagggcaactgtaaactggaataataatgcactcgcaaccaggtaaacttagatacactagtttgtttaaaattatagatttactgtacatgacttgtaatatactataatttgtatttgtaaagagatggtctatattttgtaattactgtattgtatttgaactgcagcaatatccatgggtcctaataattgtagttccccactaaaatctagaaattattagtatttttactcgggctatccagaagtagaagaaatagagccaattctcatttattcagcgaaaatcctctggggttaaaattttaagtttgaaagaacttgacactacagaaatttttctaaaatattttgagtcactataaacctatcatctttccacaaga

SEQ ID NO: 4189 - DNA, 7636 bp, Homo sapiens
gggcgagcgcctccgtccccggatgtgagctccggctgcccgcggtcccgagccagcggcggcgcgggcggcggcggcgggcaccgggcaccgcggcgggcgggcagacgggcgggcatggggggagcgccgagcggccccggcggccgggccggcatcaccgcggcgtctctccgctagaggaggggacaagccagttctcctttgcagcaaaaaattacatgtatatattattaagataatatatacattggattttatttttttaaaaagtttattttgctccatttttgaaaaagagagagcttgggtggcgagcggttttttttttaaatcaattatccttattttctgttatttgtccccgtccctccccacccccctgctgaagcgagaataagggcagggaccgcggctcctacctcttggtgatccccttccccattccgcccccgcctcaacgcccagcacagtgccctgcacacagtagtcgctcaataaatgttcgtggatgatgatgatgatgatgatgaaaaaaatgcagcatcaacggcagcagcaagcggaccacgcgaacgaggcaaactatgcaagaggcaccagacttcctctttctggtgaaggaccaacttctcagccgaatagctccaagcaaactgtcctgtcttggcaagctgcaatcgatgctgctagacaggccaaggctgcccaaactatgagcacctctgcacccccacctgtaggatctctctcccaaagaaaacgtcagcaatacgccaagagcaaaaaacagggtaactcgtccaacagccgacctgcccgcgcccttttctgtttatcactcaataaccccatccgaagagcctgcattagtatagtggaatggaaaccatttgacatatttatattattggctatttttgccaattgtgtggccttagctatttacatcccattccctgaagatgattctaattcaacaaatcataacttggaaaaagtagaatatgccttcctgattatttttacagtcgagacatttttgaagattatagcgtatggattattgctacatcctaatgcttatgttaggaatggatggaatttactggattttgttatagtaatagtaggattgtttagtgtaattttggaacaattaaccaaagaaacagaaggcgggaaccactcaagcggcaaatctggaggctttgatgtcaaagccctccgtgcctttcgagtgttgcgaccacttcgactagtgtcaggagtgcccagtttacaagttgtcctgaactccattataaaagccatggttcccctccttcacatagcccttttggtattatttgtaatcataatctatgctattataggattggaactttttattggaaaaatgcacaaaacatgtttttttgctgactcagatatcgtagctgaagaggacccagctccatgtgcgttctcagggaatggacgccagtgtactgccaatggcacggaatgtaggagtggctgggttggcccgaacggaggcatcaccaactttgataactttgcctttgccatgcttactgtgtttcagtgcatcaccatggagggctggacagatgtgctctactggatgaatgatgctatgggatttgaattgccctgggtgtattttgtcagtctcgtcatctttgggtcatttttcgtactaaatcttgtacttggtgtattgagcggagaattctcaaaggaaagagagaaggcaaaagcacggggagatttccagaagctccgggagaagcagcagctggaggaggatctaaagggctacttggattggatcacccaagctgaggacatcgatccggagaatgaggaagaaggaggagaggaaggcaaacgaaatactagcatgcccaccagcgagactgagtctgtgaacacagagaacgtcagcggtgaaggcgagaaccgaggctgctgtggaagtctctgtcaagccatctcaaaatccaaactcagccgacgctggcgtcgctggaaccgattcaatcgcagaagatgtagggccgccgtgaagtctgtcacgttttactggctggttatcgtcctggtgtttctgaacaccttaaccatttcctctgagcactacaatcagccagattggttgacacagattcaagatattgccaacaaagtcctcttggctctgttcacctgcgagatgctggtaaaaatgtacagcttgggcctccaagcatatttcgtctctcttttcaaccggtttgattgcttcgtggtgtgtggtggaatcactgagacgatcttggtggaactggaaatcatgtctcccctggggatctctgtgtttcggtgtgtgcgcctcttaagaatcttcaaagtgaccaggcactggacttccctgagcaacttagtggcatccttattaaactccatgaagtccatcgcttcgctgttgcttctgctttttctcttcattatcatcttttccttgcttgggatgcagctgtttggcggcaagtttaattttgatgaaacgcaaaccaagcggagcacctttgacaatttccctcaagcacttctcacagtgttccagatcctgacaggcgaagactggaatgctgtgatgtacgatggcatcatggcttacgggggcccatcctcttcaggaatgatcgtctgcatctacttcatcatcctcttcatttgtggtaactatattctactgaatgtcttcttggccatcgctgtagacaatttggctgatgctgaaagtctgaacactgctcagaaagaagaagcggaagaaaaggagaggaaaaagattgccagaaaagagagcctagaaaataaaaagaacaacaaaccagaagtcaaccagatagccaacagtgacaacaaggttacaattgatgactatagagaagaggatgaagacaaggacccctatccgccttgcgatgtgccagtaggggaagaggaagaggaagaggaggaggatgaacctgaggttcctgccggaccccgtcctcgaaggatctcggagttgaacatgaaggaaaaaattgcccccatccctgaagggagcgctttcttcattcttagcaagaccaacccgatccgcgtaggctgccacaagctcatcaaccaccacatcttcaccaacctcatccttgtcttcatcatgctgagcagcgctgccctggccgcagaggaccccatccgcagccactccttccggaacacgatactgggttactttgactatgccttcacagccatctttactgttgagatcctgttgaagatgacaacttttggagctttcctccacaaaggggccttctgcaggaactacttcaatttgctggatatgctggtggttggggtgtctctggtgtcatttgggattcaatccagtgccatctccgttgtgaagattctgagggtcttaagggtcctgcgtcccctcagggccatcaacagagcaaaaggacttaagcacgtggtccagtgcgtcttcgtggccatccggaccatcggcaacatcatgatcgtcaccaccctcctgcagttcatgtttgcctgtatcggggtccagttgttcaaggggaagttctatcgctgtacggatgaagccaaaagtaaccctgaagaatgcaggggacttttcatcctctacaaggatggggatgttgacagtcctgtggtccgtgaacggatctggcaaaacagtgatttcaacttcgacaacgtcctctctgctatgatggcgctcttcacagtctccacgtttgagggctggcctgcgttgctgtataaagccatcgactcgaatggagagaacatcggcccaatctacaaccaccgcgtggagatctccatcttcttcatcatctacatcatcattgtagctttcttcatgatgaacatctttgtgggctttgtcatcgttacatttcaggaacaaggagaaaaagagtataagaactgtgagctggacaaaaatcagcgtcagtgtgttgaatacgccttgaaagcacgtcccttgcggagatacatccccaaaaacccctaccagtacaagttctggtacgtggtgaactcttcgcctttcgaatacatgatgtttgtcctcatcatgctcaacacactctgcttggccatgcagcactacgagcagtccaagatgttcaatgatgccatggacattctgaacatggtcttcaccggggtgttcaccgtcgagatggttttgaaagtcatcgcatttaagcctaaggggtattttagtgacgcctggaacacgtttgactccctcatcgtaatcggcagcattatagacgtggccctcagcgaagcagacccaactgaaagtgaaaatgtccctgtcccaactgctacacctgggaactctgaagagagcaatagaatctccatcacctttttccgtcttttccgagtgatgcgattggtgaagcttctcagcaggggggaaggcatccggacattgctgtggacttttattaagtcctttcaggcgctcccgtatgtggccctcctcatagccatgctgttcttcatctatgcggtcattggcatgcagatgtttgggaaagttgccatgagagataacaaccagatcaataggaacaataacttccagacgtttccccaggcggtgctgctgctcttcaggtgtgcaacaggtgaggcctggcaggagatcatgctggcctgtctcccagggaagctctgtgaccctgagtcagattacaaccccggggaggagtatacatgtgggagcaactttgccattgtctatttcatcagtttttacatgctctgtgcatttctgatcatcaatctgtttgtggctgtcatcatggataatttcgactatctgacccgggactggtctattttggggcctcaccatttagatgaattcaaaagaatatggtcagaatatgaccctgaggcaaagggaaggataaaacaccttgatgtggtcactctgcttcgacgcatccagcctcccctggggtttgggaagttatgtccacacagggtagcgtgcaagagattagttgccatgaacatgcctctcaacagtgacgggacagtcatgtttaatgcaaccctgtttgctttggttcgaacggctcttaagatcaagaccgaagggaacctggagcaagctaatgaagaacttcgggctgtgataaagaaaatttggaagaaaaccagcatgaaattacttgaccaagttgtccctccagctggtgatgatgaggtaaccgtggggaagttctatgccactttcctgatacaggactactttaggaaattcaagaaacggaaagaacaaggactggtgggaaagtaccctgcgaagaacaccacaattgccctacaggcgggattaaggacactgcatgacattgggccagaaatccggcgtgctatatcgtgtgatttgcaagatgacgagcctgaggaaacaaaacgagaagaagaagatgatgtgttcaaaagaaatggtgccctgcttggaaaccatgtcaatcatgttaatagtgataggagagattcccttcagcagaccaataccacccaccgtcccctgcatgtccaaaggccttcaattccacctgcaagtgatactgagaaaccgctgtttcctccagcaggaaattcggtgtgtcataaccatcataaccataattccataggaaagcaagttcccacctcaacaaatgccaatctcaataatgccaatatgtccaaagctgcccatggaaagcggcccagcattgggaaccttgagcatgtgtctgaaaatgggcatcattcttcccacaagcatgaccgggagcctcagagaaggtccagtgtgaaaagaacccgctattatgaaacttacattaggtccgactcaggagatgaacagctcccaactatttgccgggaagacccagagatacatggctatttcagggacccccactgcttgggggagcaggagtatttcagtagtgaggaatgctacgaggatgacagctcgcccacctggagcaggcaaaactatggctactacagcagatacccaggcagaaacatcgactctgagaggccccgaggctaccatcatccccaaggattcttggaggacgatgactcgcccgtttgctatgattcacggagatctccaaggagacgcctactacctcccaccccagcatcccaccggagatcctccttcaactttgagtgcctgcgccggcagagcagccaggaagaggtcccgtcgtctcccatcttcccccatcgcacggccctgcctctgcatctaatgcagcaacagatcatggcagttgccggcctagattcaagtaaagcccagaagtactcaccgagtcactcgacccggtcgtgggccacccctccagcaacccctccctaccgggactggacaccgtgctacacccccctgatccaagtggagcagtcagaggccctggaccaggtgaacggcagcctgccgtccctgcaccgcagctcctggtacacagacgagcccgacatctcctaccggactttcacaccagccagcctgactgtccccagcagcttccggaacaaaaacagcgacaagcagaggagtgcggacagcttggtggaggcagtcctgatatccgaaggcttgggacgctatgcaagggacccaaaatttgtgtcagcaacaaaacacgaaatcgctgatgcctgtgacctcaccatcgacgagatggagagtgcagccagcaccctgcttaatgggaacgtgcgtccccgagccaacggggatgtgggccccctctcacaccggcaggactatgagctacaggactttggtcctggctacagcgacgaagagccagaccctgggagggatgaggaggacctggcggatgaaatgatatgcatcaccaccttgtagcccccagcgaggggcagactggctctggcctcaggtggggcgcaggagagccaggggaaaagtgcctcatagttaggaaagtttaggcactagttgggagtaatattcaattaattagacttttgtataagagatgtcatgcctcaagaaagccataaacctggtaggaacaggtcccaagcggttgagcctggcagagtaccatgcgctcggccccagctgcaggaaacagcaggccccgccctctcacagaggatgggtgaggaggccagacctgccctgccccattgtccagatgggcactgctgtggagtctgcttctcccatgtaccagggcaccaggcccacccaactgaaggcatggcggcggggtgcaggggaaagttaaaggtgatgacgatcatcacacctgtgtcgttacctcagccatcggtctagcatatcagtcactgggcccaacatatccatttttaaaccctttcccccaaatacactgcgtcctggttcctgtttagctgttctgaaatacggtgtgtaagtaagtcagaacccagctaccagtgattattgcgagggcaatgggacctcataaataaggttttctgtgatgtgacgccagtttacataagagaatatcac

SEQ ID NO: 4190 - DNA, 6414 bp, Homo sapiens
atgatgatgatgatgatgatgaaaaaaatgcagcatcaacggcagcagcaagcggaccacgcgaacgaggcaaactatgcaagaggcaccagacttcctctttctggtgaaggaccaacttctcagccgaatagctccaagcaaactgtcctgtcttggcaagctgcaatcgatgctgctagacaggccaaggctgcccaaactatgagcacctctgcacccccacctgtaggatctctctcccaaagaaaacgtcagcaatacgccaagagcaaaaaacagggtaactcgtccaacagccgacctgcccgcgcccttttctgtttatcactcaataaccccatccgaagagcctgcattagtatagtggaatggaaaccatttgacatatttatattattggctatttttgccaattgtgtggccttagctatttacatcccattccctgaagatgattctaattcaacaaatcataacttggaaaaagtagaatatgccttcctgattatttttacagtcgagacatttttgaagattatagcgtatggattattgctacatcctaatgcttatgttaggaatggatggaatttactggattttgttatagtaatagtaggattgtttagtgtaattttggaacaattaaccaaagaaacagaaggcgggaaccactcaagcggcaaatctggaggctttgatgtcaaagccctccgtgcctttcgagtgttgcgaccacttcgactagtgtcaggagtgcccagtttacaagttgtcctgaactccattataaaagccatggttcccctccttcacatagcccttttggtattatttgtaatcataatctatgctattataggattggaactttttattggaaaaatgcacaaaacatgtttttttgctgactcagatatcgtagctgaagaggacccagctccatgtgcgttctcagggaatggacgccagtgtactgccaatggcacggaatgtaggagtggctgggttggcccgaacggaggcatcaccaactttgataactttgcctttgccatgcttactgtgtttcagtgcatcaccatggagggctggacagatgtgctctactggatgaatgatgctatgggatttgaattgccctgggtgtattttgtcagtctcgtcatctttgggtcatttttcgtactaaatcttgtacttggtgtattgagcggagaattctcaaaggaaagagagaaggcaaaagcacggggagatttccagaagctccgggagaagcagcagctggaggaggatctaaagggctacttggattggatcacccaagctgaggacatcgatccggagaatgaggaagaaggaggagaggaaggcaaacgaaatactagcatgcccaccagcgagactgagtctgtgaacacagagaacgtcagcggtgaaggcgagaaccgaggctgctgtggaagtctctgtcaagccatctcaaaatccaaactcagccgacgctggcgtcgctggaaccgattcaatcgcagaagatgtagggccgccgtgaagtctgtcacgttttactggctggttatcgtcctggtgtttctgaacaccttaaccatttcctctgagcactacaatcagccagattggttgacacagattcaagatattgccaacaaagtcctcttggctctgttcacctgcgagatgctggtaaaaatgtacagcttgggcctccaagcatatttcgtctctcttttcaaccggtttgattgcttcgtggtgtgtggtggaatcactgagacgatcttggtggaactggaaatcatgtctcccctggggatctctgtgtttcggtgtgtgcgcctcttaagaatcttcaaagtgaccaggcactggacttccctgagcaacttagtggcatccttattaaactccatgaagtccatcgcttcgctgttgcttctgctttttctcttcattatcatcttttccttgcttgggatgcagctgtttggcggcaagtttaattttgatgaaacgcaaaccaagcggagcacctttgacaatttccctcaagcacttctcacagtgttccagatcctgacaggcgaagactggaatgctgtgatgtacgatggcatcatggcttacgggggcccatcctcttcaggaatgatcgtctgcatctacttcatcatcctcttcatttgtggtaactatattctactgaatgtcttcttggccatcgctgtagacaatttggctgatgctgaaagtctgaacactgctcagaaagaagaagcggaagaaaaggagaggaaaaagattgccagaaaagagagcctagaaaataaaaagaacaacaaaccagaagtcaaccagatagccaacagtgacaacaaggttacaattgatgactatagagaagaggatgaagacaaggacccctatccgccttgcgatgtgccagtaggggaagaggaagaggaagaggaggaggatgaacctgaggttcctgccggaccccgtcctcgaaggatctcggagttgaacatgaaggaaaaaattgcccccatccctgaagggagcgctttcttcattcttagcaagaccaacccgatccgcgtaggctgccacaagctcatcaaccaccacatcttcaccaacctcatccttgtcttcatcatgctgagcagcgctgccctggccgcagaggaccccatccgcagccactccttccggaacacgatactgggttactttgactatgccttcacagccatctttactgttgagatcctgttgaagatgacaacttttggagctttcctccacaaaggggccttctgcaggaactacttcaatttgctggatatgctggtggttggggtgtctctggtgtcatttgggattcaatccagtgccatctccgttgtgaagattctgagggtcttaagggtcctgcgtcccctcagggccatcaacagagcaaaaggacttaagcacgtggtccagtgcgtcttcgtggccatccggaccatcggcaacatcatgatcgtcaccaccctcctgcagttcatgtttgcctgtatcggggtccagttgttcaaggggaagttctatcgctgtacggatgaagccaaaagtaaccctgaagaatgcaggggacttttcatcctctacaaggatggggatgttgacagtcctgtggtccgtgaacggatctggcaaaacagtgatttcaacttcgacaacgtcctctctgctatgatggcgctcttcacagtctccacgtttgagggctggcctgcgttgctgtataaagccatcgactcgaatggagagaacatcggcccaatctacaaccaccgcgtggagatctccatcttcttcatcatctacatcatcattgtagctttcttcatgatgaacatctttgtgggctttgtcatcgttacatttcaggaacaaggagaaaaagagtataagaactgtgagctggacaaaaatcagcgtcagtgtgttgaatacgccttgaaagcacgtcccttgcggagatacatccccaaaaacccctaccagtacaagttctggtacgtggtgaactcttcgcctttcgaatacatgatgtttgtcctcatcatgctcaacacactctgcttggccatgcagcactacgagcagtccaagatgttcaatgatgccatggacattctgaacatggtcttcaccggggtgttcaccgtcgagatggttttgaaagtcatcgcatttaagcctaaggggtattttagtgacgcctggaacacgtttgactccctcatcgtaatcggcagcattatagacgtggccctcagcgaagcagacaactctgaagagagcaatagaatctccatcacctttttccgtcttttccgagtgatgcgattggtgaagcttctcagcaggggggaaggcatccggacattgctgtggacttttattaagtcctttcaggcgctcccgtatgtggccctcctcatagccatgctgttcttcatctatgcggtcattggcatgcagatgtttgggaaagttgccatgagagataacaaccagatcaataggaacaataacttccagacgtttccccaggcggtgctgctgctcttcaggtgtgcaacaggtgaggcctggcaggagatcatgctggcctgtctcccagggaagctctgtgaccctgagtcagattacaaccccggggaggagtatacatgtgggagcaactttgccattgtctatttcatcagtttttacatgctctgtgcatttctgatcatcaatctgtttgtggctgtcatcatggataatttcgactatctgacccgggactggtctattttggggcctcaccatttagatgaattcaaaagaatatggtcagaatatgaccctgaggcaaagggaaggataaaacaccttgatgtggtcactctgcttcgacgcatccagcctcccctggggtttgggaagttatgtccacacagggtagcgtgcaagagattagttgccatgaacatgcctctcaacagtgacgggacagtcatgtttaatgcaaccctgtttgctttggttcgaacggctcttaagatcaagaccgaagggaacctggagcaagctaatgaagaacttcgggctgtgataaagaaaatttggaagaaaaccagcatgaaattacttgaccaagttgtccctccagctggtgatgatgaggtaaccgtggggaagttctatgccactttcctgatacaggactactttaggaaattcaagaaacggaaagaacaaggactggtgggaaagtaccctgcgaagaacaccacaattgccctacaggcgggattaaggacactgcatgacattgggccagaaatccggcgtgctatatcgtgtgatttgcaagatgacgagcctgaggaaacaaaacgagaagaagaagatgatgtgttcaaaagaaatggtgccctgcttggaaaccatgtcaatcatgttaatagtgataggagagattcccttcagcagaccaataccacccaccgtcccctgcatgtccaaaggccttcaattccacctgcaagtgatactgagaaaccgctgtttcctccagcaggaaattcggtgtgtcataaccatcataaccataattccataggaaagcaagttcccacctcaacaaatgccaatctcaataatgccaatatgtccaaagctgcccatggaaagcggcccagcattgggaaccttgagcatgtgtctgaaaatgggcatcattcttcccacaagcatgaccgggagcctcagagaaggtccagtgtgaaaaggtccgactcaggagatgaacagctcccaactatttgccgggaagacccagagatacatggctatttcagggacccccactgcttgggggagcaggagtatttcagtagtgaggaatgctacgaggatgacagctcgcccacctggagcaggcaaaactatggctactacagcagatacccaggcagaaacatcgactctgagaggccccgaggctaccatcatccccaaggattcttggaggacgatgactcgcccgtttgctatgattcacggagatctccaaggagacgcctactacctcccaccccagcatcccaccggagatcctccttcaactttgagtgcctgcgccggcagagcagccaggaagaggtcccgtcgtctcccatcttcccccatcgcacggccctgcctctgcatctaatgcagcaacagatcatggcagttgccggcctagattcaagtaaagcccagaagtactcaccgagtcactcgacccggtcgtgggccacccctccagcaacccctccctaccgggactggacaccgtgctacacccccctgatccaagtggagcagtcagaggccctggaccaggtgaacggcagcctgccgtccctgcaccgcagctcctggtacacagacgagcccgacatctcctaccggactttcacaccagccagcctgactgtccccagcagcttccggaacaaaaacagcgacaagcagaggagtgcggacagcttggtggaggcagtcctgatatccgaaggcttgggacgctatgcaagggacccaaaatttgtgtcagcaacaaaacacgaaatcgctgatgcctgtgacctcaccatcgacgagatggagagtgcagccagcaccctgcttaatgggaacgtgcgtccccgagccaacggggatgtgggccccctctcacaccggcaggactatgagctacaggactttggtcctggctacagcgacgaagagccagaccctgggagggatgaggaggacctggcggatgaaatgatatgcatcaccaccttgtag

SEQ ID NO: 4191 - DNA, 5667 bp, Homo sapiens
gccaatggcacggaatgtaggagtggctgggttggcccgaacggaggcatcaccaactttgataactttgcctttgccatgcttactgtgtttcagtgcatcaccatggagggctggacagatgtgctctactggatgaatgatgctatgggatttgaattgccctgggtgtattttgtcagtctcgtcatctttgggtcatttttcgtactaaatcttgtacttggtgtattgagcggagaattctcaaaggaaagagagaaggcaaaagcacggggagatttccagaagctccgggagaagcagcagctggaggaggatctaaagggctacttggattggatcacccaagctgaggacatcgatccggagaatgaggaagaaggaggagaggaaggcaaacgaaatactagcatgcccaccagcgagactgagtctgtgaacacagagaacgtcagcggtgaaggcgagaaccgaggctgctgtggaagtctctggtgctggtggagacggagaggcgcggccaaggcggggccctctgggtgtcggcggtggggtcaagccatctcaaaatccaaactcagccgacgctggcgtcgctggaaccgattcaatcgcagaagatgtagggccgccgtgaagtctgtcacgttttactggctggttatcgtcctggtgtttctgaacaccttaaccatttcctctgagcactacaatcagccagattggttgacacagattcaagatattgccaacaaagtcctcttggctctgttcacctgcgagatgctggtaaaaatgtacagcttgggcctccaagcatatttcgtctctcttttcaaccggtttgattgcttcgtggtgtgtggtggaatcactgagacgatcttggtggaactggaaatcatgtctcccctggggatctctgtgtttcggtgtgtgcgcctcttaagaatcttcaaagtgaccaggcactggacttccctgagcaacttagtggcatccttattaaactccatgaagtccatcgcttcgctgttgcttctgctttttctcttcattatcatcttttccttgcttgggatgcagctgtttggcggcaagtttaattttgatgaaacgcaaaccaagcggagcacctttgacaatttccctcaagcacttctcacagtgttccagatcctgacaggcgaagactggaatgctgtgatgtacgatggcatcatggcttacgggggcccatcctcttcaggaatgatcgtctgcatctacttcatcatcctcttcatttgtggtaactatattctactgaatgtcttcttggccatcgctgtagacaatttggctgatgctgaaagtctgaacactgctcagaaagaagaagcggaagaaaaggagaggaaaaagattgccagaaaagagagcctagaaaataaaaagaacaacaaaccagaagtcaaccagatagccaacagtgacaacaaggttacaattgatgactatagagaagaggatgaagacaaggacccctatccgccttgcgatgtgccagtaggggaagaggaagaggaagaggaggaggatgaacctgaggttcctgccggaccccgtcctcgaaggatctcggagttgaacatgaaggaaaaaattgcccccatccctgaagggagcgctttcttcattcttagcaagaccaacccgatccgcgtaggctgccacaagctcatcaaccaccacatcttcaccaacctcatccttgtcttcatcatgctgagcagcgctgccctggccgcagaggaccccatccgcagccactccttccggaacacgatactgggttactttgactatgccttcacagccatctttactgttgagatcctgttgaagatgacaacttttggagctttcctccacaaaggggccttctgcaggaactacttcaatttgctggatatgctggtggttggggtgtctctggtgtcatttgggattcaatccagtgccatctccgttgtgaagattctgagggtcttaagggtcctgcgtcccctcagggccatcaacagagcaaaaggacttaagcacgtggtccagtgcgtcttcgtggccatccggaccatcggcaacatcatgatcgtcaccaccctcctgcagttcatgtttgcctgtatcggggtccagttgttcaaggggaagttctatcgctgtacggatgaagccaaaagtaaccctgaagaatgcaggggacttttcatcctctacaaggatggggatgttgacagtcctgtggtccgtgaacggatctggcaaaacagtgatttcaacttcgacaacgtcctctctgctatgatggcgctcttcacagtctccacgtttgagggctggcctgcgttgctgtataaagccatcgactcgaatggagagaacatcggcccaatctacaaccaccgcgtggagatctccatcttcttcatcatctacatcatcattgtagctttcttcatgatgaacatctttgtgggctttgtcatcgttacatttcaggaacaaggagaaaaagagtataagaactgtgagctggacaaaaatcagcgtcagtgtgttgaatacgccttgaaagcacgtcccttgcggagatacatccccaaaaacccctaccagtacaagttctggtacgtggtgaactcttcgcctttcgaatacatgatgtttgtcctcatcatgctcaacacactctgcttggccatgcagcactacgagcagtccaagatgttcaatgatgccatggacattctgaacatggtcttcaccggggtgttcaccgtcgagatggttttgaaagtcatcgcatttaagcctaagcactatttcactgatgcatggaacacttttgatgccttaattgttgttggtagcgtcgttgatattgctataactgaagtgaatccaactgaaagtgaaaatgtccctgtcccaactgctacacctgggaactctgaagagagcaatagaatctccatcacctttttccgtcttttccgagtgatgcgattggtgaagcttctcagcaggggggaaggcatccggacattgctgtggacttttattaagtcctttcaggcgctcccgtatgtggccctcctcatagccatgctgttcttcatctatgcggtcattggcatgcagatgtttgggaaagttgccatgagagataacaaccagatcaataggaacaataacttccagacgtttccccaggcggtgctgctgctcttcaggtgtgcaacaggtgaggcctggcaggagatcatgctggcctgtctcccagggaagctctgtgaccctgagtcagattacaaccccggggaggagtatacatgtgggagcaactttgccattgtctatttcatcagtttttacatgctctgtgcatttctgatcatcaatctgtttgtggctgtcatcatggataatttcgactatctgacccgggactggtctattttggggcctcaccatttagatgaattcaaaagaatatggtcagaatatgaccctgaggcaaagggaaggataaaacaccttgatgtggtcactctgcttcgacgcatccagcctcccctggggtttgggaagttatgtccacacagggtagcgtgcaagagattagttgccatgaacatgcctctcaacagtgacgggacagtcatgtttaatgcaaccctgtttgctttggttcgaacggctcttaagatcaagaccgaagggaacctggagcaagctaatgaagaacttcgggctgtgataaagaaaatttggaagaaaaccagcatgaaattacttgaccaagttgtccctccagctggtgatgatgaggtaaccgtggggaagttctatgccactttcctgatacaggactactttaggaaattcaagaaacggaaagaacaaggactggtgggaaagtaccctgcgaagaacaccacaattgccctacaggcgggattaaggacactgcatgacattgggccagaaatccggcgtgctatatcgtgtgatttgcaagatgacgagcctgaggaaacaaaacgagaagaagaagatgatgtgttcaaaagaaatggtgccctgcttggaaaccatgtcaatcatgttaatagtgataggagagattcccttcagcagaccaataccacccaccgtcccctgcatgtccaaaggccttcaattccacctgcaagtgatactgagaaaccgctgtttcctccagcaggaaattcggtgtgtcataaccatcataaccataattccataggaaagcaagttcccacctcaacaaatgccaatctcaataatgccaatatgtccaaagctgcccatggaaagcggcccagcattgggaaccttgagcatgtgtctgaaaatgggcatcattcttcccacaagcatgaccgggagcctcagagaaggtccagtgtgaaaagaacccgctattatgaaacttacattaggtccgactcaggagatgaacagctcccaactatttgccgggaagacccagagatacatggctatttcagggacccccactgcttgggggagcaggagtatttcagtagtgaggaatgctacgaggatgacagctcgcccacctggagcaggcaaaactatggctactacagcagatacccaggcagaaacatcgactctgagaggccccgaggctaccatcatccccaaggattcttggaggacgatgactcgcccgtttgctatgattcacggagatctccaaggagacgcctactacctcccaccccagcatcccaccggagatcctccttcaactttgagtgcctgcgccggcagagcagccaggaagaggtcccgtcgtctcccatcttcccccatcgcacggccctgcctctgcatctaatgcagcaacagatcatggcagttgccggcctagattcaagtaaagcccagaagtactcaccgagtcactcgacccggtcgtgggccacccctccagcaacccctccctaccgggactggacaccgtgctacacccccctgatccaagtggagcagtcagaggccctggaccaggtgaacggcagcctgccgtccctgcaccgcagctcctggtacacagacgagcccgacatctcctaccggactttcacaccagccagcctgactgtccccagcagcttccggaacaaaaacagcgacaagcagaggagtgcggacagcttggtggaggcagtcctgatatccgaaggcttgggacgctatgcaagggacccaaaatttgtgtcagcaacaaaacacgaaatcgctgatgcctgtgacctcaccatcgacgagatggagagtgcagccagcaccctgcttaatgggaacgtgcgtccccgagccaacggggatgtgggccccctctcacaccggcaggactatgagctacaggactttggtcctggctacagcgacgaagagccagaccctgggagggatgaggaggacctggcggatgaaatgatatgcatcaccaccttgtagcccccagcgaggggcagactggctctggcctcaggtggggcgcaggagagccaggggaaaagtgcctcatagttaggaaagtttaggcactagttgggagta

SEQ ID NO: 4192 - DNA, 1830 bp, Homo sapiens
ctcttagtgctggctgtttgggcctgaggctgatgggagagacctggttgtgtccagcagccttggggttgctgtataaagccatcgactcgaatggagagaacatcggcccaatctacaaccaccgcgtggagatctccatcttcttcatcatctacatcatcattgtagctttcttcatgatgaacatctttgtgggctttgtcatcgttacatttcaggaacaaggagaaaaagagtataagaactgtgagctggacaaaaatcagcgtcagtgtgttgaatacgccttgaaagcacgtcccttgcggagatacatccccaaaaacccctaccagtacaagttctggtacgtggtgaactcttcgcctttcgaatacatgatgtttgtcctcatcatgctcaacacactctgcttggccatgcagcactacgagcagtccaagatgttcaatgatgccatggacattctgaacatggtcttcaccggggtgttcaccgtcgagatggttttgaaagtcatcgcatttaagcctaaggggtattttagtgacgcctggaacacgtttgactccctcatcgtaatcggcagcattatagacgtggccctcagcgaagcagacaactctgaagagagcaatagaatctccatcacctttttccgtcttttccgagtgatgcgattggtgaagcttctcagcaggggggaaggcatccggacattgctgtggacttttattaagtcctttcaggcgctcccgtatgtggccctcctcatagccatgctgttcttcatctatgcggtcattggcatgcagatgtttgggaaagttgccatgagagataacaaccagatcaataggaacaataacttccagacgtttccccaggcggtgctgctgctcttcaggtgtgcaacaggtgaggcctggcaggagatcatgctggcctgtctcccagggaagctctgtgaccctgagtcagattacaaccccggggaggagtatacatgtgggagcaactttgccattgtctatttcatcagtttttacatgctctgtgcatttctgatcatcaatctgtttgtggctgtcatcatggataatttcgactatctgacccgggactggtctattttggggcctcaccatttagatgaattcaaaagaatatggtcagaatatgaccctgaggcaaagggaaggataaaacaccttgatgtggtcactctgcttcgacgcatccagcctcccctggggtttgggaagttatgtccacacagggtagcgtgcaagagattagttgccatgaacatgcctctcaacagtgacgggacagtcatgtttaatgcaaccctgtttgctttggttcgaacggctcttaagatcaagaccgaagggaacctggagcaagctaatgaagaacttcgggctgtgataaagaaaatttggaagaaaaccagcatgaaattacttgaccaagttgtccctccagctggtgatgatgaggtaaccgtggggaagttctatgccactttcctgatacaggactactttaggaaattcaagaaacggaaagaacaaggactggtgggaaagtaccctgcgaagaacaccacaattgccctacagatgcttgaacggatgctttagaattttctgcctgagctacggcaccaagctggttagtcggaaggcgtttgtggctaaggccttgaaagggaaaagtctcaagtgggcttatttctactgaaacagcatttcagaagaaatgcaggaaaaagcagacccaaggccccagggagaccccttccaagcaaagcactcctcc

SEQ ID NO: 4193 - DNA, 1749 bp, Homo sapiens
aatctcattctgttttctaatggaactagtctaaaaaggtcccctctcattgggtatagactgaatcctgctaaagggttaaccagaacttgtcaccagcgagacgactgtgtgcagggccagcctaggctgagtgcagcctgcctgtgatggggaacaggctctgccaggcagggttctttggctggagtctcaaagcctggcgcttgtatcctgaagatgaatggcctggcccagtcccgactagagacatgcatctcttatctccactgctacagcgcgggattaaggacactgcatgacattgggccagaaatccggcgtgctatatcgtgtgatttgcaagatgacgagcctgaggaaacaaaacgagaagaagaagatgatgtgttcaaaagaaatggtgccctgcttggaaaccatgtcaatcatgttaatagtgataggagagattcccttcagcagaccaataccacccaccgtcccctgcatgtccaaaggccttcaattccacctgcaagtgatactgagaaaccgctgtttcctccagcaggaaattcggtgtgtcataaccatcataaccataattccataggaaagcaagttcccacctcaacaaatgccaatctcaataatgccaatatgtccaaagctgcccatggaaagcggcccagcattgggaaccttgagcatgtgtctgaaaatgggcatcattcttcccacaagcatgaccgggagcctcagagaaggtccagtgtgaaaagaacccgctattatgaaacttacattaggtccgactcaggagatgaacagctcccaactatttgccgggaagacccagagatacatggctatttcagggacccccactgcttgggggagcaggagtatttcagtagtgaggaatgctacgaggatgacagctcgcccacctggagcaggcaaaactatggctactacagcagatacccaggcagaaacatcgactctgagaggccccgaggctaccatcatccccaaggattcttggaggacgatgactcgcccgtttgctatgattcacggagatctccaaggagacgcctactacctcccaccccagcatcccaccggagatcctccttcaactttgagtgcctgcgccggcagagcagccaggaagaggtcccgtcgtctcccatcttcccccatcgcacggccctgcctctgcatctaatgcagcaacagtcccctctttcctcagatcatggcagttgccggcctagattcaagtaaagcccagaagtactcaccgagtcactcgacccggtcgtgggccacccctccagcaacccctccctaccgggactggacaccgtgctacacccccctgatccaagtggagcagtcagaggccctggaccaggtgaacggcagcctgccgtccctgcaccgcagctcctggtacacagacgagcccgacatctcctaccggactttcacaccagccagcctgactgtccccagcagcttccggaacaaaaacagcgacaagcagaggagtgcggacagcttggtggaggcagtcctgatatccgaaggcttgggacgctatgcaagggacccaaaatttgtgtcagcaacaaaacacgaaatcgctgatgcctgtgacctcaccatcgacgagatggagagtgcagccagcaccctgcttaatgggaacgtgcgtccccgagccaacggggatgtgggccccctctcacaccggca

SEQ ID NO: 4194 - DNA, 6037 bp, Homo sapiens
ctccaaagctgggggaagagaggggggttgtgtgcagatggcccttcaatctcgaaagaaagatgtcggaatctgaaggcgggaaagacaccaccccagagcccagtccagccaatggggcaggccctggtcccgaatgggggctgtgccccgggcccccagctgtggaaggtgaaagcagtggggcatcaggcctagggacccctaagcgaagaaaccagcacagcaagcacaagacagtggcagtggccagtgcccagcggtcacctcgggcactcttctgcctcaccctggccaatcctctgcgacggtcctgcatcagcatcgtggagtggaagcccttcgacatcctcatcctgctgaccatctttgccaactgcgtggccctgggagtttacatccccttccctgaggacgactccaacactgccaaccacaacctggagcaggtggagtacgtattcctggtgattttcactgtggagacggtgctcaagatcgtggcctacgggctggtgctccaccccagcgcctacatccgcaatggctggaacctactcgacttcatcatcgtcgtggtcgggctgttcagcgttctgctggagcagggccccggacggccaggcgacgccccgcacaccgggggaaagccaggaggcttcgatgtgaaggcattgagggcgtttcgggtgctgcggccactgaggctggtgtctggggtcccgagcctgcacatagtgctcaattccatcatgaaggctctggtgccgctgctgcacattgcactgctcgtgctcttcgtcatcatcatttatgccatcattgggctcgagctgttccttggacgaatgcacaagacgtgctacttcctgggatccgacatggaagcggaggaggacccatcgccctgtgcgtcttcgggatcagggcgtgcgtgcacgctgaaccagactgagtgccgcgggcgctggccagggcccaatggaggcatcaccaactttgacaacttcttcttcgccatgctgacagtcttccagtgtgtcaccatggaaggctggaccgatgtgctctactggatgcaagatgccatggggtatgaactgccctgggtgtactttgtgagccttgtcatctttgggtccttcttcgtcctcaaccttgtgcttggcgtcctgagtggggagttctccaaggagagagagaaagcgaaagctcgcggggacttccagaagcagcgggagaagcagcagatggaggaagacctgcggggctacctggactggatcactcaagccgaagagctggacatggaggacccctccgccgatgacaaccttgggccacagctggccgagctgaccaataggaggcgtggacgtctgcgctggttcagtcattctactcgctccacacactccaccagcagccatgccagcctcccagccagtgacaccggttccatgacagagacccaaggcgatgaggatgaggaggagggggctctggccagctgtacacgctgcctaaacaagatcatgaaaaccagagtctgccgccgcctccgccgagccaaccgggtccttcgggcacgctgccgtcgggcagtgaagtccaatgcctgctactgggctgtgctgttgctcgtcttcctcaacacgttgaccatcgcctctgagcaccacgggcagcctgtgtggctcacccagatccaggagtatgccaacaaagtgttgctctgtctgttcacggtggagatgcttctcaaattgtacggtctgggcccctctgcctatgtgtcttccttcttcaaccgctttgactgctttgtggtctgtgggggcatcctagagaccaccttggtggaggtgggcgccatgcagcccttgggcatctcagtgctccgatgtgtgcgcctcctcaggatctttaaggtcaccagacactgggcttctctgagcaatctggtggcatccctgctcaattcaatgaaatccatcgcatccttgctgcttctcctcttcctcttcatcattatcttctccctgcttggcatgcagctgtttgggggcaagttcaactttgaccagacccacaccaagcgaagcacctttgacacgttcccccaggccctcctcactgtctttcagatcctgacaggtgaggactggaacgtggtcatgtatgatggtatcatggcatatggtggccccttcttcccaggaatgttggtgtgcatctatttcatcattctcttcatctgtggcaactacatcctgttgaacgtgtttcttgccattgctgtggacaacctggccagtggagatgcaggcactgccaaggacaagggcggggagaagagcaatgagaaggatctcccacaggagaatgaaggcctggtgcctggtgtggagaaagaggaagaggagggtgcaaggagggaaggagcagacatggaggaggaggaggaggaggaagaagaggaagaagaggaagaagaggaagagggtgcagggggtgtggaactcctgcaggaagttgtacccaaggagaaggtggtacccatccctgagggcagcgccttcttctgcctcagccaaaccaacccgctgaggaagggctgccacaccctcatccaccatcatgtcttcaccaatcttatcctggtgttcatcatcctcagcagtgtgtccctggccgctgaggaccccatccgagcccactccttccgcaaccatattctgggttacttcgattatgccttcacctccattttcactgtggagattctactaaagatgacagtgtttggggccttcctgcaccgcggctccttctgccgtagctggtttaatatgttggatctgctggtggtcagtgtgtccctcatctcctttggcatccactccagcgccatctcggtggtgaagattctgcgagtactccgagtactgcggcccctccgagccatcaacagggccaagggactcaagcatgtggtgcagtgtgtatttgtggccatccggaccatcggaaacatcatgattgtcaccacacttctgcaatttatgttcgcctgcatcggggtgcagctcttcaaggggaaattctacacctgcacggacgaggccaaacacacccctcaagaatgcaagggctccttcctggtatacccagatggagacgtgtcacggcccctggtccgggagcggctctgggtcaacagtgatttcaactttgacaatgtcctttcagccatgatggccctgttcactgtctccacctttgaaggctggcctgcactgctatacaaggccatcgatgcatatgcagaggaccatggccccatctataattaccgtgtggagatctcagtgttcttcattgtctacatcatcatcattgcgttcttcatgatgaacatcttcgtgggcttcgtcatcatcactttccgtgcccagggcgagcaggagtaccaaaactgtgagctggacaagaaccagcgtcaatgtgtggaatatgccctcaaggcccagccactccgccgttacatccccaagaacccgcatcagtatcgtgtgtgggccactgtgaactctgctgcctttgagtacctgatgttcctgctcatcctgctcaacacagttgccctagccatgcagcactatgagcagactgctcccttcaactatgccatggacatcctcaacatggtcttcactggcctcttcactattgagatggtgctcaaaatcatcgccttcaagcccaagcattacttcactgatgcctggaacacgtttgacgctcttattgtggtgggcagcatagtggatattgccgtcactgaagtcaataatggtggccaccttggcgagagctctgaggacagctcccgcatttccattaccttctttcgcctcttccgagttatgcggctggtcaagcttctcagtaagggtgaagggatccgcacattgctctggacattcatcaagtccttccaggccttgccctatgtggctcttctcatcgcaatgatattcttcatctatgccgtcattggcatgcagatgttcggcaaggtggctcttcaggatggcacacagataaaccgaaacaacaacttccagacctttccacaggctgtgctgcttctgttcaggtgtgccactggtgaggcatggcaggagataatgcttgccagccttcccggaaatcggtgtgatcctgagtctgacttcggccctggtgaagagtttacctgtggtagcaattttgccatcgcctatttcatcagcttcttcatgctctgtgccttcctgatcataaatctctttgtggctgtgatcatggacaactttgattatctcaccagagattggtccatcctgggcccccatcaccttgatgaattcaagaggatctggtctgaatatgaccctggggccaagggccgcatcaaacacttggatgtggttgccctgctgagacgtatccagccccctctgggatttgggaagctgtgcccacaccgagtggcctgcaagagacttgtggcaatgaacatgcccctcaactcagatgggacggtgacattcaacgccacactctttgccctggtccggacatccctgaagatcaaaacagaagggaacctggagcaagccaaccaggagctgcggattgtcatcaaaaagatctggaagcggatgaaacagaagctgctagatgaggtcatccccccaccagacgaggaggaggtcaccgtgggcaaattctacgccacatttctgatccaggactatttccgcaaattccggcggaggaaagaaaaagggctactaggcaacgacgccgcccctagcacctcttccgcccttcaggctggtctgcggagcctgcaggacttgggtcctgagatgcggcaggccctcacctgtgacacagaggaggaggaagaagaggggcaggagggagtggaggaggaagatgaaaaggacttggaaactaacaaagccacgatggtctcccagccctcagctcgccggggctccgggatttctgtgtctctgcctgtcggggacagacttccagattcactctcctttgggcccagtgatgatgacagggggactcccacctccagtcagcccagtgtgccccaggctggatccaacacccacaggagaggctctggggctctcattttcaccatcccagaagaaggaaattctcagcccaagggaaccaaagggcaaaacaagcaagatgaggatgaggaagtccctgatcggctttcctacctagatgagcaggcagggactcccccgtgctcagtccttttgccacctcacagagctcagagatacatggatgggcacctggtaccacgccgccgtctgctgccccccacacctgcaggtcggaagccctccttcaccatccagtgtctgcagcgccagggcagttgtgaggatttacccatcccaggcacctatcatcgtgggcgaaattcagggcccaatagggctcagggttcctgggcaacaccacctcagcggggtcggctcctgtatgccccgctgttgttggtggaagagggcgcagcgggggaggggtacctcggcagatccagtggcccactgcgcaccttcacctgtctgcacgtgcctggaacccactcggaccccagccatgggaagaggggcagtgccgacagcttggtggaggctgtgcttatctcagagggtctgggcctctttgctcgagacccacgtttcgtggccctggccaagcaggagattgcagatgcgtgtcgcctgacgctggatgagatggacaatgctgccagtgacctgctggcacagggaaccagctctctctatagcgacgaggagtccatcctctcccgcttcgatgaggaggacttgggagacgagatggcctgcgtccacgccctctgaattcccacccctccccaactgctcaataaacctcctgccctcccctccccagcaggaggcaggcatggaccaca

SEQ ID NO: 4195 - DNA, 5813 bp, Homo sapiens
atgtcggaatctgaaggcgggaaaggtgagagaatccttccatccctgcagacccttggagcaagcatcgtggagtggaagcccttcgacatcctcatcctgctgaccatctttgccaactgcgtggccctgggagtttacatccccttccctgaggacgactccaacactgccaaccacaacctggagcaggtggagtacgtattcctggtgattttcactgtggagacggtgctcaagatcgtggcctacgggctggtgctccaccccagcgcctacatccgcaatggctggaacctactcgacttcatcatcgtcgtggtcgggctgttcagcgttctgctggagcagggccccggacggccaggcgacgccccgcacaccgggggaaagccaggaggcttcgatgtgaaggcattgagggcgtttcgggtgctgcggccactgaggctggtgtctggggtcccgagcctgcacatagtgctcaattccatcatgaaggctctggtgccgctgctgcacattgcactgctcgtgctcttcgtcatcatcatttatgccatcattgggctcgagctgttccttggacgaatgcacaagacgtgctacttcctgggatccgacatggaagcggaggaggacccatcgccctgtgcgtcttcgggatcagggcgtgcgtgcacgctgaaccagactgagtgccgcgggcgctggccagggcccaatggaggcatcaccaactttgacaacttcttcttcgccatgctgacagtcttccagtgtgtcaccatggaaggctggaccgatgtgctctactggatgcaagatgccatggggtatgaactgccctgggtgtactttgtgagccttgtcatctttgggtccttcttcgtcctcaaccttgtgcttggcgtcctgagtggggagttctccaaggagagagagaaagcgaaagctcgcggggacttccagaagcagcgggagaagcagcagatggaggaagacctgcggggctacctggactggatcactcaagccgaagagctggacatggaggacccctccgccgatgacaaccttggttctatggctgaagagggccgggcgggccatcggccacagctggccgagctgaccaataggaggcgtggacgtctgcgctggttcagtcattctactcgctccacacactccaccagcagccatgccagcctcccagccagtgacaccggttccatgacagagacccaaggcgatgaggatgaggaggagggggctctggccagctgtacacgctgcctaaacaagatcatgaaaaccagagtctgccgccgcctccgccgagccaaccgggtccttcgggcacgctgccgtcgggcagtgaagtccaatgcctgctactgggctgtgctgttgctcgtcttcctcaacacgttgaccatcgcctctgagcaccacgggcagcctgtgtggctcacccagatccaggagtatgccaacaaagtgttgctctgtctgttcacggtggagatgcttctcaaattgtacggtctgggcccctctgcctatgtgtcttccttcttcaaccgctttgactgctttgtggtctgtgggggcatcctagagaccaccttggtggaggtgggcgccatgcagcccttgggcatctcagtgctccgatgtgtgcgcctcctcaggatctttaaggtcaccagacactgggcttctctgagcaatctggtggcatccctgctcaattcaatgaaatccatcgcatccttgctgcttctcctcttcctcttcatcattatcttctccctgcttggcatgcagctgtttgggggcaagttcaactttgaccagacccacaccaagcgaagcacctttgacacgttcccccaggccctcctcactgtctttcagatcctgacaggtgaggactggaacgtggtcatgtatgatggtatcatggcatatggtggccccttcttcccaggaatgttggtgtgcatctatttcatcattctcttcatctgtggcaactacatcctgttgaacgtgtttcttgccattgctgtggacaacctggccagtggagatgcaggcactgccaaggacaagggcggggagaagagcaatgagaaggatctcccacaggagaatgaaggcctggtgcctggtgtggagaaagaggaagaggagggtgcaaggagggaaggagcagacatggaggaggaggaggaggaggaagaagaggaagaagaggaagaagaggaagagggtgcagggggtgtggaactcctgcaggaagttgtacccaaggagaaggtggtacccatccctgagggcagcgccttcttctgcctcagccaaaccaacccgctgaggaagggctgccacaccctcatccaccatcatgtcttcaccaatcttatcctggtgttcatcatcctcagcagtgtgtccctggccgctgaggaccccatccgagcccactccttccgcaaccatattctgggttacttcgattatgccttcacctccattttcactgtggagattctactaaagatgacagtgtttggggccttcctgcaccgcggctccttctgccgtagctggtttaatatgttggatctgctggtggtcagtgtgtccctcatctcctttggcatccactccagcgccatctcggtggtgaagattctgcgagtactccgagtactgcggcccctccgagccatcaacagggccaagggactcaagcatgtggtgcagtgtgtatttgtggccatccggaccatcggaaacatcatgattgtcaccacacttctgcaatttatgttcgcctgcatcggggtgcagctcttcaaggggaaattctacacctgcacggacgaggccaaacacacccctcaagaatgcaagggctccttcctggtatacccagatggagacgtgtcacggcccctggtccgggagcggctctgggtcaacagtgatttcaactttgacaatgtcctttcagccatgatggccctgttcactgtctccacctttgaaggctggcctgcactgctatacaaggccatcgatgcatatgcagaggaccatggccccatctataattaccgtgtggagatctcagtgttcttcattgtctacatcatcatcattgcgttcttcatgatgaacatcttcgtgggcttcgtcatcatcactttccgtgcccagggcgagcaggagtaccaaaactgtgagctggacaagaaccagcgtcaatgtgtggaatatgccctcaaggcccagccactccgccgttacatccccaagaacccgcatcagtatcgtgtgtgggccactgtgaactctgctgcctttgagtacctgatgttcctgctcatcctgctcaacacagttgccctagccatgcagcactatgagcagactgctcccttcaactatgccatggacatcctcaacatggtcttcactggcctcttcactattgagatggtgctcaaaatcatcgccttcaagcccaagcattacttcactgatgcctggaacacgtttgacgctcttattgtggtgggcagcatagtggatattgccgtcactgaagtcaataatggtggccaccttggcgagagctctgaggacagctcccgcatttccattaccttctttcgcctcttccgagttatgcggctggtcaagcttctcagtaagggtgaagggatccgcacattgctctggacattcatcaagtccttccaggccttgccctatgtggctcttctcatcgcaatgatattcttcatctatgccgtcattggcatgcagatgttcggcaaggtggctcttcaggatggcacacagataaaccgaaacaacaacttccagacctttccacaggctgtgctgcttctgttcaggtgtgccactggtgaggcatggcaggagataatgcttgccagccttcccggaaatcggtgtgatcctgagtctgacttcggccctggtgaagagtttacctgtggtagcaattttgccatcgcctatttcatcagcttcttcatgctctgtgccttcctgatcataaatctctttgtggctgtgatcatggacaactttgattatctcaccagagattggtccatcctgggcccccatcaccttgatgaattcaagaggatctggtctgaatatgaccctggggccaagggccgcatcaaacacttggatgtggttgccctgctgagacgtatccagccccctctgggatttgggaagctgtgcccacaccgagtggcctgcaagagacttgtggcaatgaacatgcccctcaactcagatgggacggtgacattcaacgccacactctttgccctggtccggacatccctgaagatcaaaacagaagggaacctggagcaagccaaccaggagctgcggattgtcatcaaaaagatctggaagcggatgaaacagaagctgctagatgaggtcatccccccaccagacgaggaggaggtcaccgtgggcaaattctacgccacatttctgatccaggactatttccgcaaattccggcggaggaaagaaaaagggctactaggcaacgacgccgcccctagcacctcttccgcccttcaggctggtctgcggagcctgcaggacttgggtcctgagatgcggcaggccctcacctgtgacacagaggaggaggaagaagaggggcaggagggagtggaggaggaagatgaaaaggacttggaaactaacaaagccacgatggtctcccagccctcagctcgccggggctccgggatttctgtgtctctgcctgtcggggacagacttccagattcactctcctttgggcccagtgatgatgacagggggactcccacctccagtcagcccagtgtgccccaggctggatccaacacccacaggagaggctctggggctctcattttcaccatcccagaagaaggaaattctcagcccaagggaaccaaagggcaaaacaagcaagatgaggatgaggaagtccctgatcggctttcctacctagatgagcaggcagggactcccccgtgctcagtccttttgccacctcacagagctcagagatacatggatgggcacctggtaccacgccgccgtctgctgccccccacacctgcaggtcggaagccctccttcaccatccagtgtctgcagcgccagggcagttgtgaggatttacccatcccaggcacctatcatcgtgggcgaaattcagggcccaatagggctcagggttcctgggcaacaccacctcagcggggtcggctcctgtatgccccgctgttgttggtggaagagggcgcagcgggggaggggtacctcggcagatccagtggcccactgcgcaccttcacctgtctgcacgtgcctggaacccactcggaccccagccatgggaagaggggcagtgccgacagcttggtggaggctgtgcttatctcagagggtctgggcctctttgctcgagacccacgtttcgtggccctggccaagcaggagattgcagatgcgtgtcgcctgacgctggatgagatggacaatgctgccagtgacctgctggcacagggaaccagctctctctatagcgacgaggagtccatcctctcccgcttcgatgaggaggacttgggagacgagatggcctgcgtccacgccctctgaattcccacccctccccaactgctcaataaacctcctgccctcccctccccagcaggaggcaggcatggaccaca

SEQ ID NO: 4196 - DNA, 6070 bp, Homo sapiens
ctccaaagctgggggaagagaggggggttgtgtgcagatggcccttcaatctcgaaagaaagatgtcggaatctgaaggcgggaaagacaccaccccagagcccagtccagccaatggggcaggccctggtcccgaatgggggctgtgccccgggcccccagctgtggaaggtgaaagcagtggggcatcaggcctagggacccctaagcgaagaaaccagcacagcaagcacaagacagtggcagtggccagtgcccagcggtcacctcgggcactcttctgcctcaccctggccaatcctctgcgacggtcctgcatcagcatcgtggagtggaagcccttcgacatcctcatcctgctgaccatctttgccaactgcgtggccctgggagtttacatccccttccctgaggacgactccaacactgccaaccacaacctggagcaggtggagtacgtattcctggtgattttcactgtggagacggtgctcaagatcgtggcctacgggctggtgctccaccccagcgcctacatccgcaatggctggaacctactcgacttcatcatcgtcgtggtcgggctgttcagcgttctgctggagcagggccccggacggccaggcgacgccccgcacaccgggggaaagccaggaggcttcgatgtgaaggcattgagggcgtttcgggtgctgcggccactgaggctggtgtctggggtcccgagcctgcacatagtgctcaattccatcatgaaggctctggtgccgctgctgcacattgcactgctcgtgctcttcgtcatcatcatttatgccatcattgggctcgagctgttccttggacgaatgcacaagacgtgctacttcctgggatccgacatggaagcggaggaggacccatcgccctgtgcgtcttcgggatcagggcgtgcgtgcacgctgaaccagactgagtgccgcgggcgctggccagggcccaatggaggcatcaccaactttgacaacttcttcttcgccatgctgacagtcttccagtgtgtcaccatggaaggctggaccgatgtgctctactggatgcaagatgccatggggtatgaactgccctgggtgtactttgtgagccttgtcatctttgggtccttcttcgtcctcaaccttgtgcttggcgtcctgagtggggagttctccaaggagagagagaaagcgaaagctcgcggggacttccagaagcagcgggagaagcagcagatggaggaagacctgcggggctacctggactggatcactcaagccgaagagctggacatggaggacccctccgccgatgacaaccttggttctatggctgaagagggccgggcgggccatcggccacagctggccgagctgaccaataggaggcgtggacgtctgcgctggttcagtcattctactcgctccacacactccaccagcagccatgccagcctcccagccagtgacaccggttccatgacagagacccaaggcgatgaggatgaggaggagggggctctggccagctgtacacgctgcctaaacaagatcatgaaaaccagagtctgccgccgcctccgccgagccaaccgggtccttcgggcacgctgccgtcgggcagtgaagtccaatgcctgctactgggctgtgctgttgctcgtcttcctcaacacgttgaccatcgcctctgagcaccacgggcagcctgtgtggctcacccagatccaggagtatgccaacaaagtgttgctctgtctgttcacggtggagatgcttctcaaattgtacggtctgggcccctctgcctatgtgtcttccttcttcaaccgctttgactgctttgtggtctgtgggggcatcctagagaccaccttggtggaggtgggcgccatgcagcccttgggcatctcagtgctccgatgtgtgcgcctcctcaggatctttaaggtcaccagacactgggcttctctgagcaatctggtggcatccctgctcaattcaatgaaatccatcgcatccttgctgcttctcctcttcctcttcatcattatcttctccctgcttggcatgcagctgtttgggggcaagttcaactttgaccagacccacaccaagcgaagcacctttgacacgttcccccaggccctcctcactgtctttcagatcctgacaggtgaggactggaacgtggtcatgtatgatggtatcatggcatatggtggccccttcttcccaggaatgttggtgtgcatctatttcatcattctcttcatctgtggcaactacatcctgttgaacgtgtttcttgccattgctgtggacaacctggccagtggagatgcaggcactgccaaggacaagggcggggagaagagcaatgagaaggatctcccacaggagaatgaaggcctggtgcctggtgtggagaaagaggaagaggagggtgcaaggagggaaggagcagacatggaggaggaggaggaggaggaagaagaggaagaagaggaagaagaggaagagggtgcagggggtgtggaactcctgcaggaagttgtacccaaggagaaggtggtacccatccctgagggcagcgccttcttctgcctcagccaaaccaacccgctgaggaagggctgccacaccctcatccaccatcatgtcttcaccaatcttatcctggtgttcatcatcctcagcagtgtgtccctggccgctgaggaccccatccgagcccactccttccgcaaccatattctgggttacttcgattatgccttcacctccattttcactgtggagattctactaaagatgacagtgtttggggccttcctgcaccgcggctccttctgccgtagctggtttaatatgttggatctgctggtggtcagtgtgtccctcatctcctttggcatccactccagcgccatctcggtggtgaagattctgcgagtactccgagtactgcggcccctccgagccatcaacagggccaagggactcaagcatgtggtgcagtgtgtatttgtggccatccggaccatcggaaacatcatgattgtcaccacacttctgcaatttatgttcgcctgcatcggggtgcagctcttcaaggggaaattctacacctgcacggacgaggccaaacacacccctcaagaatgcaagggctccttcctggtatacccagatggagacgtgtcacggcccctggtccgggagcggctctgggtcaacagtgatttcaactttgacaatgtcctttcagccatgatggccctgttcactgtctccacctttgaaggctggcctgcactgctatacaaggccatcgatgcatatgcagaggaccatggccccatctataattaccgtgtggagatctcagtgttcttcattgtctacatcatcatcattgcgttcttcatgatgaacatcttcgtgggcttcgtcatcatcactttccgtgcccagggcgagcaggagtaccaaaactgtgagctggacaagaaccagcgtcaatgtgtggaatatgccctcaaggcccagccactccgccgttacatccccaagaacccgcatcagtatcgtgtgtgggccactgtgaactctgctgcctttgagtacctgatgttcctgctcatcctgctcaacacagttgccctagccatgcagcactatgagcagactgctcccttcaactatgccatggacatcctcaacatggtcttcactggcctcttcactattgagatggtgctcaaaatcatcgccttcaagcccaagcattacttcactgatgcctggaacacgtttgacgctcttattgtggtgggcagcatagtggatattgccgtcactgaagtcaataatggtggccaccttggcgagagctctgaggacagctcccgcatttccattaccttctttcgcctcttccgagttatgcggctggtcaagcttctcagtaagggtgaagggatccgcacattgctctggacattcatcaagtccttccaggccttgccctatgtggctcttctcatcgcaatgatattcttcatctatgccgtcattggcatgcagatgttcggcaaggtggctcttcaggatggcacacagataaaccgaaacaacaacttccagacctttccacaggctgtgctgcttctgttcaggtgtgccactggtgaggcatggcaggagataatgcttgccagccttcccggaaatcggtgtgatcctgagtctgacttcggccctggtgaagagtttacctgtggtagcaattttgccatcgcctatttcatcagcttcttcatgctctgtgccttcctgatcataaatctctttgtggctgtgatcatggacaactttgattatctcaccagagattggtccatcctgggcccccatcaccttgatgaattcaagaggatctggtctgaatatgaccctggggccaagggccgcatcaaacacttggatgtggttgccctgctgagacgtatccagccccctctgggatttgggaagctgtgcccacaccgagtggcctgcaagagacttgtggcaatgaacatgcccctcaactcagatgggacggtgacattcaacgccacactctttgccctggtccggacatccctgaagatcaaaacagaagggaacctggagcaagccaaccaggagctgcggattgtcatcaaaaagatctggaagcggatgaaacagaagctgctagatgaggtcatccccccaccagacgaggaggaggtcaccgtgggcaaattctacgccacatttctgatccaggactatttccgcaaattccggcggaggaaagaaaaagggctactaggcaacgacgccgcccctagcacctcttccgcccttcaggctggtctgcggagcctgcaggacttgggtcctgagatgcggcaggccctcacctgtgacacagaggaggaggaagaagaggggcaggagggagtggaggaggaagatgaaaaggacttggaaactaacaaagccacgatggtctcccagccctcagctcgccggggctccgggatttctgtgtctctgcctgtcggggacagacttccagattcactctcctttgggcccagtgatgatgacagggggactcccacctccagtcagcccagtgtgccccaggctggatccaacacccacaggagaggctctggggctctcattttcaccatcccagaagaaggaaattctcagcccaagggaaccaaagggcaaaacaagcaagatgaggatgaggaagtccctgatcggctttcctacctagatgagcaggcagggactcccccgtgctcagtccttttgccacctcacagagctcagagatacatggatgggcacctggtaccacgccgccgtctgctgccccccacacctgcaggtcggaagccctccttcaccatccagtgtctgcagcgccagggcagttgtgaggatttacccatcccaggcacctatcatcgtgggcgaaattcagggcccaatagggctcagggttcctgggcaacaccacctcagcggggtcggctcctgtatgccccgctgttgttggtggaagagggcgcagcgggggaggggtacctcggcagatccagtggcccactgcgcaccttcacctgtctgcacgtgcctggaacccactcggaccccagccatgggaagaggggcagtgccgacagcttggtggaggctgtgcttatctcagagggtctgggcctctttgctcgagacccacgtttcgtggccctggccaagcaggagattgcagatgcgtgtcgcctgacgctggatgagatggacaatgctgccagtgacctgctggcacagggaaccagctctctctatagcgacgaggagtccatcctctcccgcttcgatgaggaggacttgggagacgagatggcctgcgtccacgccctctgaattcccacccctccccaactgctcaataaacctcctgccctcccctccccagcaggaggcaggcatggaccaca

SEQ ID NO: 4197 - DNA, 6166 bp, Homo sapiens
tcaggcccggcagcggggagccgagtggaggctaattttacttgctgggagcgaggagagtaatcctcctgcccccactcctgcccccgccccctggctggctcagcagggcaggctcagccgacagcctcagccagcctagtccccaaggcgggggcattggggacacagggaagggaaagcactggggtgggggagcaggagaaagccagattcccagggaagccatggagccatcctcaccccaggatgaaggcctgaggaagaaacagcccaagaagccagttcctgagattctgccaaggccaccccgggccttgttctgcctgaccctggagaaccccctgaggaaggcctgcatcagcattgtagaatggaagcccttcgagacgatcatcttgctcaccatctttgccaattgtgtggccctggccgtgtacctgcccatgccggaagatgacaacaactctctgaacctcggcctggagaagctggagtatttcttcctcattgtcttctcgattgaagccgccatgaagatcattgcctacggcttcttattccaccaggacgcttacctgcgcagtggctggaatgtgctggacttcaccattgtcttcctgggggtcttcaccgtgattctggaacaggttaacgtcatccaaagccacacagccccaatgagcagcaaaggagccggcttggatgtcaaggccctcagagccttccgagtgctcagacccctccggctggtgtcgggggtgcctagcctgcaggtggtcctgaactccatcttcaaggccatgctccccctctttcacatcgccctgctggtcctctttatggtcatcatctatgccatcatcgggctggagctcttcaagggcaagatgcacaagacctgctacttcattggtacagatatcgtggccacggtggagaatgaagagccatcgccctgcgccaggacgggctcagggcgccggtgcaccatcaatggcagtgagtgccggggcggctggccagggcccaaccatggcatcacccacttcgacaacttcggcttctccatgctcaccgtgtaccagtgcattaccatggagggatggactgacgtcctttactgggtcaatgatgccatcgggaatgagtggccctggatctattttgtcaccctcattttgctgggatccttcttcatcctcaacctggtgctgggtgtcctgagtggggaattcaccaaggagcgggagaaggccaagtccaggggaaccttccagaagctccgggagaagcagcaactagatgaggaccttcggggctacatgagctggatcacgcagggcgaggtcatggatgttgaggacttcagagaaggaaaactgtctttggatgaaggtggctctgacacagagagcctgtatgaaattgcaggcttgaacaaaatcatccagttcatccgacattggaggcagtggaaccgcatctttcgctggaagtgccatgacatcgtgaagtccaaggtcttctattggctggtgattctcatcgttgccctcaacaccctgtctatcgcctcagagcaccacaaccagcctctctggctgacccgtttgcaagacattgccaaccgggtgctgctgtccctcttcaccactgagatgctgatgaagatgtacgggctgggcctgcgccagtacttcatgtctatcttcaaccgcttcgactgcttcgtggtgtgtagcggtatcctggagatcctgctggtggagtcgggtgccatgacacccctgggcatctccgtgctccgctgcatccgcctcctgaggatcttcaagatcaccaaatattggacgtcgctgagcaacctggtggcatccctgctcaactccatccgctccatcgcctccctgctgctgctgctcttcctcttcatcgtcatcttcgccctcctgggcatgcagctctttggggggaggtatgactttgaagacacagaagtacggcgcagcaactttgacaactttccccaagccctcatcagcgtcttccaggtactgacaggggaagactggacctcaatgatgtacaatgggatcatggcctacggcgggccgtcctaccctggcatgcttgtgtgcatttacttcatcatccttttcgtctgtggcaactacatcctgctcaatgtcttcctggccattgccgtggacaacctggccgaggcggagagcctgacttctgcccagaaggccaaggctgaggagaaaaaacgcaggaagatgtccaagggtctcccagacaagtcagaagaggagaagtcaacgatggccaagaagctggagcagaaacccaagggtgagggcatccccaccactgccaagctgaaaatcgatgagtttgaatctaatgtcaatgaggtgaaggatccctacccctcagccgacttcccaggggatgacgaggaagatgagcctgagatcccgctgagcccccgaccacgtcccctggctgagctgcagctgaaagagaaggccgtgcccattccagaagccagctccttcttcatcttcagccccaccaataagatccgtgtcctgtgtcaccgcatcgtcaatgccacctggtttaccaacttcatcctgctcttcatcctgctcagcagcgctgcactggctgcggaagaccccatccgggctgattccatgagaaatcagatccttaaacactttgacatcgggttcacctctgtcttcactgtggagattgtcctcaagatgacgacctacggagccttcctgcacaagggttccttctgccgcaattacttcaacatgctggacctgctggtggtggccgtgtccctcatctccatgggacttgagtccagtgccatctccgtggtgaagatcctgagggtgctgagggtgctccgaccactcagagccatcaacagagccaaggggttgaagcacgtggtgcagtgcatgttcgtggccatcagcaccatcgggaacatcgtgctggtcactaccctcctacagttcatgtttgcctgcatcggcgtccagctcttcaaggggaagttcttcaggtgcaccgacttgtccaagatgacagaggaggagtgcaggggctactactacgtgtacaaggacggggaccccatgcagatagagctgcgtcaccgcgagtgggtacacagcgacttccacttcgacaatgtgctctcagccatgatgtccctcttcacggtctccaccttcgagggatggcctcagctgctgtacaaggccatagactccaatgcggaggacgtgggtcccatctacaacaaccgtgtggagatggccatcttcttcatcatctacatcatcctcattgccttcttcatgatgaacatctttgtgggcttcgtcattgtcaccttccaggagcagggagagactgagtacaagaactgtgagctggacaagaaccagcgccaatgtgtacagtatgccctgaaggcccgcccactgaggtgctacattcccaaaaacccataccagtaccaggtgtggtacattgtcacctcctcctactttgaatacctgatgtttgccctcatcatgctcaacaccatctgcctcggcatgcagcactacaaccagtcggagcagatgaaccacatctcagacatcctcaatgtggccttcactatcatcttcaccctggagatgatcctcaagctcatggccttcaaggccaggggctactttggagacccctggaatgtgtttgacttcctgattgtcattggcagcatcattgatgtcatcctcagtgagatcgacactttcctggcctccagcgggggactgtattgcctgggtggaggctgcgggaacgttgacccagatgagagtgcccgcatctccagcgccttcttccgcctgttccgtgtcatgaggctgatcaagctgctgagccgggcagaaggagtgcgaaccctcctgtggacgttcatcaagtccttccaggccctaccctacgtggctctgctcatcgtcatgctcttcttcatctacgctgtcatcggcatgcagatgtttgggaagatcgccttggtggatgggacccaaataaaccggaacaacaacttccagaccttcccacaagctgtgctactgctcttcaggtgtgcaacaggtgaggcctggcaggagatcctactggcctgcagctatgggaagctgtgtgacccagagtcggactatgccccaggggaggagtacacatgtggcaccaactttgcatactactacttcatcagcttctacatgctctgtgccttcctggtcatcaacctctttgtggctgtcatcatggacaattttgactacctcacccgggactggtccatcctgggccctcatcacctggatgagttcaaggccatctgggcagagtatgacccagaggctaaggggagaatcaaacacctggacgtggtgaccctgctgagaaggattcagccccctctgggctttgggaagttctgcccacatcgggtagcttgtaagcggctggtgggcatgaacatgcccctgaacagcgacggcacagtcaccttcaatgccacactctttgccctggtccgcacggcactcaagatcaagacggaaggtaactttgagcaggccaacgaggagctgagggccatcatcaagaagatctggaagagaaccagcatgaagctcttggaccaggtcatccctccaataggagatgatgaggtgacagtggggaagttctacgccacattcctcatccaggagcacttccggaagttcatgaaacgccaagaggagtattatggctatcggcccaagaaggacattgtacagatccaggcagggctgcggaccattgaggaagaggcagcccccgagatctgtcgcacggtctcaggagacctggctgctgaggaggagctggagagagccatggtggaggctgcgatggaggagggaatattccggaggactggaggcctgtttggccaggtggacaacttcctggaaaggaccaactccctgccccccgtcatggccaatcagagacccctccagtttgctgagatagagatggaagagatggagtcacctgtcttcttggaggacttcccacaagatccacgcaccaaccccctggctcgtgccaataccaacaatgccaacgccaatgtcgcctatggcaacagcaaccatagcaacagccatgtgttttccagtgtccactatgaaagggagttcccagaagagacagagacgcctgctaccagaggacgagcccttggccaaccctgcagggtcctgggaccccacagcaaaccctgtgtggagatgctgaagggactgctgacccagagggcaatgcccagaggccaggcacctcctgccccctgccagtgccccagggtggagtcctccatgcctgaggacagaaagagctccacaccagggtctcttcatgaggagacaccccacagcaggagcaccagggagaatacttccaggtgctcagcaccagctacagccctgctgatccaaaaggctctggttcgagggggcctgggcaccttggcagctgatgcaaacttcatcatggcaacaggccaggccctggcagatgcctgccaaatggaaccagaggaagtggagatcatggcaacagagctactgaaaggacgagaggccccagagggcatggccagctccctgggatgcctgaacctcgggtcctccctgggcagcctcgaccaacaccagggctcccaggagacccttattcctccaaggctgtgatgcccacacagcatcagcatgggcttagagctggcatgaccaatgggggtggggaagttgctggggtggagaagggctagcccaccgcagcagcctccctccctctcagcagctagatgcatggcctgaggcagggtggtcaggaaccacctcaaaaagtgcggaggaagtagctggacaggccctgcccctcaccagcaagaggcatgattggatggagcttctaatgtcattcaaaaaggcctggtcagtgcctgtctggcctagggccactcccacctgcaggacattaaaatctccaggcctgtgacactggc

SEQ ID NO: 4198 - DNA, 5994 bp, Homo sapiens
ctcagccgacagcctcagccagcctagtccccaaggcgggggcattggggacacagggaagggaaagcactggggtgggggagcaggagaaagccagattcccagggaagccatggagccatcctcaccccaggatgaaggcctgaggaagaaacagcccaagaagccagttcctgagattctgccaaggccaccccgggccttgttctgcctgaccctggagaaccccctgaggaaggcctgcatcagcattgtagaatggaagcccttcgagacgatcatcttgctcaccatctttgccaattgtgtggccctggccgtgtacctgcccatgccggaagatgacaacaactctctgaacctcggcctggagaagctggagtatttcttcctcattgtcttctcgattgaagccgccatgaagatcattgcctacggcttcttattccaccaggacgcttacctgcgcagtggctggaatgtgctggacttcaccattgtcttcctgggggtcttcaccgtgattctggaacaggttaacgtcatccaaagccacacagccccaatgagcagcaaaggagccggcttggatgtcaaggccctcagagccttccgagtgctcagacccctccggctggtgtcgggggtgcctagcctgcaggtggtcctgaactccatcttcaaggccatgctccccctctttcacatcgccctgctggtcctctttatggtcatcatctatgccatcatcgggctggagctcttcaagggcaagatgcacaagacctgctacttcattggtacagatatcgtggccacggtggagaatgaagagccatcgccctgcgccaggacgggctcagggcgccggtgcaccatcaatggcagtgagtgccggggcggctggccagggcccaaccatggcatcacccacttcgacaacttcggcttctccatgctcaccgtgtaccagtgcattaccatggagggatggactgacgtcctttactgggtcaatgatgccatcgggaatgagtggccctggatctattttgtcaccctcattttgctgggatccttcttcatcctcaacctggtgctgggtgtcctgagtggggaattcaccaaggagcgggagaaggccaagtccaggggaaccttccagaagctccgggagaagcagcaactagatgaggaccttcggggctacatgagctggatcacgcagggcgaggtcatggatgttgaggacttcagagaaggaaaactgtctttggatgaaggtggctctgacacagagagcctgtatgaaattgcaggcttgaacaaaatcatccagttcatccgacattggaggcagtggaaccgcatctttcgctggaagtgccatgacatcgtgaagtccaaggtcttctattggctggtgattctcatcgttgccctcaacaccctgtctatcgcctcagagcaccacaaccagcctctctggctgacccgtttgcaagacattgccaaccgggtgctgctgtccctcttcaccactgagatgctgatgaagatgtacgggctgggcctgcgccagtacttcatgtctatcttcaaccgcttcgactgcttcgtggtgtgtagcggtatcctggagatcctgctggtggagtcgggtgccatgacacccctgggcatctccgtgctccgctgcatccgcctcctgaggatcttcaagatcaccaaatattggacgtcgctgagcaacctggtggcatccctgctcaactccatccgctccatcgcctccctgctgctgctgctcttcctcttcatcgtcatcttcgccctcctgggcatgcagctctttggggggaggtatgactttgaagacacagaagtacggcgcagcaactttgacaactttccccaagccctcatcagcgtcttccaggtactgacaggggaagactggacctcaatgatgtacaatgggatcatggcctacggcgggccgtcctaccctggcatgcttgtgtgcatttacttcatcatccttttcgtctgtggcaactacatcctgctcaatgtcttcctggccattgccgtggacaacctggccgaggcggagagcctgacttctgcccagaaggccaaggctgaggagaaaaaacgcaggaagatgtccaagggtctcccagacaagtcagaagaggagaagtcaacgatggccaagaagctggagcagaaacccaagggtgagggcatccccaccactgccaagctgaaaatcgatgagtttgaatctaatgtcaatgaggtgaaggatccctacccctcagccgacttcccaggggatgacgaggaagatgagcctgagatcccgctgagcccccgaccacgtcccctggctgagctgcagctgaaagagaaggccgtgcccattccagaagccagctccttcttcatcttcagccccaccaataagatccgtgtcctgtgtcaccgcatcgtcaatgccacctggtttaccaacttcatcctgctcttcatcctgctcagcagcgctgcactggctgcggaagaccccatccgggctgattccatgagaaatcagatccttaaacactttgacatcgggttcacctctgtcttcactgtggagattgtcctcaagatgacgacctacggagccttcctgcacaagggttccttctgccgcaattacttcaacatgctggacctgctggtggtggccgtgtccctcatctccatgggacttgagtccagtgccatctccgtggtgaagatcctgagggtgctgagggtgctccgaccactcagagccatcaacagagccaaggggttgaagcacgtggtgcagtgcatgttcgtggccatcagcaccatcgggaacatcgtgctggtcactaccctcctacagttcatgtttgcctgcatcggcgtccagctcttcaaggggaagttcttcaggtgcaccgacttgtccaagatgacagaggaggagtgcaggggctactactacgtgtacaaggacggggaccccatgcagatagagctgcgtcaccgcgagtgggtacacagcgacttccacttcgacaatgtgctctcagccatgatgtccctcttcacggtctccaccttcgagggatggcctcagctgctgtacaaggccatagactccaatgcggaggacgtgggtcccatctacaacaaccgtgtggagatggccatcttcttcatcatctacatcatcctcattgccttcttcatgatgaacatctttgtgggcttcgtcattgtcaccttccaggagcagggagagactgagtacaagaactgtgagctggacaagaaccagcgccaatgtgtacagtatgccctgaaggcccgcccactgaggtgctacattcccaaaaacccataccagtaccaggtgtggtacattgtcacctcctcctactttgaatacctgatgtttgccctcatcatgctcaacaccatctgcctcggcatgcagcactacaaccagtcggagcagatgaaccacatctcagacatcctcaatgtggccttcactatcatcttcaccctggagatgatcctcaagctcatggccttcaaggccaggggctactttggagacccctggaatgtgtttgacttcctgattgtcattggcagcatcattgatgtcatcctcagtgagatcgacgacccagatgagagtgcccgcatctccagcgccttcttccgcctgttccgtgtcatgaggctgatcaagctgctgagccgggcagaaggagtgcgaaccctcctgtggacgttcatcaagtccttccaggccctaccctacgtggctctgctcatcgtcatgctcttcttcatctacgctgtcatcggcatgcagatgtttgggaagatcgccttggtggatgggacccaaataaaccggaacaacaacttccagaccttcccacaagctgtgctactgctcttcaggtgtgcaacaggtgaggcctggcaggagatcctactggcctgcagctatgggaagctgtgtgacccagagtcggactatgccccaggggaggagtacacatgtggcaccaactttgcatactactacttcatcagcttctacatgctctgtgccttcctggtcatcaacctctttgtggctgtcatcatggacaattttgactacctcacccgggactggtccatcctgggccctcatcacctggatgagttcaaggccatctgggcagagtatgacccagaggctaaggggagaatcaaacacctggacgtggtgaccctgctgagaaggattcagccccctctgggctttgggaagttctgcccacatcgggtagcttgtaagcggctggtgggcatgaacatgcccctgaacagcgacggcacagtcaccttcaatgccacactctttgccctggtccgcacggcactcaagatcaagacggaaggtaactttgagcaggccaacgaggagctgagggccatcatcaagaagatctggaagagaaccagcatgaagctcttggaccaggtcatccctccaataggagatgatgaggtgacagtggggaagttctacgccacattcctcatccaggagcacttccggaagttcatgaaacgccaagaggagtattatggctatcggcccaagaaggacattgtacagatccaggcagggctgcggaccattgaggaagaggcagcccccgagatctgtcgcacggtctcaggagacctggctgctgaggaggagctggagagagccatggtggaggctgcgatggaggagggaatattccggaggactggaggcctgtttggccaggtggacaacttcctggaaaggaccaactccctgccccccgtcatggccaatcagagacccctccagtttgctgagatagagatggaagagatggagtcacctgtcttcttggaggacttcccacaagatccacgcaccaaccccctggctcgtgccaataccaacaatgccaacgccaatgtcgcctatggcaacagcaaccatagcaacagccatgtgttttccagtgtccactatgaaagggagttcccagaagagacagagacgcctgctaccagaggacgagcccttggccaaccctgcagggtcctgggaccccacagcaaaccctgtgtggagatgctgaagggactgctgacccagagggcaatgcccagaggccaggcacctcctgccccctgccagtgccccagggtggagtcctccatgcctgaggacagaaagagctccacaccagggtctcttcatgaggagacaccccacagcaggagcaccagggagaatacttccaggtgctcagcaccagctacagccctgctgatccaaaaggctctggttcgagggggcctgggcaccttggcagctgatgcaaacttcatcatggcaacaggccaggccctggcagatgcctgccaaatggaaccagaggaagtggagatcatggcaacagagctactgaaaggacgagaggccccagagggcatggccagctccctgggatgcctgaacctcgggtcctccctgggcagcctcgaccaacaccagggctcccaggagacccttattcctccaaggctgtgatgcccacacagcatcagcatgggcttagagctggcatgaccaatgggggtggggaagttgctggggtggagaagggctagcccaccgcagcagcctccctccctctcagcagctagatgcatggcctgaggcagggtggtcaggaaccacctcaaaaagtgcggaggaagtagctggacaggccctgcccctcaccagcaagaggcatgattggatggagcttctaatgtcattcaaaaaggcctggtcagtgcctgtctggcctagggccactcccacctgcaggacattaaaatctccaggcctgtgacactggc

SEQ ID NO: 4199 - DNA, 9796 bp, Homo sapiens
gcggcggcggctgcggcggtggggccgggcgaggtccgctgcggtcccggcggctccgtggctgctccgctctgagcgcctggcgcgccccgcgccctccctgccggggccgctgggccggggatgcacgcggggcccgggagccatggtccgcttcggggacgagctgggcggccgctatgggggccccggcggcggagagcgggcccggggcggcggggccggcggggcggggggcccgggtcccggggggctgcagcccggccagcgggtcctctacaagcaatcgatcgcgcagcgcgcgcggaccatggcgctgtacaaccccatcccggtcaagcagaactgcttcaccgtcaaccgctcgctcttcgtcttcagcgaggacaacgtcgtccgcaaatacgcgaagcgcatcaccgagtggcctccattcgagtatatgatcctggccaccatcatcgccaactgcatcgtgctggccctggagcagcacctccctgatggggacaaaacgcccatgtccgagcggctggacgacacggagccctatttcatcgggatcttttgcttcgaggcagggatcaaaatcatcgctctgggctttgtcttccacaagggctcttacctgcggaacggctggaacgtcatggacttcgtggtcgtcctcacagggatccttgccacggctggaactgacttcgacctgcgaacactgagggctgtgcgtgtgctgaggcccctgaagctggtgtctgggattccaagtttgcaggtggtgctcaagtccatcatgaaggccatggttccactcctgcagattgggctgcttctcttctttgccatcctcatgtttgccatcattggcctggagttctacatgggcaagttccacaaggcctgtttccccaacagcacagatgcggagcccgtgggtgacttcccctgtggcaaggaggccccagcccggctgtgcgagggcgacactgagtgccgggagtactggccaggacccaactttggcatcaccaactttgacaatatcctgtttgccatcttgacggtgttccagtgcatcaccatggagggctggactgacatcctctataatacaaacgatgcggccggcaacacctggaactggctctacttcatccctctcatcatcatcggctccttcttcatgctcaacctggtgctgggcgtgctctcgggggagtttgccaaggagcgagagagggtggagaaccgccgcgccttcctgaagctgcgccggcagcagcagatcgagcgagagctcaacgggtacctggagtggatcttcaaggcggaggaagtcatgctggccgaggaggacaggaatgcagaggagaagtcccctttggacgtgctgaagagagcggccaccaagaagagcagaaatgacctgatccacgcagaggagggagaggaccggtttgcagatctctgtgctgttggatcccccttcgcccgcgccagcctcaagagcgggaagacagagagctcgtcatacttccggaggaaggagaagatgttccggttttttatccggcgcatggtgaaggctcagagcttctactgggtggtgctgtgcgtggtggccctgaacacactgtgtgtggccatggtgcattacaaccagccgcggcggcttaccacgaccctgtattttgcagagtttgttttcctgggtctcttcctcacagagatgtccctgaagatgtatggcctggggcccagaagctacttccggtcctccttcaactgcttcgactttggggtcatcgtggggagcgtctttgaagtggtctgggcggccatcaagccgggaagctcctttgggatcagtgtgctgcgggccctccgcctgctgaggatcttcaaagtcacgaagtactggagctccctgcggaacctggtggtgtccctgctgaactccatgaagtccatcatcagcctgctcttcttgctcttcctgttcattgtggtcttcgccctgctggggatgcagctgtttgggggacagttcaacttccaggatgagactcccacaaccaacttcgacaccttccctgccgccatcctcactgtcttccagatcctgacgggagaggactggaatgcagtgatgtatcacgggatcgaatcgcaaggcggcgtcagcaaaggcatgttctcgtccttttacttcattgtcctgacactgttcggaaactacactctgctgaatgtctttctggccatcgctgtggacaacctggccaacgcccaagagctgaccaaggatgaagaggagatggaagaagcagccaatcagaagcttgctctgcaaaaggccaaagaagtggctgaagtcagccccatgtctgccgcgaacatctccatcgccgccaggcagcagaactcggccaaggcgcgctcggtgtgggagcagcgggccagccagctacggctgcagaacctgcgggccagctgcgaggcgctgtacagcgagatggaccccgaggagcggctgcgcttcgccactacgcgccacctgcggcccgacatgaagacgcacctggaccggccgctggtggtggagctgggccgcgacggcgcgcgggggcccgtgggaggcaaagcccgacctgaggctgcggaggcccccgagggcgtcgaccctccgcgcaggcaccaccggcaccgcgacaaggacaagacccccgcggcgggggaccaggaccgagcagaggccccgaaggcggagagcggggagcccggtgcccgggaggagcggccgcggccgcaccgcagccacagcaaggaggccgcggggcccccggaggcgcggagcgagcgcggccgaggcccaggccccgagggcggccggcggcaccaccggcgcggctccccggaggaggcggccgagcgggagccccgacgccaccgcgcgcaccggcaccaggatccgagcaaggagtgcgccggcgccaagggcgagcggcgcgcgcggcaccgcggcggcccccgagcggggccccgggaggcggagagcggggaggagccggcgcggcggcaccgggcccggcacaaggcgcagcctgctcacgaggctgtggagaaggagaccacggagaaggaggccacggagaaggaggctgagatagtggaagccgacaaggaaaaggagctccggaaccaccagccccgggagccacactgtgacctggagaccagtgggactgtgactgtgggtcccatgcacacactgcccagcacctgtctccagaaggtggaggaacagccagaggatgcagacaatcagcggaacgtcactcgcatgggcagtcagcccccagacccgaacactattgtacatatcccagtgatgctgacgggccctcttggggaagccacggtcgttcccagtggtaacgtggacctggaaagccaagcagaggggaagaaggaggtggaagcggatgacgtgatgaggagcggcccccggcctatcgtcccatacagctccatgttctgtttaagccccaccaacctgctccgccgcttctgccactacatcgtgaccatgaggtacttcgaggtggtcattctcgtggtcatcgccttgagcagcatcgccctggctgctgaggacccagtgcgcacagactcgcccaggaacaacgctctgaaatacctggattacattttcactggtgtctttacctttgagatggtgataaagatgatcgacttgggactgctgcttcaccctggagcctatttccgggacttgtggaacattctggacttcattgtggtcagtggcgccctggtggcgtttgctttctcgagcttcgtgggaggatccaaagggaaagacatcaataccatcaagtctctgagagtccttcgtgtcctgcggcccctcaagaccatcaaacggctgcccaagctcaaggctgtgtttgactgtgtggtgaactccctgaagaatgtcctcaacatcttgattgtctacatgctcttcatgttcatatttgccgtcattgcggtgcagctcttcaaagggaagtttttctactgcacagatgaatccaaggagctggagagggactgcaggggtcagtatttggattatgagaaggaggaagtggaagctcagcccaggcagtggaagaaatacgactttcactacgacaatgtgctctgggctctgctgacgctgttcacagtgtccacgggagaaggctggcccatggtgctgaaacactccgtggatgccacctatgaggagcagggtccaagccctgggtaccgcatggagctgtccatcttctacgtggtctactttgtggtctttcccttcttcttcgtcaacatctttgtggctttgatcatcatcaccttccaggagcagggggacaaggtgatgtctgaatgcagcctggagaagaacgagagggcttgcattgacttcgccatcagcgccaaacccctgacacggtacatgccccaaaaccggcagtcgttccagtataagacgtggacatttgtggtctccccgccctttgaatacttcatcatggccatgatagccctcaacactgtggtgctgatgatgaagttctatgatgcaccctatgagtacgagctgatgctgaaatgcctgaacatcgtgttcacatccatgttctccatggaatgcgtgctgaagatcatcgcctttggggtgctgaactatttcagagatgcctggaatgtctttgactttgtcactgtgttgggaagtattactgatattttagtaacagagattgcgaacaatttcatcaacctcagcttcctccgcctctttcgagctgcgcggctgatcaagctgctccgccagggctacaccatccgcatcctgctgtggacctttgtccagtccttcaaggccctgccctacgtgtgtctgctcattgccatgctgttcttcatctacgccatcatcggcatgcaggtgtttgggaatattgccctggatgatgacaccagcatcaaccgccacaacaacttccggacgtttttgcaagccctgatgctgctgttcaggagcgccacgggggaggcctggcacgagatcatgctgtcctgcctgagcaaccaggcctgtgatgagcaggccaatgccaccgagtgtggaagtgactttgcctacttctacttcgtctccttcatcttcctgtgctcctttctgatgttgaacctctttgtggctgtgatcatggacaattttgagtacctcacgcgggactcttccatcctaggtcctcaccacttggatgagttcatccgggtctgggctgaatacgacccggctgcgtgtgggcgcatcagttacaatgacatgtttgagatgctgaaacacatgtccccgcctctggggctggggaagaaatgccctgctcgagttgcttacaagcgcctggttcgcatgaacatgcccatctccaacgaggacatgactgttcacttcacgtccacgctgatggccctcatccggacggcactggagatcaagctggccccagctgggacaaagcagcatcagtgtgacgcggagttgaggaaggagatttccgttgtgtgggccaatctgccccagaagactttggacttgctggtaccaccccataagcctgatgagatgacagtggggaaggtttatgcagctctgatgatattcgacttctacaagcagaacaaaaccaccagagaccagatgcagcaggctcctggaggcctctcccagatgggtcctgtgtccctgttccaccctctgaaggccaccctggagcagacacagccggctgtgctccgaggagcccgggttttccttcgacagaagagttccacctccctcagcaatggcggggccatacaaaaccaagagagtggcatcaaagagtctgtctcctggggcactcaaaggacccaggatgcaccccatgaggccaggccacccctggagcgtggccactccacagagatccctgtggggcggtcaggagcactggctgtggacgttcagatgcagagcataacccggaggggccctgatggggagccccagcctgggctggagagccagggtcgagcggcctccatgccccgccttgcggccgagactcagcccgtcacagatgccagccccatgaagcgctccatctccacgctggcccagcggccccgtgggactcatctttgcagcaccaccccggaccgcccaccccctagccaggcgtcgtcgcaccaccaccaccaccgctgccaccgccgcagggacaggaagcagaggtccctggagaaggggcccagcctgtctgccgatatggatggcgcaccaagcagtgctgtggggccggggctgcccccgggagaggggcctacaggctgccggcgggaacgagagcgccggcaggagcggggccggtcccaggagcggaggcagccctcatcctcctcctcggagaagcagcgcttctactcctgcgaccgctttgggggccgtgagcccccgaagcccaagccctccctcagcagccacccaacgtcgccaacagctggccaggagccgggaccccacccacagggcagtggttccgtgaatgggagccccttgctgtcaacatctggtgctagcacccccggccgcggtgggcggaggcagctcccccagacgcccctgactccccgccccagcatcacctacaagacggccaactcctcacccatccacttcgccggggctcagaccagcctccctgccttctccccaggccggctcagccgtgggctttccgaacacaacgccctgctgcagagagaccccctcagccagcccctggcccctggctctcgaattggctctgacccttacctggggcagcgtctggacagtgaggcctctgtccacgccctgcctgaggacactctcactttcgaggaggctgtggccaccaactcgggccgctcctccaggacttcctacgtgtcctccctgacctcccagtctcaccctctccgccgcgtgcccaacggttaccactgcaccctgggactcagctcgggtggccgagcacggcacagctaccaccaccctgaccaagaccactggtgctagctgcaccgtgaccgctcagacgcctgcatgcagcaggcgtgtgttccagtggatgagttttatcatccacacggggcagccggccctcgggggaggccttgcccaccttggtgaggctcctgtggcccctccctccccctcctcccctcttttactctagacgacgaataaagccctgttagaggatgcggctctctctgtccccttcctgtcctgccttcctgggtctcgtaccacacaccagaccctaaaccgcaggctgctgtgtgtggctgagaaggacccaggagtccaaatcccgtgtcctgggactcagcatccagcatgggtgcttggagccgttgtgaggagctctgcgtcctgtggggagcacccttcacgtggccgtgcggcacagagaagcagggcccacctgaaagtgcgccgagacctcgggacggaggggatggggagggggacacagtcgtggcttgtgcagcccgccagtgtcagcgaatgctcactcaggcaagctctgtcctccctggacaccgtcagccccacaggaaccgagctgggaagtgttcttgctgtggttgtgatttttaattgcaacacctctcattcttgtcacttctatatacgtgatgtagaaaaaatggaaaaccagaaaaatggggaaggaaatgttcacataactttaaaaaatcaaacctgtgaaagaaagatgtcagctttttgccacgtgtctttgtggcttatgcgaggagactccctgtgcagccctgtccggtccaggtggacgtagacggcccctggctctgctgctcttgaccaagtgcctgaccgccaggccctcacacccaggctcctgggcactgtggtgtgaggcgaggcctcgggatccatcaccgcaggatgctgtgaaaagtactcgcgatggcagccaggtagcaagcccttgccagtggagagcactggatgtcatggtggcaaacaaggcagccatttgctgtcctcctcccacgagtggaaggggtttccaaggaagccacagggcagctgaccacgtgcttgtgtgaggcattttcagtctgttctgcatatgattctcagggcacactctgtggtatgtgaaataggtttccttccacatacagcagaagagaggcaaaggctggtaggaaggaggaagacattggctgggggcttggatgtggggccgtcagggcaggagggaggaagccccagctggaatgaaactcagagcaagtgaccgagggaggacacggctcctgccactgaggccgggcacctgatgcccagcactgtcctggcgccagacacagggagcaggcagtcaagtgaggtctgacccccatggccacgctcaggagagaaagaccatgctcaggacactgtccaaggtgcacaagatgctgggaggtcccttgtttggtgaagaaagggagcatttagagcagttgatggtggtgtgtcctccgtgttctgaaattccagatgatctgtgttggattcttggcttctaccccatgattctcctcaaagaaattgtgtgtgatgtgtgtgtgtgtgtgtgtgtgtgtgtgtctgtgtcacaggagatgcagtgcctgtacaggtgtgttcagtgtgtggatgtcattaacccatagggctatgcaacaaaagacacatttaatagaagtaaaacacacaagaccgctgcctggtctcggggttcagcatgattgtgaccaaacctttttatagaatttccttacctgaaggcacaacactctgaaactttaaagataacagagtattttattccaatagaataaaccaggaatctcggactgtgcatgtgatcactgtgctcctgttgcaaagtagaaggatgtgtattttgacactgacgttttgtctcttgttccccagcccccagcccatgttatcttgggtgtcgaatgtgtccattccatgcagaaccacagccatttccccaggcagtgttgggtcgagaatccacttttctaaacccacacagcctagctggcttgtctagactcttctaggcattggaattgatgaaaactacagggagcggggaaaggagacattatgtcttgttttcctgactttgggttttgtttctcactgtgtcttctccggctatcatatatgtcccctgaatctcatagtgagctgccaaatttgaagtgcatcacccagttgtctgcatctggaaccagtcaagcagtggctgtagtttgaacaagttatgtgtgcatgtaacatatatacatatatacatatatacaagtatgtgcatgataatgtatatcttcgtactttttgatacaatgtattcatttgttaatttttaattatatttgatataaatcaaaggtttgttgcaaaactttatatttaagaagtgttaaaaaaaaaaaaaagtcccaaccatgcaacacaactgggacctacttaaaaagaaattctgtgattgactagtttgctgcctgagtcatatttatcagccaaactttggattctgctgttgtttctacaatgacattttgtatgaagcaaagtccttgaattaaaataaaaacttagcaaaaaatcaaaaacaaaacccca

SEQ ID NO: 4200 - DNA, 303 bp, Homo sapiens
gacaacctggccaacgcccaagagctgaccaaggatgaagaggagatggaagaagcagccaatcagaagcttgctctgcaaaaggccaaagaagtggctgaagtcagccccatgtctgccgcgaacatctccatcgccgcttttgtaaagcaagctcgaggtactgtatctcgcagctcatctgtctccagcgtgaactcacccaggcagcagaactcggccaaggcgcgctcggtgtgggagcagcgggccagccagctacggctgcagaacctgcgggccagctgcgaggcgctgtacagc

SEQ ID NO: 4201 - DNA, 7158 bp, Homo sapiens
gcggcggcggctgcggcggtggggccgggcgaggtccgctgcggtcccggcggctccgtggctgctccgctctgagcgcctggcgcgccccgcgccctccctgccggggccgctgggccggggatgcacgcggggcccgggagccatggtccgcttcggggacgagctgggcggccgctatgggggccccggcggcggagagcgggcccggggcggcggggccggcggggcggggggcccgggtcccggggggctgcagcccggccagcgggtcctctacaagcaatcgatcgcgcagcgcgcgcggaccatggcgctgtacaaccccatcccggtcaagcagaactgcttcaccgtcaaccgctcgctcttcgtcttcagcgaggacaacgtcgtccgcaaatacgcgaagcgcatcaccgagtggcctccattcgagtatatgatcctggccaccatcatcgccaactgcatcgtgctggccctggagcagcacctccctgatggggacaaaacgcccatgtccgagcggctggacgacacggagccctatttcatcgggatcttttgcttcgaggcagggatcaaaatcatcgctctgggctttgtcttccacaagggctcttacctgcggaacggctggaacgtcatggacttcgtggtcgtcctcacagggatccttgccacggctggaactgacttcgacctgcgaacactgagggctgtgcgtgtgctgaggcccctgaagctggtgtctgggattccaagtttgcaggtggtgctcaagtccatcatgaaggccatggttccactcctgcagattgggctgcttctcttctttgccatcctcatgtttgccatcattggcctggagttctacatgggcaagttccacaaggcctgtttccccaacagcacagatgcggagcccgtgggtgacttcccctgtggcaaggaggccccagcccggctgtgcgagggcgacactgagtgccgggagtactggccaggacccaactttggcatcaccaactttgacaatatcctgtttgccatcttgacggtgttccagtgcatcaccatggagggctggactgacatcctctataatacaaacgatgcggccggcaacacctggaactggctctacttcatccctctcatcatcatcggctccttcttcatgctcaacctggtgctgggcgtgctctcgggggagtttgccaaggagcgagagagggtggagaaccgccgcgccttcctgaagctgcgccggcagcagcagatcgagcgagagctcaacgggtacctggagtggatcttcaaggcggaggaagtcatgctggccgaggaggacaggaatgcagaggagaagtcccctttggacgtgctgaagagagcggccaccaagaagagcagaaatgacctgatccacgcagaggagggagaggaccggtttgcagatctctgtgctgttggatcccccttcgcccgcgccagcctcaagagcgggaagacagagagctcgtcatacttccggaggaaggagaagatgttccggttttttatccggcgcatggtgaaggctcagagcttctactgggtggtgctgtgcgtggtggccctgaacacactgtgtgtggccatggtgcattacaaccagccgcggcggcttaccacgaccctgtattttgcagagtttgttttcctgggtctcttcctcacagagatgtccctgaagatgtatggcctggggcccagaagctacttccggtcctccttcaactgcttcgactttggggtcatcgtggggagcgtctttgaagtggtctgggcggccatcaagccgggaagctcctttgggatcagtgtgctgcgggccctccgcctgctgaggatcttcaaagtcacgaagtactggagctccctgcggaacctggtggtgtccctgctgaactccatgaagtccatcatcagcctgctcttcttgctcttcctgttcattgtggtcttcgccctgctggggatgcagctgtttgggggacagttcaacttccaggatgagactcccacaaccaacttcgacaccttccctgccgccatcctcactgtcttccagatcctgacgggagaggactggaatgcagtgatgtatcacgggatcgaatcgcaaggcggcgtcagcaaaggcatgttctcgtccttttacttcattgtcctgacactgttcggaaactacactctgctgaatgtctttctggccatcgctgtggacaacctggccaacgcccaagagctgaccaaggatgaagaggagatggaagaagcagccaatcagaagcttgctctgcaaaaggccaaagaagtggctgaagtcagccccatgtctgccgcgaacatctccatcgccgccaggcagcagaactcggccaaggcgcgctcggtgtgggagcagcgggccagccagctacggctgcagaacctgcgggccagctgcgaggcgctgtacagcgagatggaccccgaggagcggctgcgcttcgccactacgcgccacctgcggcccgacatgaagacgcacctggaccggccgctggtggtggagctgggccgcgacggcgcgcgggggcccgtgggaggcaaagcccgacctgaggctgcggaggcccccgagggcgtcgaccctccgcgcaggcaccaccggcaccgcgacaaggacaagacccccgcggcgggggaccaggaccgagcagaggccccgaaggcggagagcggggagcccggtgcccgggaggagcggccgcggccgcaccgcagccacagcaaggaggccgcggggcccccggaggcgcggagcgagcgcggccgaggcccaggccccgagggcggccggcggcaccaccggcgcggctccccggaggaggcggccgagcgggagccccgacgccaccgcgcgcaccggcaccaggatccgagcaaggagtgcgccggcgccaagggcgagcggcgcgcgcggcaccgcggcggcccccgagcggggccccgggaggcggagagcggggaggagccggcgcggcggcaccgggcccggcacaaggcgcagcctgctcacgaggctgtggagaaggagaccacggagaaggaggccacggagaaggaggctgagatagtggaagccgacaaggaaaaggagctccggaaccaccagccccgggagccacactgtgacctggagaccagtgggactgtgactgtgggtcccatgcacacactgcccagcacctgtctccagaaggtggaggaacagccagaggatgcagacaatcagcggaacgtcactcgcatgggcagtcagcccccagacccgaacactattgtacatatcccagtgatgctgacgggccctcttggggaagccacggtcgttcccagtggtaacgtggacctggaaagccaagcagaggggaagaaggaggtggaagcggatgacgtgatgaggagcggcccccggcctatcgtcccatacagctccatgttctgtttaagccccaccaacctgctccgccgcttctgccactacatcgtgaccatgaggtacttcgaggtggtcattctcgtggtcatcgccttgagcagcatcgccctggctgctgaggacccagtgcgcacagactcgcccaggaacaacgctctgaaatacctggattacattttcactggtgtctttacctttgagatggtgataaagatgatcgacttgggactgctgcttcaccctggagcctatttccgggacttgtggaacattctggacttcattgtggtcagtggcgccctggtggcgtttgctttctcaggatccaaagggaaagacatcaataccatcaagtctctgagagtccttcgtgtcctgcggcccctcaagaccatcaaacggctgcccaagctcaaggctgtgtttgactgtgtggtgaactccctgaagaatgtcctcaacatcttgattgtctacatgctcttcatgttcatatttgccgtcattgcggtgcagctcttcaaagggaagtttttctactgcacagatgaatccaaggagctggagagggactgcaggggtcagtatttggattatgagaaggaggaagtggaagctcagcccaggcagtggaagaaatacgactttcactacgacaatgtgctctgggctctgctgacgctgttcacagtgtccacgggagaaggctggcccatggtgctgaaacactccgtggatgccacctatgaggagcagggtccaagccctgggtaccgcatggagctgtccatcttctacgtggtctactttgtggtctttcccttcttcttcgtcaacatctttgtggctttgatcatcatcaccttccaggagcagggggacaaggtgatgtctgaatgcagcctggagaagaacgagagggcttgcattgacttcgccatcagcgccaaacccctgacacggtacatgccccaaaaccggcagtcgttccagtataagacgtggacatttgtggtctccccgccctttgaatacttcatcatggccatgatagccctcaacactgtggtgctgatgatgaagttctatgatgcaccctatgagtacgagctgatgctgaaatgcctgaacatcgtgttcacatccatgttctccatggaatgcgtgctgaagatcatcgcctttggggtgctgaactatttcagagatgcctggaatgtctttgactttgtcactgtgttgggaagtattactgatattttagtaacagagattgcggaaacgaacaatttcatcaacctcagcttcctccgcctctttcgagctgcgcggctgatcaagctgctccgccagggctacaccatccgcatcctgctgtggacctttgtccagtccttcaaggccctgccctacgtgtgtctgctcattgccatgctgttcttcatctacgccatcatcggcatgcaggtgtttgggaatattgccctggatgatgacaccagcatcaaccgccacaacaacttccggacgtttttgcaagccctgatgctgctgttcaggagcgccacgggggaggcctggcacgagatcatgctgtcctgcctgagcaaccaggcctgtgatgagcaggccaatgccaccgagtgtggaagtgactttgcctacttctacttcgtctccttcatcttcctgtgctcctttctgatgttgaacctctttgtggctgtgatcatggacaattttgagtacctcacgcgggactcttccatcctaggtcctcaccacttggatgagttcatccgggtctgggctgaatacgacccggctgcgtgtgggcgcatcagttacaatgacatgtttgagatgctgaaacacatgtccccgcctctggggctggggaagaaatgccctgctcgagttgcttacaagcgcctggttcgcatgaacatgcccatctccaacgaggacatgactgttcacttcacgtccacgctgatggccctcatccggacggcactggagatcaagctggccccagctgggacaaagcagcatcagtgtgacgcggagttgaggaaggagatttccgttgtgtgggccaatctgccccagaagactttggacttgctggtaccaccccataagcctgatgagatgacagtggggaaggtttatgcagctctgatgatattcgacttctacaagcagaacaaaaccaccagagaccagatgcagcaggctcctggaggcctctcccagatgggtcctgtgtccctgttccaccctctgaaggccaccctggagcagacacagccggctgtgctccgaggagcccgggttttccttcgacagaagagttccacctccctcagcaatggcggggccatacaaaaccaagagagtggcatcaaagagtctgtctcctggggcactcaaaggacccaggatgcaccccatgaggccaggccacccctggagcgtggccactccacagagatccctgtggggcggtcaggagcactggctgtggacgttcagatgcagagcataacccggaggggccctgatggggagccccagcctgggctggagagccagggtcgagcggcctccatgccccgccttgcggccgagactcagcccgtcacagatgccagccccatgaagcgctccatctccacgctggcccagcggccccgtgggactcatctttgcagcaccaccccggaccgcccaccccctagccaggcgtcgtcgcaccaccaccaccaccgctgccaccgccgcagggacaggaagcagaggtccctggagaaggggcccagcctgtctgccgatatggatggcgcaccaagcagtgctgtggggccggggctgcccccgggagaggggcctacaggctgccggcgggaacgagagcgccggcaggagcggggccggtcccaggagcggaggcagccctcatcctcctcctcggagaagcagcgcttctactcctgcgaccgctttgggggccgtgagcccccgaagcccaagccctccctcagcagccacccaacgtcgccaacagctggccaggagccgggaccccacccacaggccggctcagccgtgggctttccgaacacaacgccctgctgcagagagaccccctcagccagcccctggcccctggctctcgaattggctctgacccttacctggggcagcgtctggacagtgaggcctctgtccacgccctgcctgaggacactctcactttcgaggaggctgtggccaccaactcgggccgctcctccaggacttcctacgtgtcctccctgacctcccagtctcaccctctccgccgcgtgcccaacggttaccactgcaccctgggactcagctcgggtggccgagcacggcacagctaccaccaccctgaccaagaccactggtgctagctgcaccgtgaccgctcagacgcctgcatgcagcaggcgtgtgttccagtggatgagttttatcatccacacggggcagccggccctcgggggaggccttgcccaccttggtgaggctcctgtggcccctccctccccctcctcccctcttttactctagacgacgaataaagccctgtt

SEQ ID NO: 4202 - DNA, 9648 bp, Homo sapiens
atggtccgcttcggggacgagctgggcggccgctatgggggccccggcggcggagagcgggcccggggcggcggggccggcggggcggggggcccgggtcccggggggctgcagcccggccagcgggtcctctacaagcaatcgatcgcgcagcgcgcgcggaccatggcgctgtacaaccccatcccggtcaagcagaactgcttcaccgtcaaccgctcgctcttcgtcttcagcgaggacaacgtcgtccgcaaatacgcgaagcgcatcaccgagtggccaccattcgagtatatgatcctggccaccatcatcgccaactgcatcgtgctggccctggagcagcacctccctgatggggacaaaacgcccatgtccgagcggctggacgacacggagccctatttcatcgggatcttttgcttcgaggcagggatcaaaatcatcgctctgggctttgtcttccacaagggctcttacctgcggaacggctggaacgtcatggacttcgtggtcgtcctcacagggatccttgccacggctggaactgacttcgacctgcgaacactgagggctgtgcgtgtgctgaggcccctgaagctggtgtctgggattccaagtttgcaggtggtgctcaagtccatcatgaaggccatggttccactcctgcagattgggctgcttctcttctttgccatcctcatgtttgccatcattggcctggagttctacatgggcaagttccacaaggcctgtttccccaacagcacagatgcggagcccgtgggtgacttcccctgtggcaaggaggccccagcccggctgtgcgagggcgacactgagtgccgggagtactggccaggacccaactttggcatcaccaactttgacaatatcctgtttgccatcttgacggtgttccagtgcatcaccatggagggctggactgacatcctctataatacaaacgatgcggccggcaacacctggaactggctctacttcatccctctcatcatcatcggctccttcttcatgctcaacctggtgctgggcgtgctctcgggggagtttgccaaggagcgagagagggtggagaaccgccgcgccttcctgaagctgcgccggcagcagcagatcgagcgagagctcaacgggtacctggagtggatcttcaaggcggaggaagtcatgctggccgaggaggacaggaatgcagaggagaagtcccctttggacgcagtgctgaagagagcggccaccaagaagagcagaaatgacctgatccacgcagaggagggagaggaccggtttgcagatctctgtgctgttggatcccccttcgcccgcgccagcctcaagagcgggaagacagagagctcgtcatacttccggaggaaggagaagatgttccggttttttatccggcgcatggtgaaggctcagagcttctactgggtggtgctgtgcgtggtggccctgaacacactgtgtgtggccatggtgcattacaaccagccgcggcggcttaccacgaccctgtattttgcagagtttgttttcctgggtctcttcctcacagagatgtccctgaagatgtatggcctggggcccagaagctacttccggtcctccttcaactgcttcgactttggggtcatcgtggggagcgtctttgaagtggtctgggcggccatcaagccgggaagctcctttgggatcagtgtgctgcgggccctccgcctgctgaggatcttcaaagtcacgaagtactggagctccctgcggaacctggtggtgtccctgctgaactccatgaagtccatcatcagcctgctcttcttgctcttcctgttcattgtggtcttcgccctgctggggatgcagctgtttgggggacagttcaacttccaggatgagactcccacaaccaacttcgacaccttccctgccgccatcctcactgtcttccagatcctgacgggagaggactggaatgcagtgatgtatcacgggatcgaatcgcaaggcggcgtcagcaaaggcatgttctcgtccttttacttcattgtcctgacactgttcggaaactacactctgctgaatgtctttctggccatcgctgtggacaacctggccaacgcccaagagctgaccaaggatgaagaggagatggaagaagcagccaatcagaagcttgctctgcaaaaggccaaagaagtggctgaagtcagccccatgtctgccgcgaacatctccatcgccgccaggcagcagaactcggccaaggcgcgctcggtgtgggagcagcgggccagccagctacggctgcagaacctgcgggccagctgcgaggcgctgtacagcgagatggaccccgaggagcggctgcgcttcgccactacgcgccacctgcggcccgacatgaagacgcacctggaccggccgctggtggtggagctgggccgcgacggcgcgcgggggcccgtgggaggcaaagcccgacctgaggctgcggaggcccccgagggcgtcgaccctccgcgcaggcaccaccggcaccgcgacaaggacaagacccccgcggcgggggaccaggaccgagcagaggccccgaaggcggagagcggggagcccggtgcccgggaggagcggccgcggccgcaccgcagccacagcaaggaggccgcggggcccccggaggcgcggagcgagcgcggccgaggcccaggccccgagggcggccggcggcaccaccggcgcggctccccggaggaggcggccgagcgggagccccgacgccaccgcgcgcaccggcaccaggatccgagcaaggagtgcgccggcgccaagggcgagcggcgcgcgcggcaccgcggcggcccccgagcggggccccgggaggcggagagcggggaggagccggcgcggcggcaccgggcccggcacaaggcgcagcctgctcacgaggctgtggagaaggagaccacggagaaggaggccacggagaaggaggctgagatagtggaagccgacaaggaaaaggagctccggaaccaccagccccgggagccacactgtgacctggagaccagtgggactgtgactgtgggtcccatgcacacactgcccagcacctgtctccagaaggtggaggaacagccagaggatgcagacaatcagcggaacgtcactcgcatgggcagtcagcccccagacccgaacactattgtacatatcccagtgatgctgacgggccctcttggggaagccacggtcgttcccagtggtaacgtggacctggaaagccaagcagaggggaagaaggaggtggaagcggatgacgtgatgaggagcggcccccggcctatcgtcccatacagctccatgttctgtttaagccccaccaacctgctccgccgcttctgccactacatcgtgaccatgaggtacttcgaggtggtcattctcgtggtcatcgccttgagcagcatcgccctggctgctgaggacccagtgcgcacagactcgcccaggaacaacgctctgaaatacctggattacattttcactggtgtctttacctttgagatggtgataaagatgatcgacttgggactgctgcttcaccctggagcctatttccgggacttgtggaacattctggacttcattgtggtcagtggcgccctggtggcgtttgctttctcaggatccaaagggaaagacatcaataccatcaagtctctgagagtccttcgtgtcctgcggcccctcaagaccatcaaacggctgcccaagctcaaggctgtgtttgactgtgtggtgaactccctgaagaatgtcctcaacatcttgattgtctacatgctcttcatgttcatatttgccgtcattgcggtgcagctcttcaaagggaagtttttctactgcacagatgaatccaaggagctggagagggactgcaggggtcagtatttggattatgagaaggaggaagtggaagctcagcccaggcagtggaagaaatacgactttcactacgacaatgtgctctgggctctgctgacgctgttcacagtgtccacgggagaaggctggcccatggtgctgaaacactccgtggatgccacctatgaggagcagggtccaagccctgggtaccgcatggagctgtccatcttctacgtggtctactttgtggtctttcccttcttcttcgtcaacatctttgtggctttgatcatcatcaccttccaggagcagggggacaaggtgatgtctgaatgcagcctggagaagaacgagagggcttgcattgacttcgccatcagcgccaaacccctgacacggtacatgccccaaaaccggcagtcgttccagtataagacgtggacatttgtggtctccccgccctttgaatacttcatcatggccatgatagccctcaacactgtggtgctgatgatgaagttctatgatgcaccctatgagtacgagctgatgctgaaatgcctgaacatcgtgttcacatccatgttctccatggaatgcgtgctgaagatcatcgcctttggggtgctgaactatttcagagatgcctggaatgtctttgactttgtcactgtgttgggaagtattactgatattttagtaacagagattgcggaaacaaacaatttcatcaacctcagcttcctccgcctctttcgagctgcgcggctgatcaagctgctccgccagggctacaccatccgcatcctgctgtggacctttgtccagtccttcaaggccctgccctacgtgtgtctgctcattgccatgctgttcttcatctacgccatcatcggcatgcaggtgtttgggaatattgccctggatgatgacaccagcatcaaccgccacaacaacttccggacgtttttgcaagccctgatgctgctgttcaggagcgccacgggggaggcctggcacgagatcatgctgtcctgcctgagcaaccaggcctgtgatgagcaggccaatgccaccgagtgtggaagtgactttgcctacttctacttcgtctccttcatcttcctgtgctcctttctgatgttgaacctctttgtggctgtgatcatggacaattttgagtacctcacgcgggactcttccatcctaggtcctcaccacttggatgagttcatccgggtctgggctgaatacgacccggctgcgtgtgggcgcatcagttacaatgacatgtttgagatgctgaaacacatgtccccgcctctggggctggggaagaaatgccctgctcgagttgcttacaagcgcctggttcgcatgaacatgcccatctccaacgaggacatgactgttcacttcacgtccacgctgatggccctcatccggacggcactggagatcaagctggccccagctgggacaaagcagcatcagtgtgacgcggagttgaggaaggagatttccgttgtgtgggccaatctgccccagaagactttggacttgctggtaccaccccataagcctgatgagatgacagtggggaaggtttatgcagctctgatgatattcgacttctacaagcagaacaaaaccaccagagaccagatgcagcaggctcctggaggcctctcccagatgggtcctgtgtccctgttccaccctctgaaggccaccctggagcagacacagccggctgtgctccgaggagcccgggttttccttcgacagaagagttccacctccctcagcaatggcggggccatacaaaaccaagagagtggcatcaaagagtctgtctcctggggcactcaaaggacccaggatgcaccccatgaggccaggccacccctggagcgtggccactccacagagatccctgtggggcggtcaggagcactggctgtggacgttcagatgcagagcataacccggaggggccctgatggggagccccagcctgggctggagagccagggtcgagcggcctccatgccccgccttgcggccgagactcagcccgtcacagatgccagccccatgaagcgctccatctccacgctggcccagcggccccgtgggactcatctttgcagcaccaccccggaccgcccaccccctagccaggcgtcgtcgcaccaccaccaccaccgctgccaccgccgcagggacaggaagcagaggtccctggagaaggggcccagcctgtctgccgatatggatggcgcaccaagcagtgctgtggggccggggctgcccccgggagaggggcctacaggctgccggcgggaacgagagcgccggcaggagcggggccggtcccaggagcggaggcagccctcatcctcctcctcggagaagcagcgcttctactcctgcgaccgctttgggggccgtgagcccccgaagcccaagccctccctcagcagccacccaacgtcgccaacagctggccaggagccgggaccccacccacagggcagtggttccgtgaatgggagccccttgctgtcaacatctggtgctagcacccccggccgcggtgggcggaggcagctcccccagacgcccctgactccccgccccagcatcacctacaagacggccaactcctcacccatccacttcgccggggctcagaccagcctccctgccttctccccaggccggctcagccgtgggctttccgaacacaacgccctgctgcagagagaccccctcagccagcccctggcccctggctctcgaattggctctgacccttacctggggcagcgtctggacagtgaggcctctgtccacgccctgcctgaggacactctcactttcgaggaggctgtggccaccaactcgggccgctcctccaggacttcctacgtgtcctccctgacctcccagtctcaccctctccgccgcgtgcccaacggttaccactgcaccctgggactcagctcgggtggccgagcacggcacagctaccaccaccctgaccaagaccactggtgctagctgcaccgtgaccgctcagacgcctgcatgcagcaggcgtgtgttccagtggatgagttttatcatccacacggggcagccggccctcgggggaggccttgcccaccttggtgaggctcctgtggcccctccctccccctcctcccctcttttactctagacgacgaataaagccctgttagaggatgcggctctctctgtccccttcctgtcctgccttcctgggtctcgtaccacacaccagaccctaaaccgcaggctgctgtgtgtggctgagaaggacccaggagtccaaatcccgtgtcctgggactcagcatccagcatgggtgcttggagccgttgtgaggagctctgcgtcctgtggggagcacccttcacgtggccgtgcggcacagagaagcagggcccacctgaaagtgcgccgagacctcgggacggaggggatggggagggggacacagtcgtggcttgtgcagcccgccagtgtcagcgaatgctcactcaggcaagctctgtcctccctggacaccgtcagccccacaggaaccgagctgggaagtgttcttgctgtggttgtgatttttaattgcaacacctctcattcttgtcacttctatatacgtgatgtagaaaaaatggaaaaccagaaaaatggggaaggaaatgttcacataactttaaaaaatcaaacctgtgaaagaaagatgtcagctttttgccacgtgtctttgtggcttatgcgaggagactccctgtgcagccctgtccggtccaggtggacgtagacggcccctggctctgctgctcttgaccaagtgcctgaccgccaggccctcacacccaggctcctgggcactgtggtgtgaggcgaggcctcgggatccatcaccgcaggatgctgtgaaaagtactcgcgatggcagccaggtagcaagcccttgccagtggagagcactggatgtcatggtggcaaacaaggcagccatttgctgtcctcctcccacgagtggaaggggtttccaaggaagccacagggcagctgaccacgtgcttgtgtgaggcattttcagtctgttctgcatatgattctcagggcacactctgtggtatgtgaaataggtttccttccacatacagcagaagagaggcaaaggctggtaggaaggaggaagacattggctgggggcttggatgtggggccgtcagggcaggagggaggaagccccagctggaatgaaactcagagcaagtgaccgagggaggacacggctcctgccactgaggccgggcacctgatgcccagcactgtcctggcgccagacacagggagcaggcagtcaagtgaggtctgacccccatggccacgctcaggagagaaagaccatgctcaggacactgtccaaggtgcacaagatgctgggaggtcccttgtttggtgaagaaagggagcatttagagcagttgatggtggtgtgtcctccgtgttctgaaattccagatgatctgtgttggattcttggcttctaccccatgattctcctcaaagaaattgtgtgtgatgtgtgtgtgtgtgtgtgtgtgtgtgtgtctgtgtcacaggagatgcagtgcctgtacaggtgtgttcagtgtgtggatgtcattaacccatagggctatgcaacaaaagacacatttaatagaagtaaaacacacaagaccgctgcctggtctcggggttcagcatgattgtgaccaaacctttttatagaatttccttacctgaaggcacaacactctgaaactttaaagataacagagtattttattccaatagaataaaccaggaatctcggactgtgcatgtgatcactgtgctcctgttgcaaagtagaaggatgtgtattttgacactgacgttttgtctcttgttccccagcccccagcccatgttatcttgggtgtcgaatgtgtccattccatgcagaaccacagccatttccccaggcagtgttgggtcgagaatccacttttctaaacccacacagcctagctggcttgtctagactcttctaggcattggaattgatgaaaactacagggagcggggaaaggagacattatgtcttgttttcctgactttgggttttgtttctcactgtgtcttctccggctatcatatatgtcccctgaatctcatagtgagctgccaaatttgaagtgcatcacccagttgtctgcatctggaaccagtcaagcagtggctgtagtttgaacaagttatgtgtgcatgtaacatatatacatatatacatatatacaagtatgtgcatgataatgtatatcttcgtactttttgatacaatgtattcatttgttaatttttaattatatttgatataaatcaaaggtttgttgcaaaactttatatttaagaagtgttaaaaaaaaaaaaaagtcccaaccatgcaacacaactgggacctacttaaaaagaaattctgtgattgactagtttgctgcctgagtcatatttatcagccaaactttggattctgctgttgtttctacaatgacattttgtatgaagcaaagtccttgaattaaaataaaaacttagcaaaaaatcaaaaacaaaacccca

SEQ ID NO: 4203 - DNA, 9642 bp, Homo sapiens
atggtccgcttcggggacgagctgggcggccgctatgggggccccggcggcggagagcgggcccggggcggcggggccggcggggcggggggcccgggtcccggggggctgcagcccggccagcgggtcctctacaagcaatcgatcgcgcagcgcgcgcggaccatggcgctgtacaaccccatcccggtcaagcagaactgcttcaccgtcaaccgctcgctcttcgtcttcagcgaggacaacgtcgtccgcaaatacgcgaagcgcatcaccgagtggcctccattcgagtatatgatcctggccaccatcatcgccaactgcatcgtgctggccctggagcagcacctccctgatggggacaaaacgcccatgtccgagcggctggacgacacggagccctatttcatcgggatcttttgcttcgaggcagggatcaaaatcatcgctctgggctttgtcttccacaagggctcttacctgcggaacggctggaacgtcatggacttcgtggtcgtcctcacagggatccttgccacggctggaactgacttcgacctgcgaacactgagggctgtgcgtgtgctgaggcccctgaagctggtgtctgggattccaagtttgcaggtggtgctcaagtccatcatgaaggccatggttccactcctgcagattgggctgcttctcttctttgccatcctcatgtttgccatcattggcctggagttctacatgggcaagttccacaaggcctgtttccccaacagcacagatgcggagcccgtgggtgacttcccctgtggcaaggaggccccagcccggctgtgcgagggcgacactgagtgccgggagtactggccaggacccaactttggcatcaccaactttgacaatatcctgtttgccatcttgacggtgttccagtgcatcaccatggagggctggactgacatcctctataatacaaacgatgcggccggcaacacctggaactggctctacttcatccctctcatcatcatcggctccttcttcatgctcaacctggtgctgggcgtgctctcgggggagtttgccaaggagcgagagagggtggagaaccgccgcgccttcctgaagctgcgccggcagcagcagatcgagcgagagctcaacgggtacctggagtggatcttcaaggcggaggaagtcatgctggccgaggaggacaggaatgcagaggagaagtcccctttggacgcagtgctgaagagagcggccaccaagaagagcagaaatgacctgatccacgcagaggagggagaggaccggtttgcagatctctgtgctgttggatcccccttcgcccgcgccagcctcaagagcgggaagacagagagctcgtcatacttccggaggaaggagaagatgttccggttttttatccggcgcatggtgaaggctcagagcttctactgggtggtgctgtgcgtggtggccctgaacacactgtgtgtggccatggtgcattacaaccagccgcggcggcttaccacgaccctgtattttgcagagtttgttttcctgggtctcttcctcacagagatgtccctgaagatgtatggcctggggcccagaagctacttccggtcctccttcaactgcttcgactttggggtcatcgtggggagcgtctttgaagtggtctgggcggccatcaagccgggaagctcctttgggatcagtgtgctgcgggccctccgcctgctgaggatcttcaaagtcacgaagtactggagctccctgcggaacctggtggtgtccctgctgaactccatgaagtccatcatcagcctgctcttcttgctcttcctgttcattgtggtcttcgccctgctggggatgcagctgtttgggggacagttcaacttccaggatgagactcccacaaccaacttcgacaccttccctgccgccatcctcactgtcttccagatcctgacgggagaggactggaatgcagtgatgtatcacgggatcgaatcgcaaggcggcgtcagcaaaggcatgttctcgtccttttacttcattgtcctgacactgttcggaaactacactctgctgaatgtctttctggccatcgctgtggacaacctggccaacgcccaagagctgaccaaggatgaagaggagatggaagaagcagccaatcagaagcttgctctgcaaaaggccaaagaagtggctgaagtcagccccatgtctgccgcgaacatctccatcgccgccaggcagcagaactcggccaaggcgcgctcggtgtgggagcagcgggccagccagctacggctgcagaacctgcgggccagctgcgaggcgctgtacagcgagatggaccccgaggagcggctgcgcttcgccactacgcgccacctgcggcccgacatgaagacgcacctggaccggccgctggtggtggagctgggccgcgacggcgcgcgggggcccgtgggaggcaaagcccgacctgaggctgcggaggcccccgagggcgtcgaccctccgcgcaggcaccaccggcaccgcgacaaggacaagacccccgcggcgggggaccaggaccgagcagaggccccgaaggcggagagcggggagcccggtgcccgggaggagcggccgcggccgcaccgcagccacagcaaggaggccgcggggcccccggaggcgcggagcgagcgcggccgaggcccaggccccgagggcggccggcggcaccaccggcgcggctccccggaggaggcggccgagcgggagccccgacgccaccgcgcgcaccggcaccaggatccgagcaaggagtgcgccggcgccaagggcgagcggcgcgcgcggcaccgcggcggcccccgagcggggccccgggaggcggagagcggggaggagccggcgcggcggcaccgggcccggcacaaggcgcagcctgctcacgaggctgtggagaaggagaccacggagaaggaggccacggagaaggaggctgagatagtggaagccgacaaggaaaaggagctccggaaccaccagccccgggagccacactgtgacctggagaccagtgggactgtgactgtgggtcccatgcacacactgcccagcacctgtctccagaaggtggaggaacagccagaggatgcagacaatcagcggaacgtcactcgcatgggcagtcagcccccagacccgaacactattgtacatatcccagtgatgctgacgggccctcttggggaagccacggtcgttcccagtggtaacgtggacctggaaagccaagcagaggggaagaaggaggtggaagcggatgacgtgatgaggagcggcccccggcctatcgtcccatacagctccatgttctgtttaagccccaccaacctgctccgccgcttctgccactacatcgtgaccatgaggtacttcgaggtggtcattctcgtggtcatcgccttgagcagcatcgccctggctgctgaggacccagtgcgcacagactcgcccaggaacaacgctctgaaatacctggattacattttcactggtgtctttacctttgagatggtgataaagatgatcgacttgggactgctgcttcaccctggagcctatttccgggacttgtggaacattctggacttcattgtggtcagtggcgccctggtggcgtttgctttctcaggatccaaagggaaagacatcaataccatcaagtctctgagagtccttcgtgtcctgcggcccctcaagaccatcaaacggctgcccaagctcaaggctgtgtttgactgtgtggtgaactccctgaagaatgtcctcaacatcttgattgtctacatgctcttcatgttcatatttgccgtcattgcggtgcagctcttcaaagggaagtttttctactgcacagatgaatccaaggagctggagagggactgcaggggtcagtatttggattatgagaaggaggaagtggaagctcagcccaggcagtggaagaaatacgactttcactacgacaatgtgctctgggctctgctgacgctgttcacagtgtccacgggagaaggctggcccatggtgctgaaacactccgtggatgccacctatgaggagcagggtccaagccctgggtaccgcatggagctgtccatcttctacgtggtctactttgtggtctttcccttcttcttcgtcaacatctttgtggctttgatcatcatcaccttccaggagcagggggacaaggtgatgtctgaatgcagcctggagaagaacgagagggcttgcattgacttcgccatcagcgccaaacccctgacacggtacatgccccaaaaccggcagtcgttccagtataagacgtggacatttgtggtctccccgccctttgaatacttcatcatggccatgatagccctcaacactgtggtgctgatgatgaagttctatgatgcaccctatgagtacgagctgatgctgaaatgcctgaacatcgtgttcacatccatgttctccatggaatgcgtgctgaagatcatcgcctttggggtgctgaactatttcagagatgcctggaatgtctttgactttgtcactgtgttgggaagtattactgatattttagtaacagagattgcgaacaatttcatcaacctcagcttcctccgcctctttcgagctgcgcggctgatcaagctgctccgccagggctacaccatccgcatcctgctgtggacctttgtccagtccttcaaggccctgccctacgtgtgtctgctcattgccatgctgttcttcatctacgccatcatcggcatgcaggtgtttgggaatattgccctggatgatgacaccagcatcaaccgccacaacaacttccggacgtttttgcaagccctgatgctgctgttcaggagcgccacgggggaggcctggcacgagatcatgctgtcctgcctgagcaaccaggcctgtgatgagcaggccaatgccaccgagtgtggaagtgactttgcctacttctacttcgtctccttcatcttcctgtgctcctttctgatgttgaacctctttgtggctgtgatcatggacaattttgagtacctcacgcgggactcttccatcctaggtcctcaccacttggatgagttcatccgggtctgggctgaatacgacccggctgcgtgtgggcgcatcagttacaatgacatgtttgagatgctgaaacacatgtccccgcctctggggctggggaagaaatgccctgctcgagttgcttacaagcgcctggttcgcatgaacatgcccatctccaacgaggacatgactgttcacttcacgtccacgctgatggccctcatccggacggcactggagatcaagctggccccagctgggacaaagcagcatcagtgtgacgcggagttgaggaaggagatttccgttgtgtgggccaatctgccccagaagactttggacttgctggtaccaccccataagcctgatgagatgacagtggggaaggtttatgcagctctgatgatattcgacttctacaagcagaacaaaaccaccagagaccagatgcagcaggctcctggaggcctctcccagatgggtcctgtgtccctgttccaccctctgaaggccaccctggagcagacacagccggctgtgctccgaggagcccgggttttccttcgacagaagagttccacctccctcagcaatggcggggccatacaaaaccaagagagtggcatcaaagagtctgtctcctggggcactcaaaggacccaggatgcaccccatgaggccaggccacccctggagcgtggccactccacagagatccctgtggggcggtcaggagcactggctgtggacgttcagatgcagagcataacccggaggggccctgatggggagccccagcctgggctggagagccagggtcgagcggcctccatgccccgccttgcggccgagactcagcccgtcacagatgccagccccatgaagcgctccatctccacgctggcccagcggccccgtgggactcatctttgcagcaccaccccggaccgcccaccccctagccaggcgtcgtcgcaccaccaccaccaccgctgccaccgccgcagggacaggaagcagaggtccctggagaaggggcccagcctgtctgccgatatggatggcgcaccaagcagtgctgtggggccggggctgcccccgggagaggggcctacaggctgccggcgggaacgagagcgccggcaggagcggggccggtcccaggagcggaggcagccctcatcctcctcctcggagaagcagcgcttctactcctgcgaccgctttgggggccgtgagcccccgaagcccaagccctccctcagcagccacccaacgtcgccaacagctggccaggagccgggaccccacccacagggcagtggttccgtgaatgggagccccttgctgtcaacatctggtgctagcacccccggccgcggtgggcggaggcagctcccccagacgcccctgactccccgccccagcatcacctacaagacggccaactcctcacccatccacttcgccggggctcagaccagcctccctgccttctccccaggccggctcagccgtgggctttccgaacacaacgccctgctgcagagagaccccctcagccagcccctggcccctggctctcgaattggctctgacccttacctggggcagcgtctggacagtgaggcctctgtccacgccctgcctgaggacactctcactttcgaggaggctgtggccaccaactcgggccgctcctccaggacttcctacgtgtcctccctgacctcccagtctcaccctctccgccgcgtgcccaacggttaccactgcaccctgggactcagctcgggtggccgagcacggcacagctaccaccaccctgaccaagaccactggtgctagctgcaccgtgaccgctcagacgcctgcatgcagcaggcgtgtgttccagtggatgagttttatcatccacacggggcagccggccctcgggggaggccttgcccaccttggtgaggctcctgtggcccctccctccccctcctcccctcttttactctagacgacgaataaagccctgttagaggatgcggctctctctgtccccttcctgtcctgccttcctgggtctcgtaccacacaccagaccctaaaccgcaggctgctgtgtgtggctgagaaggacccaggagtccaaatcccgtgtcctgggactcagcatccagcatgggtgcttggagccgttgtgaggagctctgcgtcctgtggggagcacccttcacgtggccgtgcggcacagagaagcagggcccacctgaaagtgcgccgagacctcgggacggaggggatggggagggggacacagtcgtggcttgtgcagcccgccagtgtcagcgaatgctcactcaggcaagctctgtcctccctggacaccgtcagccccacaggaaccgagctgggaagtgttcttgctgtggttgtgatttttaattgcaacacctctcattcttgtcacttctatatacgtgatgtagaaaaaatggaaaaccagaaaaatggggaaggaaatgttcacataactttaaaaaatcaaacctgtgaaagaaagatgtcagctttttgccacgtgtctttgtggcttatgcgaggagactccctgtgcagccctgtccggtccaggtggacgtagacggcccctggctctgctgctcttgaccaagtgcctgaccgccaggccctcacacccaggctcctgggcactgtggtgtgaggcgaggcctcgggatccatcaccgcaggatgctgtgaaaagtactcgcgatggcagccaggtagcaagcccttgccagtggagagcactggatgtcatggtggcaaacaaggcagccatttgctgtcctcctcccacgagtggaaggggtttccaaggaagccacagggcagctgaccacgtgcttgtgtgaggcattttcagtctgttctgcatatgattctcagggcacactctgtggtatgtgaaataggtttccttccacatacagcagaagagaggcaaaggctggtaggaaggaggaagacattggctgggggcttggatgtggggccgtcagggcaggagggaggaagccccagctggaatgaaactcagagcaagtgaccgagggaggacacggctcctgccactgaggccgggcacctgatgcccagcactgtcctggcgccagacacagggagcaggcagtcaagtgaggtctgacccccatggccacgctcaggagagaaagaccatgctcaggacactgtccaaggtgcacaagatgctgggaggtcccttgtttggtgaagaaagggagcatttagagcagttgatggtggtgtgtcctccgtgttctgaaattccagatgatctgtgttggattcttggcttctaccccatgattctcctcaaagaaattgtgtgtgatgtgtgtgtgtgtgtgtgtgtgtgtgtgtctgtgtcacaggagatgcagtgcctgtacaggtgtgttcagtgtgtggatgtcattaacccatagggctatgcaacaaaagacacatttaatagaagtaaaacacacaagaccgctgcctggtctcggggttcagcatgattgtgaccaaacctttttatagaatttccttacctgaaggcacaacactctgaaactttaaagataacagagtattttattccaatagaataaaccaggaatctcggactgtgcatgtgatcactgtgctcctgttgcaaagtagaaggatgtgtattttgacactgacgttttgtctcttgttccccagcccccagcccatgttatcttgggtgtcgaatgtgtccattccatgcagaaccacagccatttccccaggcagtgttgggtcgagaatccacttttctaaacccacacagcctagctggcttgtctagactcttctaggcattggaattgatgaaaactacagggagcggggaaaggagacattatgtcttgttttcctgactttgggttttgtttctcactgtgtcttctccggctatcatatatgtcccctgaatctcatagtgagctgccaaatttgaagtgcatcacccagttgtctgcatctggaaccagtcaagcagtggctgtagtttgaacaagttatgtgtgcatgtaacatatatacatatatacatatatacaagtatgtgcatgataatgtatatcttcgtactttttgatacaatgtattcatttgttaatttttaattatatttgatataaatcaaaggtttgttgcaaaactttatatttaagaagtgttaaaaaaaaaaaaaagtcccaaccatgcaacacaactgggacctacttaaaaagaaattctgtgattgactagtttgctgcctgagtcatatttatcagccaaactttggattctgctgttgtttctacaatgacattttgtatgaagcaaagtccttgaattaaaataaaaacttagcaaaaaatcaaaaacaaaacccca

SEQ ID NO: 4204 - DNA, 9758 bp, Homo sapiens
gggcgaggtccgctgcggtcccggcggctccgtggctgctccgctctgagcgcctggcgcgccccgcgccctccctgccggggccgctgggccggggatgcacgcggggcccgggagccatggtccgcttcggggacgagctgggcggccgctatgggggccccggcggcggagagcgggcccggggcggcggggccggcggggcggggggcccgggtcccggggggctgcagcccggccagcgggtcctctacaagcaatcgatcgcgcagcgcgcgcggaccatggcgctgtacaaccccatcccggtcaagcagaactgcttcaccgtcaaccgctcgctcttcgtcttcagcgaggacaacgtcgtccgcaaatacgcgaagcgcatcaccgagtggcctccattcgagtatatgatcctggccaccatcatcgccaactgcatcgtgctggccctggagcagcacctccctgatggggacaaaacgcccatgtccgagcggctggacgacacggagccctatttcatcgggatcttttgcttcgaggcagggatcaaaatcatcgctctgggctttgtcttccacaagggctcttacctgcggaacggctggaacgtcatggacttcgtggtcgtcctcacagggatccttgccacggctggaactgacttcgacctgcgaacactgagggctgtgcgtgtgctgaggcccctgaagctggtgtctgggattccaagtttgcaggtggtgctcaagtccatcatgaaggccatggttccactcctgcagattgggctgcttctcttctttgccatcctcatgtttgccatcattggcctggagttctacatgggcaagttccacaaggcctgtttccccaacagcacagatgcggagcccgtgggtgacttcccctgtggcaaggaggccccagcccggctgtgcgagggcgacactgagtgccgggagtactggccaggacccaactttggcatcaccaactttgacaatatcctgtttgccatcttgacggtgttccagtgcatcaccatggagggctggactgacatcctctataatacaaacgatgcggccggcaacacctggaactggctctacttcatccctctcatcatcatcggctccttcttcatgctcaacctggtgctgggcgtgctctcgggggagtttgccaaggagcgagagagggtggagaaccgccgcgccttcctgaagctgcgccggcagcagcagatcgagcgagagctcaacgggtacctggagtggatcttcaaggcggaggaagtcatgctggccgaggaggacaggaatgcagaggagaagtcccctttggacgtgctgaagagagcggccaccaagaagagcagaaatgacctgatccacgcagaggagggagaggaccggtttgcagatctctgtgctgttggatcccccttcgcccgcgccagcctcaagagcgggaagacagagagctcgtcatacttccggaggaaggagaagatgttccggttttttatccggcgcatggtgaaggctcagagcttctactgggtggtgctgtgcgtggtggccctgaacacactgtgtgtggccatggtgcattacaaccagccgcggcggcttaccacgaccctgtattttgcagagtttgttttcctgggtctcttcctcacagagatgtccctgaagatgtatggcctggggcccagaagctacttccggtcctccttcaactgcttcgactttggggtcatcgtggggagcgtctttgaagtggtctgggcggccatcaagccgggaagctcctttgggatcagtgtgctgcgggccctccgcctgctgaggatcttcaaagtcacgaagtactggagctccctgcggaacctggtggtgtccctgctgaactccatgaagtccatcatcagcctgctcttcttgctcttcctgttcattgtggtcttcgccctgctggggatgcagctgtttgggggacagttcaacttccaggatgagactcccacaaccaacttcgacaccttccctgccgccatcctcactgtcttccagatcctgacgggagaggactggaatgcagtgatgtatcacgggatcgaatcgcaaggcggcgtcagcaaaggcatgttctcgtccttttacttcattgtcctgacactgttcggaaactacactctgctgaatgtctttctggccatcgctgtggacaacctggccaacgcccaagagctgaccaaggatgaagaggagatggaagaagcagccaatcagaagcttgctctgcaaaaggccaaagaagtggctgaagtcagccccatgtctgccgcgaacatctccatcgccgccaggcagcagaactcggccaaggcgcgctcggtgtgggagcagcgggccagccagctacggctgcagaacctgcgggccagctgcgaggcgctgtacagcgagatggaccccgaggagcggctgcgcttcgccactacgcgccacctgcggcccgacatgaagacgcacctggaccggccgctggtggtggagctgggccgcgacggcgcgcgggggcccgtgggaggcaaagcccgacctgaggctgcggaggcccccgagggcgtcgaccctccgcgcaggcaccaccggcaccgcgacaaggacaagacccccgcggcgggggaccaggaccgagcagaggccccgaaggcggagagcggggagcccggtgcccgggaggagcggccgcggccgcaccgcagccacagcaaggaggccgcggggcccccggaggcgcggagcgagcgcggccgaggcccaggccccgagggcggccggcggcaccaccggcgcggctccccggaggaggcggccgagcgggagccccgacgccaccgcgcgcaccggcaccaggatccgagcaaggagtgcgccggcgccaagggcgagcggcgcgcgcggcaccgcggcggcccccgagcggggccccgggaggcggagagcggggaggagccggcgcggcggcaccgggcccggcacaaggcgcagcctgctcacgaggctgtggagaaggagaccacggagaaggaggccacggagaaggaggctgagatagtggaagccgacaaggaaaaggagctccggaaccaccagccccgggagccacactgtgacctggagaccagtgggactgtgactgtgggtcccatgcacacactgcccagcacctgtctccagaaggtggaggaacagccagaggatgcagacaatcagcggaacgtcactcgcatgggcagtcagcccccagacccgaacactattgtacatatcccagtgatgctgacgggccctcttggggaagccacggtcgttcccagtggtaacgtggacctggaaagccaagcagaggggaagaaggaggtggaagcggatgacgtgatgaggagcggcccccggcctatcgtcccatacagctccatgttctgtttaagccccaccaacctgctccgccgcttctgccactacatcgtgaccatgaggtacttcgaggtggtcattctcgtggtcatcgccttgagcagcatcgccctggctgctgaggacccagtgcgcacagactcgcccaggaacaacgctctgaaatacctggattacattttcactggtgtctttacctttgagatggtgataaagatgatcgacttgggactgctgcttcaccctggagcctatttccgggacttgtggaacattctggacttcattgtggtcagtggcgccctggtggcgtttgctttctcaggatccaaagggaaagacatcaataccatcaagtctctgagagtccttcgtgtcctgcggcccctcaagaccatcaaacggctgcccaagctcaaggctgtgtttgactgtgtggtgaactccctgaagaatgtcctcaacatcttgattgtctacatgctcttcatgttcatatttgccgtcattgcggtgcagctcttcaaagggaagtttttctactgcacagatgaatccaaggagctggagagggactgcaggggtcagtatttggattatgagaaggaggaagtggaagctcagcccaggcagtggaagaaatacgactttcactacgacaatgtgctctgggctctgctgacgctgttcacagtgtccacgggagaaggctggcccatggtgctgaaacactccgtggatgccacctatgaggagcagggtccaagccctgggtaccgcatggagctgtccatcttctacgtggtctactttgtggtctttcccttcttcttcgtcaacatctttgtggctttgatcatcatcaccttccaggagcagggggacaaggtgatgtctgaatgcagcctggagaagaacgagagggcttgcattgacttcgccatcagcgccaaacccctgacacggtacatgccccaaaaccggcagtcgttccagtataagacgtggacatttgtggtctccccgccctttgaatacttcatcatggccatgatagccctcaacactgtggtgctgatgatgaagttctatgatgcaccctatgagtacgagctgatgctgaaatgcctgaacatcgtgttcacatccatgttctccatggaatgcgtgctgaagatcatcgcctttggggtgctgaactatttcagagatgcctggaatgtctttgactttgtcactgtgttgggaagtattactgatattttagtaacagagattgcgaacaatttcatcaacctcagcttcctccgcctctttcgagctgcgcggctgatcaagctgctccgccagggctacaccatccgcatcctgctgtggacctttgtccagtccttcaaggccctgccctacgtgtgtctgctcattgccatgctgttcttcatctacgccatcatcggcatgcaggtgtttgggaatattgccctggatgatgacaccagcatcaaccgccacaacaacttccggacgtttttgcaagccctgatgctgctgttcaggagcgccacgggggaggcctggcacgagatcatgctgtcctgcctgagcaaccaggcctgtgatgagcaggccaatgccaccgagtgtggaagtgactttgcctacttctacttcgtctccttcatcttcctgtgctcctttctgatgttgaacctctttgtggctgtgatcatggacaattttgagtacctcacgcgggactcttccatcctaggtcctcaccacttggatgagttcatccgggtctgggctgaatacgacccggctgcgtgtgggcgcatcagttacaatgacatgtttgagatgctgaaacacatgtccccgcctctggggctggggaagaaatgccctgctcgagttgcttacaagcgcctggttcgcatgaacatgcccatctccaacgaggacatgactgttcacttcacgtccacgctgatggccctcatccggacggcactggagatcaagctggccccagctgggacaaagcagcatcagtgtgacgcggagttgaggaaggagatttccgttgtgtgggccaatctgccccagaagactttggacttgctggtaccaccccataagcctgatgagatgacagtggggaaggtttatgcagctctgatgatattcgacttctacaagcagaacaaaaccaccagagaccagatgcagcaggctcctggaggcctctcccagatgggtcctgtgtccctgttccaccctctgaaggccaccctggagcagacacagccggctgtgctccgaggagcccgggttttccttcgacagaagagttccacctccctcagcaatggcggggccatacaaaaccaagagagtggcatcaaagagtctgtctcctggggcactcaaaggacccaggatgcaccccatgaggccaggccacccctggagcgtggccactccacagagatccctgtggggcggtcaggagcactggctgtggacgttcagatgcagagcataacccggaggggccctgatggggagccccagcctgggctggagagccagggtcgagcggcctccatgccccgccttgcggccgagactcagcccgtcacagatgccagccccatgaagcgctccatctccacgctggcccagcggccccgtgggactcatctttgcagcaccaccccggaccgcccaccccctagccaggcgtcgtcgcaccaccaccaccaccgctgccaccgccgcagggacaggaagcagaggtccctggagaaggggcccagcctgtctgccgatatggatggcgcaccaagcagtgctgtggggccggggctgcccccgggagaggggcctacaggctgccggcgggaacgagagcgccggcaggagcggggccggtcccaggagcggaggcagccctcatcctcctcctcggagaagcagcgcttctactcctgcgaccgctttgggggccgtgagcccccgaagcccaagccctccctcagcagccacccaacgtcgccaacagctggccaggagccgggaccccacccacagggcagtggttccgtgaatgggagccccttgctgtcaacatctggtgctagcacccccggccgcggtgggcggaggcagctcccccagacgcccctgactccccgccccagcatcacctacaagacggccaactcctcacccatccacttcgccggggctcagaccagcctccctgccttctccccaggccggctcagccgtgggctttccgaacacaacgccctgctgcagagagaccccctcagccagcccctggcccctggctctcgaattggctctgacccttacctggggcagcgtctggacagtgaggcctctgtccacgccctgcctgaggacactctcactttcgaggaggctgtggccaccaactcgggccgctcctccaggacttcctacgtgtcctccctgacctcccagtctcaccctctccgccgcgtgcccaacggttaccactgcaccctgggactcagctcgggtggccgagcacggcacagctaccaccaccctgaccaagaccactggtgctagctgcaccgtgaccgctcagacgcctgcatgcagcaggcgtgtgttccagtggatgagttttatcatccacacggggcagccggccctcgggggaggccttgcccaccttggtgaggctcctgtggcccctccctccccctcctcccctcttttactctagacgacgaataaagccctgttagaggatgcggctctctctgtccccttcctgtcctgccttcctgggtctcgtaccacacaccagaccctaaaccgcaggctgctgtgtgtggctgagaaggacccaggagtccaaatcccgtgtcctgggactcagcatccagcatgggtgcttggagccgttgtgaggagctctgcgtcctgtggggagcacccttcacgtggccgtgcggcacagagaagcagggcccacctgaaagtgcgccgagacctcgggacggaggggatggggagggggacacagtcgtggcttgtgcagcccgccagtgtcagcgaatgctcactcaggcaagctctgtcctccctggacaccgtcagccccacaggaaccgagctgggaagtgttcttgctgtggttgtgatttttaattgcaacacctctcattcttgtcacttctatatacgtgatgtagaaaaaatggaaaaccagaaaaatggggaaggaaatgttcacataactttaaaaaatcaaacctgtgaaagaaagatgtcagctttttgccacgtgtctttgtggcttatgcgaggagactccctgtgcagccctgtccggtccaggtggacgtagacggcccctggctctgctgctcttgaccaagtgcctgaccgccaggccctcacacccaggctcctgggcactgtggtgtgaggcgaggcctcgggatccatcaccgcaggatgctgtgaaaagtactcgcgatggcagccaggtagcaagcccttgccagtggagagcactggatgtcatggtggcaaacaaggcagccatttgctgtcctcctcccacgagtggaaggggtttccaaggaagccacagggcagctgaccacgtgcttgtgtgaggcattttcagtctgttctgcatatgattctcagggcacactctgtggtatgtgaaataggtttccttccacatacagcagaagagaggcaaaggctggtaggaaggaggaagacattggctgggggcttggatgtggggccgtcagggcaggagggaggaagccccagctggaatgaaactcagagcaagtgaccgagggaggacacggctcctgccactgaggccgggcacctgatgcccagcactgtcctggcgccagacacagggagcaggcagtcaagtgaggtctgacccccatggccacgctcaggagagaaagaccatgctcaggacactgtccaaggtgcacaagatgctgggaggtcccttgtttggtgaagaaagggagcatttagagcagttgatggtggtgtgtcctccgtgttctgaaattccagatgatctgtgttggattcttggcttctaccccatgattctcctcaaagaaattgtgtgtgatgtgtgtgtgtgtgtgtgtgtgtgtgtgtctgtgtcacaggagatgcagtgcctgtacaggtgtgttcagtgtgtggatgtcattaacccatagggctatgcaacaaaagacacatttaatagaagtaaaacacacaagaccgctgcctggtctcggggttcagcatgattgtgaccaaacctttttatagaatttccttacctgaaggcacaacactctgaaactttaaagataacagagtattttattccaatagaataaaccaggaatctcggactgtgcatgtgatcactgtgctcctgttgcaaagtagaaggatgtgtattttgacactgacgttttgtctcttgttccccagcccccagcccatgttatcttgggtgtcgaatgtgtccattccatgcagaaccacagccatttccccaggcagtgttgggtcgagaatccacttttctaaacccacacagcctagctggcttgtctagactcttctaggcattggaattgatgaaaactacagggagcggggaaaggagacattatgtcttgttttcctgactttgggttttgtttctcactgtgtcttctccggctatcatatatgtcccctgaatctcatagtgagctgccaaatttgaagtgcatcacccagttgtctgcatctggaaccagtcaagcagtggctgtagtttgaacaagttatgtgtgcatgtaacatatatacatatatacatatatacaagtatgtgcatgataatgtatatcttcgtactttttgatacaatgtattcatttgttaatttttaattatatttgatataaatcaaaggtttgttgcaaaactttatatttaagaagtgttaaaaaaaaaaaaaagtcccaaccatgcaacacaactgggacctacttaaaaagaaattctgtgattgactagtttgctgcctgagtcatatttatcagccaaactttggattctgctgttgtttctacaatgacattttgtatgaagcaaagtccttgaattaaaataaaaacttagcaaaaaatcaaaaacaaaacccca

SEQ ID NO: 4205 - DNA, 683 bp, Homo sapiens
gggaatattgccctggatgatgacaccagcatcaaccgccacaacaacttccggacgtttttgcaagccctgatgctgctgttcaggagcgccacgggggaggcctggcacgagatcatgctgtcctgcctgagcaaccaggcctgtgatgagcaggccaatgccaccgagtgtggaagtgactttgcctacttctacttcgtctccttcatcttcctgtgctcctttctgatgttgaacctctttgtggctgtgatcatggacaattttgagtacctcacgcgggactcttccatcctaggtcctcaccacttggatgagttcatccgggtctgggctgaatacgacccggctgcgtgttgccggattcattataaggatatgtacagtttgttgcgttgtattgcgccacccgttggcttagggaagaactgccctcgtaggttggcctacaagcgcctggttcgcatgaacatgcccatctccaacgaggacatgactgttcacttcacgtccacgctgatggccctcatccggacggcactggagatcaagctggccccagctgggacaaagcagcatcagtgtgacgcggagttgaggaaggagatttccgttgtgtgggccaatctgccccagaagactttggacttgctggtaccaccccataagcgtaagtgtga

SEQ ID NO: 4206 - DNA, 448 bp, Homo sapiens
gcggcggcaccgggcccggcacaaggcgcagcctgctcacgaggctgtggagaaggagaccacggagaaggaggccacggagaaggaggctgagatagtggaagccgacaaggaaaaggagctccggaaccaccagccccgggagccacactgtgacctggagaccagtgggactgtgactgtgggtcccatgcacacactgcccagcacctgtctccagaaggtggaggaacagccagaggatgcagacaatcagcggaacgtcactcgcatgggcagtcagcccccagacccgaacactattgtacatatcccagtgatgctgacgggccctcttggggaagccacggtcgttcccacacttgaaaaaaacgtgtgcctcttccttctgacctccatggtttctgatgagaaatccactgtcattcgaattgttttcttcctatag

SEQ ID NO: 4207 - DNA, 9790 bp, Homo sapiens
gcggcggcggctgcggcggtggggccgggcgaggtccgctgcggtcccggcggctccgtggctgctccgctctgagcgcctggcgcgccccgcgccctccctgccggggccgctgggccggggatgcacgcggggcccgggagccatggtccgcttcggggacgagctgggcggccgctatgggggccccggcggcggagagcgggcccggggcggcggggccggcggggcggggggcccgggtcccggggggctgcagcccggccagcgggtcctctacaagcaatcgatcgcgcagcgcgcgcggaccatggcgctgtacaaccccatcccggtcaagcagaactgcttcaccgtcaaccgctcgctcttcgtcttcagcgaggacaacgtcgtccgcaaatacgcgaagcgcatcaccgagtggcctccattcgagtatatgatcctggccaccatcatcgccaactgcatcgtgctggccctggagcagcacctccctgatggggacaaaacgcccatgtccgagcggctggacgacacggagccctatttcatcgggatcttttgcttcgaggcagggatcaaaatcatcgctctgggctttgtcttccacaagggctcttacctgcggaacggctggaacgtcatggacttcgtggtcgtcctcacagggatccttgccacggctggaactgacttcgacctgcgaacactgagggctgtgcgtgtgctgaggcccctgaagctggtgtctgggattccaagtttgcaggtggtgctcaagtccatcatgaaggccatggttccactcctgcagattgggctgcttctcttctttgccatcctcatgtttgccatcattggcctggagttctacatgggcaagttccacaaggcctgtttccccaacagcacagatgcggagcccgtgggtgacttcccctgtggcaaggaggccccagcccggctgtgcgagggcgacactgagtgccgggagtactggccaggacccaactttggcatcaccaactttgacaatatcctgtttgccatcttgacggtgttccagtgcatcaccatggagggctggactgacatcctctataatacaaacgatgcggccggcaacacctggaactggctctacttcatccctctcatcatcatcggctccttcttcatgctcaacctggtgctgggcgtgctctcgggggagtttgccaaggagcgagagagggtggagaaccgccgcgccttcctgaagctgcgccggcagcagcagatcgagcgagagctcaacgggtacctggagtggatcttcaaggcggaggaagtcatgctggccgaggaggacaggaatgcagaggagaagtcccctttggacgtgctgaagagagcggccaccaagaagagcagaaatgacctgatccacgcagaggagggagaggaccggtttgcagatctctgtgctgttggatcccccttcgcccgcgccagcctcaagagcgggaagacagagagctcgtcatacttccggaggaaggagaagatgttccggttttttatccggcgcatggtgaaggctcagagcttctactgggtggtgctgtgcgtggtggccctgaacacactgtgtgtggccatggtgcattacaaccagccgcggcggcttaccacgaccctgtattttgcagagtttgttttcctgggtctcttcctcacagagatgtccctgaagatgtatggcctggggcccagaagctacttccggtcctccttcaactgcttcgactttggggtcatcgtggggagcgtctttgaagtggtctgggcggccatcaagccgggaagctcctttgggatcagtgtgctgcgggccctccgcctgctgaggatcttcaaagtcacgaagtactggagctccctgcggaacctggtggtgtccctgctgaactccatgaagtccatcatcagcctgctcttcttgctcttcctgttcattgtggtcttcgccctgctggggatgcagctgtttgggggacagttcaacttccaggatgagactcccacaaccaacttcgacaccttccctgccgccatcctcactgtcttccagatcctgacgggagaggactggaatgcagtgatgtatcacgggatcgaatcgcaaggcggcgtcagcaaaggcatgttctcgtccttttacttcattgtcctgacactgttcggaaactacactctgctgaatgtctttctggccatcgctgtggacaacctggccaacgcccaagagctgaccaaggatgaagaggagatggaagaagcagccaatcagaagcttgctctgcaaaaggccaaagaagtggctgaagtcagccccatgtctgccgcgaacatctccatcgccgccaggcagcagaactcggccaaggcgcgctcggtgtgggagcagcgggccagccagctacggctgcagaacctgcgggccagctgcgaggcgctgtacagcgagatggaccccgaggagcggctgcgcttcgccactacgcgccacctgcggcccgacatgaagacgcacctggaccggccgctggtggtggagctgggccgcgacggcgcgcgggggcccgtgggaggcaaagcccgacctgaggctgcggaggcccccgagggcgtcgaccctccgcgcaggcaccaccggcaccgcgacaaggacaagacccccgcggcgggggaccaggaccgagcagaggccccgaaggcggagagcggggagcccggtgcccgggaggagcggccgcggccgcaccgcagccacagcaaggaggccgcggggcccccggaggcgcggagcgagcgcggccgaggcccaggccccgagggcggccggcggcaccaccggcgcggctccccggaggaggcggccgagcgggagccccgacgccaccgcgcgcaccggcaccaggatccgagcaaggagtgcgccggcgccaagggcgagcggcgcgcgcggcaccgcggcggcccccgagcggggccccgggaggcggagagcggggaggagccggcgcggcggcaccgggcccggcacaaggcgcagcctgctcacgaggctgtggagaaggagaccacggagaaggaggccacggagaaggaggctgagatagtggaagccgacaaggaaaaggagctccggaaccaccagccccgggagccacactgtgacctggagaccagtgggactgtgactgtgggtcccatgcacacactgcccagcacctgtctccagaaggtggaggaacagccagaggatgcagacaatcagcggaacgtcactcgcatgggcagtcagcccccagacccgaacactattgtacatatcccagtgatgctgacgggccctcttggggaagccacggtcgttcccagtggtaacgtggacctggaaagccaagcagaggggaagaaggaggtggaagcggatgacgtgatgaggagcggcccccggcctatcgtcccatacagctccatgttctgtttaagccccaccaacctgctccgccgcttctgccactacatcgtgaccatgaggtacttcgaggtggtcattctcgtggtcatcgccttgagcagcatcgccctggctgctgaggacccagtgcgcacagactcgcccaggaacaacgctctgaaatacctggattacattttcactggtgtctttacctttgagatggtgataaagatgatcgacttgggactgctgcttcaccctggagcctatttccgggacttgtggaacattctggacttcattgtggtcagtggcgccctggtggcgtttgctttctcaggatccaaagggaaagacatcaataccatcaagtctctgagagtccttcgtgtcctgcggcccctcaagaccatcaaacggctgcccaagctcaaggctgtgtttgactgtgtggtgaactccctgaagaatgtcctcaacatcttgattgtctacatgctcttcatgttcatatttgccgtcattgcggtgcagctcttcaaagggaagtttttctactgcacagatgaatccaaggagctggagagggactgcaggggtcagtatttggattatgagaaggaggaagtggaagctcagcccaggcagtggaagaaatacgactttcactacgacaatgtgctctgggctctgctgacgctgttcacagtgtccacgggagaaggctggcccatggtgctgaaacactccgtggatgccacctatgaggagcagggtccaagccctgggtaccgcatggagctgtccatcttctacgtggtctactttgtggtctttcccttcttcttcgtcaacatctttgtggctttgatcatcatcaccttccaggagcagggggacaaggtgatgtctgaatgcagcctggagaagaacgagagggcttgcattgacttcgccatcagcgccaaacccctgacacggtacatgccccaaaaccggcagtcgttccagtataagacgtggacatttgtggtctccccgccctttgaatacttcatcatggccatgatagccctcaacactgtggtgctgatgatgaagttctatgatgcaccctatgagtacgagctgatgctgaaatgcctgaacatcgtgttcacatccatgttctccatggaatgcgtgctgaagatcatcgcctttggggtgctgaactatttcagagatgcctggaatgtctttgactttgtcactgtgttgggaagtattactgatattttagtaacagagattgcggaaacgaacaatttcatcaacctcagcttcctccgcctctttcgagctgcgcggctgatcaagctgctccgccagggctacaccatccgcatcctgctgtggacctttgtccagtccttcaaggccctgccctacgtgtgtctgctcattgccatgctgttcttcatctacgccatcatcggcatgcaggtgtttgggaatattgccctggatgatgacaccagcatcaaccgccacaacaacttccggacgtttttgcaagccctgatgctgctgttcaggagcgccacgggggaggcctggcacgagatcatgctgtcctgcctgagcaaccaggcctgtgatgagcaggccaatgccaccgagtgtggaagtgactttgcctacttctacttcgtctccttcatcttcctgtgctcctttctgatgttgaacctctttgtggctgtgatcatggacaattttgagtacctcacgcgggactcttccatcctaggtcctcaccacttggatgagttcatccgggtctgggctgaatacgacccggctgcgtgtgggcgcatcagttacaatgacatgtttgagatgctgaaacacatgtccccgcctctggggctggggaagaaatgccctgctcgagttgcttacaagcgcctggttcgcatgaacatgcccatctccaacgaggacatgactgttcacttcacgtccacgctgatggccctcatccggacggcactggagatcaagctggccccagctgggacaaagcagcatcagtgtgacgcggagttgaggaaggagatttccgttgtgtgggccaatctgccccagaagactttggacttgctggtaccaccccataagcctgatgagatgacagtggggaaggtttatgcagctctgatgatattcgacttctacaagcagaacaaaaccaccagagaccagatgcagcaggctcctggaggcctctcccagatgggtcctgtgtccctgttccaccctctgaaggccaccctggagcagacacagccggctgtgctccgaggagcccgggttttccttcgacagaagagttccacctccctcagcaatggcggggccatacaaaaccaagagagtggcatcaaagagtctgtctcctggggcactcaaaggacccaggatgcaccccatgaggccaggccacccctggagcgtggccactccacagagatccctgtggggcggtcaggagcactggctgtggacgttcagatgcagagcataacccggaggggccctgatggggagccccagcctgggctggagagccagggtcgagcggcctccatgccccgccttgcggccgagactcagcccgtcacagatgccagccccatgaagcgctccatctccacgctggcccagcggccccgtgggactcatctttgcagcaccaccccggaccgcccaccccctagccaggcgtcgtcgcaccaccaccaccaccgctgccaccgccgcagggacaggaagcagaggtccctggagaaggggcccagcctgtctgccgatatggatggcgcaccaagcagtgctgtggggccggggctgcccccgggagaggggcctacaggctgccggcgggaacgagagcgccggcaggagcggggccggtcccaggagcggaggcagccctcatcctcctcctcggagaagcagcgcttctactcctgcgaccgctttgggggccgtgagcccccgaagcccaagccctccctcagcagccacccaacgtcgccaacagctggccaggagccgggaccccacccacagggcagtggttccgtgaatgggagccccttgctgtcaacatctggtgctagcacccccggccgcggtgggcggaggcagctcccccagacgcccctgactccccgccccagcatcacctacaagacggccaactcctcacccatccacttcgccggggctcagaccagcctccctgccttctccccaggccggctcagccgtgggctttccgaacacaacgccctgctgcagagagaccccctcagccagcccctggcccctggctctcgaattggctctgacccttacctggggcagcgtctggacagtgaggcctctgtccacgccctgcctgaggacactctcactttcgaggaggctgtggccaccaactcgggccgctcctccaggacttcctacgtgtcctccctgacctcccagtctcaccctctccgccgcgtgcccaacggttaccactgcaccctgggactcagctcgggtggccgagcacggcacagctaccaccaccctgaccaagaccactggtgctagctgcaccgtgaccgctcagacgcctgcatgcagcaggcgtgtgttccagtggatgagttttatcatccacacggggcagccggccctcgggggaggccttgcccaccttggtgaggctcctgtggcccctccctccccctcctcccctcttttactctagacgacgaataaagccctgttagaggatgcggctctctctgtccccttcctgtcctgccttcctgggtctcgtaccacacaccagaccctaaaccgcaggctgctgtgtgtggctgagaaggacccaggagtccaaatcccgtgtcctgggactcagcatccagcatgggtgcttggagccgttgtgaggagctctgcgtcctgtggggagcacccttcacgtggccgtgcggcacagagaagcagggcccacctgaaagtgcgccgagacctcgggacggaggggatggggagggggacacagtcgtggcttgtgcagcccgccagtgtcagcgaatgctcactcaggcaagctctgtcctccctggacaccgtcagccccacaggaaccgagctgggaagtgttcttgctgtggttgtgatttttaattgcaacacctctcattcttgtcacttctatatacgtgatgtagaaaaaatggaaaaccagaaaaatggggaaggaaatgttcacataactttaaaaaatcaaacctgtgaaagaaagatgtcagctttttgccacgtgtctttgtggcttatgcgaggagactccctgtgcagccctgtccggtccaggtggacgtagacggcccctggctctgctgctcttgaccaagtgcctgaccgccaggccctcacacccaggctcctgggcactgtggtgtgaggcgaggcctcgggatccatcaccgcaggatgctgtgaaaagtactcgcgatggcagccaggtagcaagcccttgccagtggagagcactggatgtcatggtggcaaacaaggcagccatttgctgtcctcctcccacgagtggaaggggtttccaaggaagccacagggcagctgaccacgtgcttgtgtgaggcattttcagtctgttctgcatatgattctcagggcacactctgtggtatgtgaaataggtttccttccacatacagcagaagagaggcaaaggctggtaggaaggaggaagacattggctgggggcttggatgtggggccgtcagggcaggagggaggaagccccagctggaatgaaactcagagcaagtgaccgagggaggacacggctcctgccactgaggccgggcacctgatgcccagcactgtcctggcgccagacacagggagcaggcagtcaagtgaggtctgacccccatggccacgctcaggagagaaagaccatgctcaggacactgtccaaggtgcacaagatgctgggaggtcccttgtttggtgaagaaagggagcatttagagcagttgatggtggtgtgtcctccgtgttctgaaattccagatgatctgtgttggattcttggcttctaccccatgattctcctcaaagaaattgtgtgtgatgtgtgtgtgtgtgtgtgtgtgtgtgtgtctgtgtcacaggagatgcagtgcctgtacaggtgtgttcagtgtgtggatgtcattaacccatagggctatgcaacaaaagacacatttaatagaagtaaaacacacaagaccgctgcctggtctcggggttcagcatgattgtgaccaaacctttttatagaatttccttacctgaaggcacaacactctgaaactttaaagataacagagtattttattccaatagaataaaccaggaatctcggactgtgcatgtgatcactgtgctcctgttgcaaagtagaaggatgtgtattttgacactgacgttttgtctcttgttccccagcccccagcccatgttatcttgggtgtcgaatgtgtccattccatgcagaaccacagccatttccccaggcagtgttgggtcgagaatccacttttctaaacccacacagcctagctggcttgtctagactcttctaggcattggaattgatgaaaactacagggagcggggaaaggagacattatgtcttgttttcctgactttgggttttgtttctcactgtgtcttctccggctatcatatatgtcccctgaatctcatagtgagctgccaaatttgaagtgcatcacccagttgtctgcatctggaaccagtcaagcagtggctgtagtttgaacaagttatgtgtgcatgtaacatatatacatatatacatatatacaagtatgtgcatgataatgtatatcttcgtactttttgatacaatgtattcatttgttaatttttaattatatttgatataaatcaaaggtttgttgcaaaactttatatttaagaagtgttaaaaaaaaaaaaaagtcccaaccatgcaacacaactgggacctacttaaaaagaaattctgtgattgactagtttgctgcctgagtcatatttatcagccaaactttggattctgctgttgtttctacaatgacattttgtatgaagcaaagtccttgaattaaaataaaaacttagcaaaaaatcaaaaacaaaacccca

SEQ ID NO: 4208 - DNA, 492 bp, Homo sapiens
caacttccggacgtttttgcaagccctgatgctgctgttcaggagcgccacgggggaggcctggcacgagatcatgctgtcctgcctgagcaaccaggcctgtgatgagcaggccaatgccaccgagtgtggaagtgactttgcctacttctacttcgtctccttcatcttcctgtgctcctttctgatgttgaacctctttgtggctgtgatcatggacaattttgagtacctcacgcgggactcttccatcctaggtcctcaccacttggatgagttcatccgggtctgggctgaatacgacccggctgcgtgttgccggattcattataaggatatgtacagtttgttgcgttgtattgcgccacccgttggcttagggaagaactgccctcgtaggttggcctacaagcgcctggttcgcatgaacatgcccatctccaacgaggacatgactgttcacttcacgtccacgctgatggccctcatccg

SEQ ID NO: 4209 - DNA, 770 bp, Homo sapiens
ctccggaaccaccagccccgggagccacactgtgacctggagaccagtgggactgtgactgtgggtcccatgcacacactgcccagcacctgtctccagaaggtggaggaacagccagaggatgcagacaatcagcggaacgtcactcgcatgggcagtcagcccccagacccgaacactattgtacatatcccagtgatgctgacgggccctcttggggaagccacggtcgttcccagtcccacaataggccgtctgcaagctgaggagcaaggagagccagcccgagtctcaaagctgaacttggagtccgatgttcgagggcaggaagcgtccagcacgggagaaagatataggctgggaggtggtaacgtggacctggaaagccaagcagaggggaagaaggaggtggaagcggatgacgtgatgaggagcggcccccggcctatcgtcccatacagctccatgttctgtttaagccccaccaacctgctccgccgcttctgccactacatcgtgaccatgaggtacttcgaggtggtcattctcgtggtcatcgccttgagcagcatcgccctggctgctgaggacccagtgcgcacagactcgcccaggaacaacgctctgaaatacctggattacattttcactggtgtctttacctttgagatggtgataaagatgatcgacttgggactgctgcttcaccctggagcctatttccgggacttgtggaacattctggacttcattgtggtcagtggcgccct

SEQ ID NO: 4210 - DNA, 8626 bp, Homo sapiens
gatgtcccgagctgctatccccggctcggcccgggcagccgccttctgagcccccgacccgaggcgccgagccgccgccgcccgatgggctgggccgtggagcgtctccgcagtcgtagctccagccgccgcgctcccagccccggcagcctcagcatcagcggcggcggcggcggcggcggcgtcttccgcatcgttcgccgcagcgtaacccggagccctttgctctttgcagaatggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggcctccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgaacgtgagctcaatgggtacatggagtggatctcaaaagcagaagaggtgatcctcgccgaggatgaaactgacggggagcagaggcatccctttgatggagctctgcggagaaccaccataaagaaaagcaagacagatttgctcaaccccgaagaggctgaggatcagctggctgatatagcctctgtgggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttactatgcagaattcattttcttaggactctttatgtccgaaatgtttataaaaatgtacgggcttgggacgcggccttacttccactcttccttcaactgctttgactgtggggttatcattgggagcatcttcgaggtcatctgggctgtcataaaacctggcacatcctttggaatcagcgtgttacgagccctcaggttattgcgtattttcaaagtcacaaagtactgggcatctctcagaaacctggtcgtctctctcctcaactccatgaagtccatcatcagcctgttgtttctccttttcctgttcattgtcgtcttcgcccttttgggaatgcaactcttcggcggccagtttaatttcgatgaagggactcctcccaccaacttcgatacttttccagcagcaataatgacggtgtttcagatcctgacgggcgaagactggaacgaggtcatgtacgacgggatcaagtctcaggggggcgtgcagggcggcatggtgttctccatctatttcattgtactgacgctctttgggaactacaccctcctgaatgtgttcttggccatcgctgtggacaatctggccaacgcccaggagctcaccaaggacgagcaagaggaagaagaagcagcgaaccagaaacttgccctacagaaagccaaggaggtggcagaagtgagtcctctgtccgcggccaacatgtctatagctgtgaaagagcaacagaagaatcaaaagccagccaagtccgtgtgggagcagcggaccagtgagatgcgaaagcagaacttgctggccagccgggaggccctgtataacgaaatggacccggacgagcgctggaaggctgcctacacgcggcacctgcggccagacatgaagacgcacttggaccggccgctggtggtggacccgcaggagaaccgcaacaacaacaccaacaagagccgggcggccgagcccaccgtggaccagcgcctcggccagcagcgcgccgaggacttcctcaggaaacaggcccgctaccacgatcgggcccgggaccccagcggctcggcgggcctggacgcacggaggccctgggcgggaagccaggaggccgagctgagccgggagggaccctacggccgcgagtcggaccaccacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcaccgcaggcccggggaggagggtccggaggacaaggcggagcggagggcgcggcaccgcgagggcagccggccggcccggggcggcgagggcgagggcgagggccccgacgggggcgagcgcaggagaaggcaccggcatggcgctccagccacgtacgagggggacgcgcggagggaggacaaggagcggaggcatcggaggaggaaagagaaccagggctccggggtccctgtgtcgggccccaacctgtcaaccacccggccaatccagcaggacctgggccgccaagacccacccctggcagaggatattgacaacatgaagaacaacaagctggccaccgcggagtcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccacagtggacatccccccagcctgcccaccccccctcaaccacaccgtcgtacaagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccccttcgccgcctgtgccattacatcctgaacctgcgctactttgagatgtgcatcctcatggtcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgacctctggaatattctcgacttcatagtggtcagtggggccctggtagcctttgccttcactggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttgggaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttgcggtcggattcattataaggatatgtacagtttattacgagtaatatctccccctctcggcttaggcaagaaatgtcctcatagggttgcttgcaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaggagaaggggccggccacgtgggaataacctcagtaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcagtagttccgtaagtggaagcccagccccctcaacatctggtaccagcactccgcggcggggccgccgccagctcccccagaccccctccaccccccggccacacgtgtcctattcccctgtgatccgtaaggccggcggctcggggcccccgcagcagcagcagcagcagcagcagcagcagcagcagcaggcggtggccaggccgggccgggcggccaccagcggccctcggaggtacccaggccccacggccgagcctctggccggagatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactaccggggctccgactacgacgaggccgatggcccgggcagcgggggcggcgaggaggccatggccggggcctacgacgcgccaccccccgtacgacacgcgtcctcgggcgccaccgggcgctcgcccaggactccccgggcctcgggcccggcctgcgcctcgccttctcggcacggccggcgactccccaacggctactacccggcgcacggactggccaggccccgcgggccgggctccaggaagggcctgcacgaaccctacagcgagagtgacgatgattggtgctaagcccgggcgaggtggcgcccgcccggccccccacgcaccccacgcacacaccccacccgaggagccgcgcagaggccgcgggggcccagcacagagggcccgggagagggccagccgggagaccccagactctggagaggccagggctgggccacaagggtgtcccgcagagaccctcggccaaaagagaccctcctgggcagccacggcgccccccaaccagccccgatccccccacccacgacaggggctctcgggtgggaggcagggagcagacaaaccacacagccaagggatttgaattaactcagccatttttggagaactttggggaacatgaaaaaaaaaaaaaaaaaaaaaaaaaaaaacatttttaaaagaaaaaacggggagaaaaaaatagcttctattgatgagttttatcatctcaattgaatctttcctttccctgatgaagacagctggtggccgagtgcggcaaagaagccagaaggaaccagaatcccagtgccctacacccaccaccagacacactcacacccacacacgttctcagacacacacaagagtgcttgccggttataccaaaccctactattactgcctgcagaaatcaatttaaaaaaataataataacaataaacaattttaaaaaggacaaaaaaattaatgattgagaaaagaggcatttttttctgacatttggtcctgcttgaaacaacaaaagaagaagaaaaacccaccatcaccaccgattcctttgcttcttttttccttttttcctaccttgtttgaaaaccgtgggcttgggactgtgaattattgcatgacattcaaaaagaaaaaaaaaataaaaaaaagttgaatcaaa

SEQ ID NO: 4211 - DNA, 8359 bp, Homo sapiens
atggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggccaccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgaacgtgagctcaatgggtacatggagtggatctcaaaagcagaagaggtgatcctcgccgaggatgaaactgacggggagcagaggcatccctttgatggagctctgcggagaaccaccataaagaaaagcaagacagatttgctcaaccccgaagaggctgaggatcagctggctgatatagcctctgtgggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttactatgcagaattcattttcttaggactctttatgtccgaaatgtttataaaaatgtacgggcttgggacgcggccttacttccactcttccttcaactgctttgactgtggggttatcattgggagcatcttcgaggtcatctgggctgtcataaaacctggcacatcctttggaatcagcgtgttacgagccctcaggttattgcgtattttcaaagtcacaaagtactgggcatctctcagaaacctggtcgtctctctcctcaactccatgaagtccatcatcagcctgttgtttctccttttcctgttcattgtcgtcttcgcccttttgggaatgcaactcttcggcggccagtttaatttcgatgaagggactcctcccaccaacttcgatacttttccagcagcaataatgacggtgtttcagatcctgacgggcgaagactggaacgaggtcatgtacgacgggatcaagtctcaggggggcgtgcagggcggcatggtgttctccatctatttcattgtactgacgctctttgggaactacaccctcctgaatgtgttcttggccatcgctgtggacaatctggccaacgcccaggagctcaccaaggacgagcaagaggaagaagaagcagcgaaccagaaacttgccctacagaaagccaaggaggtggcagaagtgagtcctctgtccgcggccaacatgtctatagctgtgaaagagcaacagaagaatcaaaagccagccaagtccgtgtgggagcagcggaccagtgagatgcgaaagcagaacttgctggccagccgggaggccctgtataacgaaatggacccggacgagcgctggaaggctgcctacacgcggcacctgcggccagacatgaagacgcacttggaccggccgctggtggtggacccgcaggagaaccgcaacaacaacaccaacaagagccgggcggccgagcccaccgtggaccagcgcctcggccagcagcgcgccgaggacttcctcaggaaacaggcccgctaccacgatcgggcccgggaccccagcggctcggcgggcctggacgcacggaggccctgggcgggaagccaggaggccgagctgagccgggagggaccctacggccgcgagtcggaccaccacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcaccgcaggcccggggaggagggtccggaggacaaggcggagcggagggcgcggcaccgcgagggcagccggccggcccggggcggcgagggcgagggcgagggccccgacgggggcgagcgcaggagaaggcaccggcatggcgctccagccacgtacgagggggacgcgcggagggaggacaaggagcggaggcatcggaggaggaaagagaaccagggctccggggtccctgtgtcgggccccaacctgtcaaccacccggccaatccagcaggacctgggccgccaagacccacccctggcagaggatattgacaacatgaagaacaacaagctggccaccgcggagtcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccacagtggacatccccccagcctgcccaccccccctcaaccacaccgtcgtacaagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccccttcgccgcctgtgccattacatcctgaacctgcgctactttgagatgtgcatcctcatggtcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgacctctggaatattctcgacttcatagtggtcagtggggccctggtagcctttgccttcactggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttgggaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttggggccgcatgccttacctggacatgtatcagatgctgagacacatgtctccgcccctgggtctggggaagaagtgtccggccagagtggcttacaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcagggcagtagttccgtaagtggaagcccagccccctcaacatctggtaccagcactccgcggcggggccgccgccagctcccccagaccccctccaccccccggccacacgtgtcctattcccctgtgatccgtaaggccggcggctcggggcccccgcagcagcagcagcagcagcagcagcagcagcagcagcaggcggtggccaggccgggccgggcggccaccagcggccctcggaggtacccaggccccacggccgagcctctggccggagatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactaccggggctccgactacgacgaggccgatggcccgggcagcgggggcggcgaggaggccatggccggggcctacgacgcgccaccccccgtacgacacgcgtcctcgggcgccaccgggcgctcgcccaggactccccgggcctcgggcccggcctgcgcctcgccttctcggcacggccggcgactccccaacggctactacccggcgcacggactggccaggccccgcgggccgggctccaggaagggcctgcacgaaccctacagcgagagtgacgatgattggtgctaagcccgggcgaggtggcgcccgcccggccccccacgcaccccacgcacacaccccacccgaggagccgcgcagaggccgcgggggcccagcacagagggcccgggagagggccagccgggagaccccagactctggagaggccagggctgggccacaagggtgtcccgcagagaccctcggccaaaagagaccctcctgggcagccacggcgccccccaaccagccccgatccccccacccacgacaggggctctcgggtgggaggcagggagcagacaaaccacacagccaagggatttgaattaactcagccatttttggagaactttggggaacatgaaaaaaaaaaaaaaaaaaaaaaaaaaaaacatttttaaaagaaaaaacggggagaaaaaaatagcttctattgatgagttttatcatctcaattgaatctttcctttccctgatgaagacagctggtggccgagtgcggcaaagaagccagaaggaaccagaatcccagtgccctacacccaccaccagacacactcacacccacacacgttctcagacacacacaagagtgcttgccggttataccaaaccctactattactgcctgcagaaatcaatttaaaaaaataataataacaataaacaattttaaaaaggacaaaaaaattaatgattgagaaaagaggcatttttttctgacatttggtcctgcttgaaacaacaaaagaagaagaaaaacccaccatcaccaccgattcctttgcttcttttttccttttttcctaccttgtttgaaaaccgtgggcttgggactgtgaattattgcatgacattcaaaaagaaaaaaaaaataaaaaaaagttgaatcaaa

SEQ ID NO: 4212 - DNA, 8628 bp, Homo sapiens
gatgtcccgagctgctatccccggctcggcccgggcagccgccttctgagcccccgacccgaggcgccgagccgccgccgcccgatgggctgggccgtggagcgtctccgcagtcgtagctccagccgccgcgctcccagccccggcagcctcagcatcagcggcggcggcggcggcggcggcgtcttccgcatcgttcgccgcagcgtaacccggagccctttgctctttgcagaatggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggcctccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgaacgtgagctcaatgggtacatggagtggatctcaaaagcagaagaggtgatcctcgccgaggatgaaactgacggggagcagaggcatccctttgatgctctgcggagaaccaccataaagaaaagcaagacagatttgctcaaccccgaagaggctgaggatcagctggctgatatagcctctgtgggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttactatgcagaattcattttcttaggactctttatgtccgaaatgtttataaaaatgtacgggcttgggacgcggccttacttccactcttccttcaactgctttgactgtggggttatcattgggagcatcttcgaggtcatctgggctgtcataaaacctggcacatcctttggaatcagcgtgttacgagccctcaggttattgcgtattttcaaagtcacaaagtactgggcatctctcagaaacctggtcgtctctctcctcaactccatgaagtccatcatcagcctgttgtttctccttttcctgttcattgtcgtcttcgcccttttgggaatgcaactcttcggcggccagtttaatttcgatgaagggactcctcccaccaacttcgatacttttccagcagcaataatgacggtgtttcagatcctgacgggcgaagactggaacgaggtcatgtacgacgggatcaagtctcaggggggcgtgcagggcggcatggtgttctccatctatttcattgtactgacgctctttgggaactacaccctcctgaatgtgttcttggccatcgctgtggacaatctggccaacgcccaggagctcaccaaggacgagcaagaggaagaagaagcagcgaaccagaaacttgccctacagaaagccaaggaggtggcagaagtgagtcctctgtccgcggccaacatgtctatagctgtgaaagagcaacagaagaatcaaaagccagccaagtccgtgtgggagcagcggaccagtgagatgcgaaagcagaacttgctggccagccgggaggccctgtataacgaaatggacccggacgagcgctggaaggctgcctacacgcggcacctgcggccagacatgaagacgcacttggaccggccgctggtggtggacccgcaggagaaccgcaacaacaacaccaacaagagccgggcggccgagcccaccgtggaccagcgcctcggccagcagcgcgccgaggacttcctcaggaaacaggcccgctaccacgatcgggcccgggaccccagcggctcggcgggcctggacgcacggaggccctgggcgggaagccaggaggccgagctgagccgggagggaccctacggccgcgagtcggaccaccacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcaccgcaggcccggggaggagggtccggaggacaaggcggagcggagggcgcggcaccgcgagggcagccggccggcccggggcggcgagggcgagggcgagggccccgacgggggcgagcgcaggagaaggcaccggcatggcgctccagccacgtacgagggggacgcgcggagggaggacaaggagcggaggcatcggaggaggaaagagaaccagggctccggggtccctgtgtcgggccccaacctgtcaaccacccggccaatccagcaggacctgggccgccaagacccacccctggcagaggatattgacaacatgaagaacaacaagctggccaccgcggagtcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccacagtggacatccccccagcctgcccaccccccctcaaccacaccgtcgtacaagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccccttcgccgcctgtgccattacatcctgaacctgcgctactttgagatgtgcatcctcatggtcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgacctctggaatattctcgacttcatagtggtcagtggggccctggtagcctttgccttcactggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttgggaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttggggccgcatgccttacctggacatgtatcagatgctgagacacatgtctccgcccctgggtctggggaagaagtgtccggccagagtggcttacaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaggagaaggggccggccacgtgggaataacctcagtaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcagggcagtagttccgtaagtggaagcccagccccctcaacatctggtaccagcactccgcggcggggccgccgccagctcccccagaccccctccaccccccggccacacgtgtcctattcccctgtgatccgtaaggccggcggctcggggcccccgcagcagcagcagcagcagcagcagcagcagcagcagcaggcggtggccaggccgggccgggcggccaccagcggccctcggaggtacccaggccccacggccgagcctctggccggagatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactaccggggctccgactacgacgaggccgatggcccgggcagcgggggcggcgaggaggccatggccggggcctacgacgcgccaccccccgtacgacacgcgtcctcgggcgccaccgggcgctcgcccaggactccccgggcctcgggcccggcctgcgcctcgccttctcggcacggccggcgactccccaacggctactacccggcgcacggactggccaggccccgcgggccgggctccaggaagggcctgcacgaaccctacagcgagagtgacgatgattggtgctaagcccgggcgaggtggcgcccgcccggccccccacgcaccccacgcacacaccccacccgaggagccgcgcagaggccgcgggggcccagcacagagggcccgggagagggccagccgggagaccccagactctggagaggccagggctgggccacaagggtgtcccgcagagaccctcggccaaaagagaccctcctgggcagccacggcgccccccaaccagccccgatccccccacccacgacaggggctctcgggtgggaggcagggagcagacaaaccacacagccaagggatttgaattaactcagccatttttggagaactttggggaacatgaaaaaaaaaaaaaaaaaaaaaaaaaaaaacatttttaaaagaaaaaacggggagaaaaaaatagcttctattgatgagttttatcatctcaattgaatctttcctttccctgatgaagacagctggtggccgagtgcggcaaagaagccagaaggaaccagaatcccagtgccctacacccaccaccagacacactcacacccacacacgttctcagacacacacaagagtgcttgccggttataccaaaccctactattactgcctgcagaaatcaatttaaaaaaataataataacaataaacaattttaaaaaggacaaaaaaattaatgattgagaaaagaggcatttttttctgacatttggtcctgcttgaaacaacaaaagaagaagaaaaacccaccatcaccaccgattcctttgcttcttttttccttttttcctaccttgtttgaaaaccgtgggcttgggactgtgaattattgcatgacattcaaaaagaaaaaaaaaataaaaaaaagttgaatcaaa

SEQ ID NO: 4213 - DNA, 8410 bp, Homo sapiens
atggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggccaccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgaacgtgagctcaatgggtacatggagtggatctcaaaagcagaagaggtgatcctcgccgaggatgaaactgacggggagcagaggcatccctttgatggagctctgcggagaaccaccataaagaaaagcaagacagatttgctcaaccccgaagaggctgaggatcagctggctgatatagcctctgtgggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttactatgcagaattcattttcttaggactctttatgtccgaaatgtttataaaaatgtacgggcttgggacgcggccttacttccactcttccttcaactgctttgactgtggggttatcattgggagcatcttcgaggtcatctgggctgtcataaaacctggcacatcctttggaatcagcgtgttacgagccctcaggttattgcgtattttcaaagtcacaaagtactgggcatctctcagaaacctggtcgtctctctcctcaactccatgaagtccatcatcagcctgttgtttctccttttcctgttcattgtcgtcttcgcccttttgggaatgcaactcttcggcggccagtttaatttcgatgaagggactcctcccaccaacttcgatacttttccagcagcaataatgacggtgtttcagatcctgacgggcgaagactggaacgaggtcatgtacgacgggatcaagtctcaggggggcgtgcagggcggcatggtgttctccatctatttcattgtactgacgctctttgggaactacaccctcctgaatgtgttcttggccatcgctgtggacaatctggccaacgcccaggagctcaccaaggtggaggcggacgagcaagaggaagaagaagcagcgaaccagaaacttgccctacagaaagccaaggaggtggcagaagtgagtcctctgtccgcggccaacatgtctatagctgtgaaagagcaacagaagaatcaaaagccagccaagtccgtgtgggagcagcggaccagtgagatgcgaaagcagaacttgctggccagccgggaggccctgtataacgaaatggacccggacgagcgctggaaggctgcctacacgcggcacctgcggccagacatgaagacgcacttggaccggccgctggtggtggacccgcaggagaaccgcaacaacaacaccaacaagagccgggcggccgagcccaccgtggaccagcgcctcggccagcagcgcgccgaggacttcctcaggaaacaggcccgctaccacgatcgggcccgggaccccagcggctcggcgggcctggacgcacggaggccctgggcgggaagccaggaggccgagctgagccgggagggaccctacggccgcgagtcggaccaccacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcaccgcaggcccggggaggagggtccggaggacaaggcggagcggagggcgcggcaccgcgagggcagccggccggcccggggcggcgagggcgagggcgagggccccgacgggggcgagcgcaggagaaggcaccggcatggcgctccagccacgtacgagggggacgcgcggagggaggacaaggagcggaggcatcggaggaggaaagagaaccagggctccggggtccctgtgtcgggccccaacctgtcaaccacccggccaatccagcaggacctgggccgccaagacccacccctggcagaggatattgacaacatgaagaacaacaagctggccaccgcggagtcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccacagtggacatccccccagcctgcccaccccccctcaaccacaccgtcgtacaagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccccttcgccgcctgtgccattacatcctgaacctgcgctactttgagatgtgcatcctcatggtcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgacctctggaatattctcgacttcatagtggtcagtggggccctggtagcctttgccttcactggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttgggaatccgaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttggggccgcatgccttacctggacatgtatcagatgctgagacacatgtctccgcccctgggtctggggaagaagtgtccggccagagtggcttacaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaggagaaggggccggccacgtgggaataacctcagtaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcagggcagtagttccgtaagtggaagcccagccccctcaacatctggtaccagcactccgcggcggggccgccgccagctcccccagaccccctccaccccccggccacacgtgtcctattcccctgtgatccgtaaggccggcggctcggggcccccgcagcagcagcagcagcagcagcagcagcagcagcagcaggcggtggccaggccgggccgggcggccaccagcggccctcggaggtacccaggccccacggccgagcctctggccggagatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactaccggggctccgactacgacgaggccgatggcccgggcagcgggggcggcgaggaggccatggccggggcctacgacgcgccaccccccgtacgacacgcgtcctcgggcgccaccgggcgctcgcccaggactccccgggcctcgggcccggcctgcgcctcgccttctcggcacggccggcgactccccaacggctactacccggcgcacggactggccaggccccgcgggccgggctccaggaagggcctgcacgaaccctacagcgagagtgacgatgattggtgctaagcccgggcgaggtggcgcccgcccggccccccacgcaccccacgcacacaccccacccgaggagccgcgcagaggccgcgggggcccagcacagagggcccgggagagggccagccgggagaccccagactctggagaggccagggctgggccacaagggtgtcccgcagagaccctcggccaaaagagaccctcctgggcagccacggcgccccccaaccagccccgatccccccacccacgacaggggctctcgggtgggaggcagggagcagacaaaccacacagccaagggatttgaattaactcagccatttttggagaactttggggaacatgaaaaaaaaaaaaaaaaaaaaaaaaaaaaacatttttaaaagaaaaaacggggagaaaaaaatagcttctattgatgagttttatcatctcaattgaatctttcctttccctgatgaagacagctggtggccgagtgcggcaaagaagccagaaggaaccagaatcccagtgccctacacccaccaccagacacactcacacccacacacgttctcagacacacacaagagtgcttgccggttataccaaaccctactattactgcctgcagaaatcaatttaaaaaaataataataacaataaacaattttaaaaaggacaaaaaaattaatgattgagaaaagaggcatttttttctgacatttggtcctgcttgaaacaacaaaagaagaagaaaaacccaccatcaccaccgattcctttgcttcttttttccttttttcctaccttgtttgaaaaccgtgggcttgggactgtgaattattgcatgacattcaaaaagaaaaaaaaaataaaaaaaagttgaatcaaa

SEQ ID NO: 4214 - DNA, 1006 bp, Homo sapiens
cgacttcatagtggtcagtggggccctggtagcctttgccttcactggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttggg

SEQ ID NO: 4215 - DNA, 9848 bp, Homo sapiens
gctgctgctgcctctccgaagagctcgcggagctccccagaggcggtggtccccgtgcttgtctggatgcggctctgagtctccgtgtgtctttctgcttgttgctgtgtgcgggtgttcggccgcgatcacctttgtgtgtcttctgtctgtttaaacctcaggatggctcgcttcggggaggcggtggtcgccaggccagggtccggcgatggagactcggaccagagcaggaaccggcaaggaacccccgtgccggcctcggggcaggcggccgcctacaagcagacgaaagcacagagggcgcggactatggctttgtacaaccccattcccgtccggcagaactgtttcaccgtcaacagatccctgttcatcttcggagaagataacattgtcaggaaatatgccaagaagctcatcgattggccgccatttgagtacatgatcctggccaccatcattgccaactgcatcgtcctggccctggagcagcatcttcctgaggatgacaagacccccatgtcccgaagactggagaagacagaaccttatttcattgggatcttttgctttgaagctgggatcaaaattgtggccctggggttcatcttccataagggctcttacctccgcaatggctggaatgtcatggacttcatcgtggtcctcagtggcatcctggccactgcaggaacccacttcaatactcacgtggacctgaggaccctccgggctgtgcgtgtcctgcggcctttgaagctcgtgtcagggatacctagcctgcagattgtgttgaagtccatcatgaaggccatggtacctcttctgcagattggccttctgctcttctttgccatcctgatgtttgctatcattggtttggagttctacagtggcaagttacatcgagcatgcttcatgaacaattcaggtattctagaaggatttgacccccctcacccatgtggtgtgcagggctgcccagctggttatgaatgcaaggactggatcggccccaatgatgggatcacccagtttgataacatcctttttgctgtgctgactgtcttccagtgcatcaccatggaagggtggaccactgtgctgtacaataccaatgatgccttaggagccacctggaattggctgtacttcatccccctcatcatcattggatccttctttgttctcaacctagtcctgggagtgctttccggggaatttgccaaagagagagagagagtggagaaccgaagggctttcatgaagctgcggcgccagcagcagattgagcgtgagctgaatggctaccgtgcctggatagacaaagcagaggaagtcatgctcgctgaagaaaataaaaatgctggaacatccgccttagaagtgcttcgaagggcaaccatcaagaggagccggacagaggccatgactcgagactccagtgatgagcactgtgttgatatctcctctgtgggcacacctctggcccgagccagtatcaaaagtgcaaaggtagacggggtctcttatttccggcacaaggaaaggcttctgcgcatctccattcgccacatggttaaatcccaggtgttttactggattgtgctgagccttgtggcactcaacactgcctgtgtggccattgtccatcacaaccagccccagtggctcacccacctcctctactatgcagaatttctgtttctgggactcttcctcttggagatgtccctgaagatgtatggcatggggcctcgcctttattttcactcttcattcaactgctttgattttggggtcacagtgggcagtatctttgaagtggtctgggcaatcttcagacctggtacgtcttttggaatcagtgtcttgcgagccctccggcttctaagaatatttaaaataaccaagtattgggcttccctacggaatttggtggtctccttgatgagctcaatgaagtctatcatcagtttgcttttcctcctcttcctcttcatcgttgtctttgctctcctaggaatgcagttatttggaggcaggtttaactttaatgatgggactccttcggcaaattttgataccttccctgcagccatcatgactgtgttccagatcctgacgggtgaggactggaatgaggtgatgtacaatgggatccgctcccagggtggggtcagctcaggcatgtggtctgccatctacttcattgtgctcaccttgtttggcaactacacgctactgaatgtgttcttggctatcgctgtggataatctcgccaacgcccaggaactgaccaaggatgaacaggaggaagaagaggccttcaaccagaaacatgcactgcagaaggccaaggaggtcagcccgatgtctgcacccaacatgccttcgatcgaaagagacagaaggagaagacaccacatgtcgatgtgggagccacgcagcagccacctgagggagcggaggcgccggcaccacatgtccgtgtgggagcagcgtaccagccagctgaggaagcacatgcagatgtccagccaggaggccctcaacagagaggaggcgccgaccatgaacccgctcaaccccctcaacccgctcagctccctcaacccgctcaatgcccaccccagcctttatcggcgacccagggccattgagggcctggccctgggcctggccctggagaagttcgaggaggagcgcatcagccgtggggggtccctcaagggggatggaggggaccgatccagtgccctggacaaccagaggacccctttgtccctgggccagcgggagccaccatggctggccaggccctgtcatggaaactgtgacccgactcagcaggaggcagggggaggagaggctgtggtgacctttgaggaccgggccaggcacaggcagagccaacggcgcagccggcatcgccgcgtcaggacagaaggcaaggagtcctcttcagcctcccggagcaggtctgccagccaggaacgcagtctggatgaagccatgcccactgaaggggagaaggaccatgagctcaggggcaaccatggtgccaaggagccaacgatccaagaagagagagcccaggatttaaggaggaccaacagtctgatggtgtccagaggctccgggctggcaggaggccttgatgaggctgacacccccctagtcctgccccatcctgagctggaagtggggaagcacgtggtgctgacggagcaggagccagaaggcagcagtgagcaggccctgctggggaatgtgcagctagacatgggccgggtcatcagccagagcgagcctgacctctcctgcatcacggccaacacggacaaggccaccaccgagagcaccagcgtcaccgtcgccatccccgacgtggaccccttggtggactcaaccgtggtgcacattagcaacaagacggatggggaagccagtcccttgaaggaggcagagatcagagaggatgaggaggaggtggagaagaagaagcagaagaaggagaagcgtgagacaggcaaagccatggtgccccacagctcaatgttcatcttcagcaccaccaacccgatccggagggcctgccactacatcgtgaacctgcgctactttgagatgtgcatcctcctggtgattgcagccagcagcatcgccctggcggcagaggaccccgtcctgaccaactcggagcgcaacaaagtcctgaggtattttgactatgtgttcacgggcgtgttcacctttgagatggttataaagatgatagaccaaggcttgatcctgcaggatgggtcctacttccgagacttgtggaacatcctggactttgtggtggtcgttggcgcattggtggcctttgctctggctaacagcatgaaaaccaacaaaggacgggacatcaagaccatcaagtctctgcgggtgctccgagttctaaggccactgaaaaccatcaagcgcttgcccaagctcaaggccgtcttcgactgcgtagtgacctccttgaagaatgtcttcaacatactcattgtgtacaagctcttcatgttcatctttgctgtcatcgcagttcagctcttcaagggaaagttcttttattgcacggacagttccaaggacacagagaaggagtgcataggcaactatgtagatcatgagaaaaacaagatggaggtgaagggccgggaatggaagcgccatgaattccactacgacaacattatctgggccctgctgaccctcttcaccgtctccacaggggaaggatggcctcaagttctgcagcactctgtagatgtgacagaggaagaccgaggcccaagccgcagcaaccgcatggagatgtctatcttttatgtagtctactttgtggtcttccccttcttctttgtcaatatctttgtggctctcatcatcatcaccttccaggagcaaggggataagatgatggaggagtgcagcctggagaagaatgagagggcgtgcatcgacttcgccatcagcgccaaacctctcacccgctacatgccgcagaacagacacaccttccagtaccgcgtgtggcactttgtggtgtctccgtcctttgagtacaccattatggccatgatcgccttgaatactgttgtgctgatgatgaagtattattctgctccctgtacctatgagctggccctgaagtacctgaatatcgccttcaccatggtgttttccctggaatgtgtcctgaaggtcatcgcttttggctttttgaactatttccgagacacctggaatatctttgacttcatcaccgtgattggcagtatcacagaaattatcctgacagacagcaagctggtgaacaccagtggcttcaatatgagctttctgaagctcttccgagctgcccgcctcataaagctcctgcgtcagggctataccatacgcattttgctgtggacctttgtgcagtcctttaaggccctcccttatgtctgccttttaattgccatgcttttcttcatttatgccatcattgggatgcaggtatttggaaacataaaattagacgaggagagtcacatcaaccggcacaacaacttccggagtttctttgggtccctaatgctactcttcaggagtgccacaggtgaggcctggcaggagattatgctgtcatgccttggggagaagggctgtgagcctgacaccaccgcaccatcagggcagaacgagaacgaacgctgcggcaccgatctggcctacgtgtactttgtctccttcatcttcttctgctccttcttgatgctcaacctgtttgtggccgtcatcatggacaactttgagtacctgactcgggactcctccatcctggggcctcaccacttggacgagtttgtccgcgtctgggcagaatatgaccgagcagcatgtggccgcatccattacactgagatgtatgaaatgctgactctcatgtcacctccgctaggcctcggcaagagatgtccctccaaagtggcatataagaggttggtcctgatgaacatgccagtagctgaggacatgacggtccacttcacctccacacttatggctctgatccggacagctctggacattaaaattgccaaaggtggtgcagacaggcagcagctagactcagagctacaaaaggagaccctagccatctggcctcacctatcccagaagatgctggatctgcttgtgcccatgcccaaagcctctgacctgactgtgggcaaaatctatgcagcaatgatgatcatggactactataagcagagtaaggtgaagaagcagaggcagcagctggaggaacagaaaaatgcccccatgttccagcgcatggagccttcatctctgcctcaggagatcattgctaatgccaaagccctgccttacctccagcaggaccccgtttcaggcctgagtggccggagtggatacccttcgatgagtccactctctccccaggatatattccagttggcttgtatggaccccgccgatgacggacagttccaagaacggcagtctctggagccagaggttagtgaattaaaaagcgtgcagccctctaaccatggcatctaccttccttcggacacccaggagcatgcgggatctgggagggcatcttctatgccacgtctgactgtggatccccaggtggtgacagaccctagctccatgagacgttcattttccactattcgggataagcgttcaaattcctcgtggttggaggaattctccatggagcgaagcagtgaaaatacctacaagtcccgtcgccggagttaccactcctccttgcggctgtcagcccaccgcctgaactctgattcaggccacaagtctgacactcaccgctcagggggcagggagcggggacgatcaaaagagcgaaagcatcttctctctcctgatgtctcccgctgcaattcagaagagcgagggacccaggctgactgggagtccccagagcgccgtcaatccaggtcacccagtgagggcaggtcacagacgcccaacagacagggcacaggttccctaagtgagagctccatcccctctgtctctgacaccagcaccccaagaagaagtcgtcggcagctcccacccgtcccgccaaagccccggcccctcctttcctacagctccctgattcgacacgcgggcagcatctctccacctgctgatggaagcgaggagggctccccgctgacctcccaagctctggagagcaacaatgcttgcctgaccgagtcttccaactctccgcacccccagcagagccaacatgcctccccacagcgctacatctccgagccctacttggccctgcacgaagactcccacgcctcagactgtggtgaggaggagacgctcactttcgaagcagccgtggctactagcctgggccgttccaacaccatcggctcagccccacccctgcggcatagctggcagatgcccaacgggcactatcggcggcggaggcgcggggggcctgggccaggcatgatgtgtggggctgtcaacaacctgctaagtgacacggaagaagatgacaaatgctagaggctgctcccccctccgatgcatgctcttctctcacatggagaaaaccaagacagaattgggaagccagtgcggcccgggggggaggaagagggaaaaggaagatggaaggacaccatgcattatcagagaagaggaagtaaaggacaatcagaacaccagtcaaacccaccaaattgctttattcccctttgcaagatgggcactgccatagttctgcctctttgctggggaaagaaaccaggaacgtggagggttattactgcgggagaagggacacgaggatggctttgcttccccttgccccttcccacttttctaaaagctgtggagggatctagctggcctatgtctacactcagtgccctgagaagcctggaagactttctggctcttaactggggagtagtggagaccataggagaggactctcctccctcaccagctcttacgcctcagccagcaccactgccaccagggcaactgcagcagcatctcatgcataaccctgtggcttgcttcccccagggcagcacaggctaagtcaggaacatcggatgccagggagggaggagaaagccgaagcgaaaggggtcagggtgctgaggcaacagcagcaagggctggtctggacaagaaaagccatagcccggcagcccctaccatgagggagacagagaaacagaactggtggtgctggggggtatagccccccatccttgaggcctgtcacccacacagtaggtgctgagagttaggacaggtcaggaagtcccccagggtccacaaaggtgcctgaggctctggtaagggtgaagataaaagtatttaacaaccgctatggcatcaatgtaagtggagtttggtcctagtgccggagcccatgctattccaggcattggctctttagatgccagtcatgggggaaccctgagggtgtgggtagagtagcaggggccacctaagagattaaaaacagtctgttttccaaccagtgtggaagcaattaaatatgcgtaacagtgctacggccacaccagcacctcctggctgaaggtcagcccacactctggtccatgaggcagcaaggccagtgctgtgccaagcccggtaaggccaagtgccgaggcccagccttccctgccactcctctgagagggcagaacacacatatccaagtaggctacccaccactgggtagggatttctgtaaagatgggaaaggctgatagattgaaataagcttctgtgaaagtctggatttactgaggacctcccctgaggagggaccgttgggaccgcagattctgcagctggtgtggggttcaggtcagtttgtcaggatgctttaaggtgattagtaaatatacctcagcttagacttgggctgctccttctagcaaagcaggctccagtggggcctcatcatacaggatgacaagactggggccctgttcaccttgaacatgcccctgggccaagatggggcttcacccctccccagagtaagagctggggctgacagtcccaccctgtcattcctaatagcccaaacgcagaagcactgagcaagagagccctttcttgccaagccagtgctcttttggtatatggcatacagctccattggaggggacacatcactggctttatctggtggaaatgtacctttcccttaagttcctccttagtgccatcacagcaggtgaatgggtgccctacggggccctccttcccccaccaggaacagatggaacctgccacccaggatcctgatctgccctgcactgagcactcagtggataaacactcctccagcccagacacactcctcctcttgggcaggagcaatccagagttgttatttttcttagaaggagcctcttttccctctattttttaaattgaaatataatagctgcatcagccctgaaaagccaaattcaaccacatggctggagaatcatttgtcatggccccgccttctcttctgatactaatggagcttcatgacccacggtcagcccccaaaccaaagttgtcccaacagaggaggccagtgaggcagagacagagctctcccactctcagaccctcttttgtcttcattttcctctcccacttagcacatgtgtgcttgagggtggctgggaatgtgatatacagcaccctgatcctaacaggtgtgattgttacgtaagacgctgatactgggccttgtattgcttttaaagtttcctctgctcagcatcatttcatgccaaagtgctgctatgggctgctttgtgtgcacaaaattgctttttccacctcggaaatgcagctttccctagggggaggcctacaacaggacgaccattctgagccagtgagtctattgcatggtgttttgagaaagggaattttagtgacaccttatgccatttcaagaggagaaatgcaggctggcagagcaatttccagaaatggaatttgcctgcaaatagtataaacaacactaaatttactgtgccaggaaatcttcctgaactccttgaactcatacacacaggtatttgagtcctgaataaagtgttggaaagcactgcagatgcggtcacctgactgaccacctgggttttctattaccagtgaatttcttttattcaccttcccttgaccaagaaattgggtttcttttccctcagcctgcacttactcttctattaagaccagaaaataaaataattttccgttgagtc

SEQ ID NO: 4216 - DNA, 9662 bp, Homo sapiens
gctgctgctgcctctccgaagagctcgcggagctccccagaggcggtggtccccgtgcttgtctggatgcggctctgagtctccgtgtgtctttctgcttgttgctgtgtgcgggtgttcggccgcgatcacctttgtgtgtcttctgtctgtttaaacctcaggatggctcgcttcggggaggcggtggtcgccaggccagggtccggcgatggagactcggaccagagcaggaaccggcaaggaacccccgtgccggcctcggggcaggcggccgcctacaagcagacgaaagcacagagggcgcggactatggctttgtacaaccccattcccgtccggcagaactgtttcaccgtcaacagatccctgttcatcttcggagaagataacattgtcaggaaatatgccaagaagctcatcgattggccgccatttgagtacatgatcctggccaccatcattgccaactgcatcgtcctggccctggagcagcatcttcctgaggatgacaagacccccatgtcccgaagactggagaagacagaaccttatttcattgggatcttttgctttgaagctgggatcaaaattgtggccctggggttcatcttccataagggctcttacctccgcaatggctggaatgtcatggacttcatcgtggtcctcagtggcatcctggccactgcaggaacccacttcaatactcacgtggacctgaggaccctccgggctgtgcgtgtcctgcggcctttgaagctcgtgtcagggatacctagcctgcagattgtgttgaagtccatcatgaaggccatggtacctcttctgcagattggccttctgctcttctttgccatcctgatgtttgctatcattggtttggagttctacagtggcaagttacatcgagcatgcttcatgaacaattcaggtattctagaaggatttgacccccctcacccatgtggtgtgcagggctgcccagctggttatgaatgcaaggactggatcggccccaatgatgggatcacccagtttgataacatcctttttgctgtgctgactgtcttccagtgcatcaccatggaagggtggaccactgtgctgtacaataccaatgatgccttaggagccacctggaattggctgtacttcatccccctcatcatcattggatccttctttgttctcaacctagtcctgggagtgctttccggggaatttgccaaagagagagagagagtggagaaccgaagggctttcatgaagctgcggcgccagcagcagattgagcgtgagctgaatggctaccgtgcctggatagacaaagcagaggaagtcatgctcgctgaagaaaataaaaatgctggaacatccgccttagaagtgcttcgaagggcaaccatcaagaggagccggacagaggccatgactcgagactccagtgatgagcactgtgttgatatctcctctgtgggcacacctctggcccgagccagtatcaaaagtgcaaaggtagacggggtctcttatttccggcacaaggaaaggcttctgcgcatctccattcgccacatggttaaatcccaggtgttttactggattgtgctgagccttgtggcactcaacactgcctgtgtggccattgtccatcacaaccagccccagtggctcacccacctcctctactatgcagaatttctgtttctgggactcttcctcttggagatgtccctgaagatgtatggcatggggcctcgcctttattttcactcttcattcaactgctttgattttggggtcacagtgggcagtatctttgaagtggtctgggcaatcttcagacctggtacgtcttttggaatcagtgtcttgcgagccctccggcttctaagaatatttaaaataaccaagtattgggcttccctacggaatttggtggtctccttgatgagctcaatgaagtctatcatcagtttgcttttcctcctcttcctcttcatcgttgtctttgctctcctaggaatgcagttatttggaggcaggtttaactttaatgatgggactccttcggcaaattttgataccttccctgcagccatcatgactgtgttccagatcctgacgggtgaggactggaatgaggtgatgtacaatgggatccgctcccagggtggggtcagctcaggcatgtggtctgccatctacttcattgtgctcaccttgtttggcaactacacgctactgaatgtgttcttggctatcgctgtggataatctcgccaacgcccaggaactgaccaaggatgaacaggaggaagaagaggccttcaaccagaaacatgcactgcagaaggccaaggaggtcagcccgatgtctgcacccaacatgccttcgatcgagagggagcggaggcgccggcaccacatgtccgtgtgggagcagcgtaccagccagctgaggaagcacatgcagatgtccagccaggaggccctcaacagagaggaggcgccgaccatgaacccgctcaaccccctcaacccgctcagctccctcaacccgctcaatgcccaccccagcctttatcggcgacccagggccattgagggcctggccctgggcctggccctggagaagttcgaggaggagcgcatcagccgtggggggtccctcaagggggatggaggggaccgatccagtgccctggacaaccagaggacccctttgtccctgggccagcgggagccaccatggctggccaggccctgtcatggaaactgtgacccgactcagcaggaggcagggggaggagaggctgtggtgacctttgaggaccgggccaggcacaggcagagccaacggcgcagccggcatcgccgcgtcaggacagaaggcaaggagtcctcttcagcctcccggagcaggtctgccagccaggaacgcagtctggatgaagccatgcccactgaaggggagaaggaccatgagctcaggggcaaccatggtgccaaggagccaacgatccaagaagagagagcccaggatttaaggaggaccaacagtctgatggtgtccagaggctccgggctggcaggaggccttgatgaggctgacacccccctagtcctgccccatcctgagctggaagtggggaagcacgtggtgctgacggagcaggagccagaaggcagcagtgagcaggccctgctggggaatgtgcagctagacatgggccgggtcatcagccagagcgagcctgacctctcctgcatcacggccaacacggacaaggccaccaccgagagcaccagcgtcaccgtcgccatccccgacgtggaccccttggtggactcaaccgtggtgcacattagcaacaagacggatggggaagccagtcccttgaaggaggcagagatcagagaggatgaggaggaggtggagaagaagaagcagaagaaggagaagcgtgagacaggcaaagccatggtgccccacagctcaatgttcatcttcagcaccaccaacccgatccggagggcctgccactacatcgtgaacctgcgctactttgagatgtgcatcctcctggtgattgcagccagcagcatcgccctggcggcagaggaccccgtcctgaccaactcggagcgcaacaaagtcctgaggtattttgactatgtgttcacgggcgtgttcacctttgagatggttataaagatgatagaccaaggcttgatcctgcaggatgggtcctacttccgagacttgtggaacatcctggactttgtggtggtcgttggcgcattggtggcctttgctctggctaacagcatgaaaaccaacaaaggacgggacatcaagaccatcaagtctctgcgggtgctccgagttctaaggccactgaaaaccatcaagcgcttgcccaagctcaaggccgtcttcgactgcgtagtgacctccttgaagaatgtcttcaacatactcattgtgtacaagctcttcatgttcatctttgctgtcatcgcagttcagctcttcaagggaaagttcttttattgcacggacagttccaaggacacagagaaggagtgcataggcaactatgtagatcatgagaaaaacaagatggaggtgaagggccgggaatggaagcgccatgaattccactacgacaacattatctgggccctgctgaccctcttcaccgtctccacaggggaaggatggcctcaagttctgcagcactctgtagatgtgacagaggaagaccgaggcccaagccgcagcaaccgcatggagatgtctatcttttatgtagtctactttgtggtcttccccttcttctttgtcaatatctttgtggctctcatcatcatcaccttccaggagcaaggggataagatgatggaggagtgcagcctggagaagaatgagagggcgtgcatcgacttcgccatcagcgccaaacctctcacccgctacatgccgcagaacagacacaccttccagtaccgcgtgtggcactttgtggtgtctccgtcctttgagtacaccattatggccatgatcgccttgaatactgttgtgctgatgatgaagtattattctgctccctgtacctatgagctggccctgaagtacctgaatatcgccttcaccatggtgttttccctggaatgtgtcctgaaggtcatcgcttttggctttttgaactatttccgagacacctggaatatctttgacttcatcaccgtgattggcagtatcacagaaattatcctgacagacagcaagctggtgaacaccagtggcttcaatatgagctttctgaagctcttccgagctgcccgcctcataaagctcctgcgtcagggctataccatacgcattttgctgtggacctttgtgcagtcctttaaggccctcccttatgtctgccttttaattgccatgcttttcttcatttatgccatcattgggatgcaggtatttggaaacataaaattagacgaggagagtcacatcaaccggcacaacaacttccggagtttctttgggtccctaatgctactcttcaggagtgccacaggtgaggcctggcaggagattatgctgtcatgccttggggagaagggctgtgagcctgacaccaccgcaccatcagggcagaacgagaacgaacgctgcggcaccgatctggcctacgtgtactttgtctccttcatcttcttctgctccttcttgatgctcaacctgtttgtggccgtcatcatggacaactttgagtacctgactcgggactcctccatcctggggcctcaccacttggacgagtttgtccgcgtctgggcagaatatgaccgagcagcatgcggcaggatcccgtataaggatatgtacaaattagtgcgggtgatctcgcctcctctgggcctgggagagaactgcccctacagggtggcttgcaagaggttggtcctgatgaacatgccagtagctgaggacatgacggtccacttcacctccacacttatggctctgatccggacagctctggacattaaaattgccaaaggtggtgcagacaggcagcagctagactcagagctacaaaaggagaccctagccatctggcctcacctatcccagaagatgctggatctgcttgtgcccatgcccaaagcctctgacctgactgtgggcaaaatctatgcagcaatgatgatcatggactactataagcagagtaaggtgaagaagcagaggcagcagctggaggaacagaaaaatgcccccatgttccagcgcatggagccttcatctctgcctcaggagatcattgctaatgccaaagccctgccttacctccagcaggaccccgtttcaggcctgagtggccggagtggatacccttcgatgagtccactctctccccaggatatattccagttggcttgtatggaccccgccgatgacggacagttccaagaacggcagtctctggtggtgacagaccctagctccatgagacgttcattttccactattcgggataagcgttcaaattcctcgtggttggaggaattctccatggagcgaagcagtgaaaatacctacaagtcccgtcgccggagttaccactcctccttgcggctgtcagcccaccgcctgaactctgattcaggccacaagtctgacactcaccgctcagggggcagggagcggggacgatcaaaagagcgaaagcatcttctctctcctgatgtctcccgctgcaattcagaagagcgagggacccaggctgactgggagtccccagagcgccgtcaatccaggtcacccagtgagggcaggtcacagacgcccaacagacagggcacaggttccctaagtgagagctccatcccctctgtctctgacaccagcaccccaagaagaagtcgtcggcagctcccacccgtcccgccaaagccccggcccctcctttcctacagctccctgattcgacacgcgggcagcatctctccacctgctgatggaagcgaggagggctccccgctgacctcccaagctctggagagcaacaatgcttgcctgaccgagtcttccaactctccgcacccccagcagagccaacatgcctccccacagcgctacatctccgagccctacttggccctgcacgaagactcccacgcctcagactgtggtgaggaggagacgctcactttcgaagcagccgtggctactagcctgggccgttccaacaccatcggctcagccccacccctgcggcatagctggcagatgcccaacgggcactatcggcggcggaggcgcggggggcctgggccaggcatgatgtgtggggctgtcaacaacctgctaagtgacacggaagaagatgacaaatgctagaggctgctcccccctccgatgcatgctcttctctcacatggagaaaaccaagacagaattgggaagccagtgcggcccgggggggaggaagagggaaaaggaagatggaaggacaccatgcattatcagagaagaggaagtaaaggacaatcagaacaccagtcaaacccaccaaattgctttattcccctttgcaagatgggcactgccatagttctgcctctttgctggggaaagaaaccaggaacgtggagggttattactgcgggagaagggacacgaggatggctttgcttccccttgccccttcccacttttctaaaagctgtggagggatctagctggcctatgtctacactcagtgccctgagaagcctggaagactttctggctcttaactggggagtagtggagaccataggagaggactctcctccctcaccagctcttacgcctcagccagcaccactgccaccagggcaactgcagcagcatctcatgcataaccctgtggcttgcttcccccagggcagcacaggctaagtcaggaacatcggatgccagggagggaggagaaagccgaagcgaaaggggtcagggtgctgaggcaacagcagcaagggctggtctggacaagaaaagccatagcccggcagcccctaccatgagggagacagagaaacagaactggtggtgctggggggtatagccccccatccttgaggcctgtcacccacacagtaggtgctgagagttaggacaggtcaggaagtcccccagggtccacaaaggtgcctgaggctctggtaagggtgaagataaaagtatttaacaaccgctatggcatcaatgtaagtggagtttggtcctagtgccggagcccatgctattccaggcattggctctttagatgccagtcatgggggaaccctgagggtgtgggtagagtagcaggggccacctaagagattaaaaacagtctgttttccaaccagtgtggaagcaattaaatatgcgtaacagtgctacggccacaccagcacctcctggctgaaggtcagcccacactctggtccatgaggcagcaaggccagtgctgtgccaagcccggtaaggccaagtgccgaggcccagccttccctgccactcctctgagagggcagaacacacatatccaagtaggctacccaccactgggtagggatttctgtaaagatgggaaaggctgatagattgaaataagcttctgtgaaagtctggatttactgaggacctcccctgaggagggaccgttgggaccgcagattctgcagctggtgtggggttcaggtcagtttgtcaggatgctttaaggtgattagtaaatatacctcagcttagacttgggctgctccttctagcaaagcaggctccagtggggcctcatcatacaggatgacaagactggggccctgttcaccttgaacatgcccctgggccaagatggggcttcacccctccccagagtaagagctggggctgacagtcccaccctgtcattcctaatagcccaaacgcagaagcactgagcaagagagccctttcttgccaagccagtgctcttttggtatatggcatacagctccattggaggggacacatcactggctttatctggtggaaatgtacctttcccttaagttcctccttagtgccatcacagcaggtgaatgggtgccctacggggccctccttcccccaccaggaacagatggaacctgccacccaggatcctgatctgccctgcactgagcactcagtggataaacactcctccagcccagacacactcctcctcttgggcaggagcaatccagagttgttatttttcttagaaggagcctcttttccctctattttttaaattgaaatataatagctgcatcagccctgaaaagccaaattcaaccacatggctggagaatcatttgtcatggccccgccttctcttctgatactaatggagcttcatgacccacggtcagcccccaaaccaaagttgtcccaacagaggaggccagtgaggcagagacagagctctcccactctcagaccctcttttgtcttcattttcctctcccacttagcacatgtgtgcttgagggtggctgggaatgtgatatacagcaccctgatcctaacaggtgtgattgttacgtaagacgctgatactgggccttgtattgcttttaaagtttcctctgctcagcatcatttcatgccaaagtgctgctatgggctgctttgtgtgcacaaaattgctttttccacctcggaaatgcagctttccctagggggaggcctacaacaggacgaccattctgagccagtgagtctattgcatggtgttttgagaaagggaattttagtgacaccttatgccatttcaagaggagaaatgcaggctggcagagcaatttccagaaatggaatttgcctgcaaatagtataaacaacactaaatttactgtgccaggaaatcttcctgaactccttgaactcatacacacaggtatttgagtcctgaataaagtgttggaaagcactgcagatgcggtcacctgactgaccacctgggttttctattaccagtgaatttcttttattcaccttcccttgaccaagaaattgggtttcttttccctcagcctgcacttactcttctattaagaccagaaaataaaataattttccgttgagtc

SEQ ID NO: 4217 - DNA, 6970 bp, Homo sapiens
cctcaggatggctcgcttcggggaggcggtggtcgccaggccagggtccggcgatggagactcggaccagagcaggaaccggcaaggaacccccgtgccggcctcggggcaggcggccgcctacaagcagacgaaagcacagagggcgcggactatggctttgtacaaccccattcccgtccggcagaactgtttcaccgtcaacagatccctgttcatcttcggagaagataacattgtcaggaaatatgccaagaagctcatcgattggccgccatttgagtacatgatcctggccaccatcattgccaactgcatcgtcctggccctggagcagcatcttcctgaggatgacaagacccccatgtcccgaagactggagaagacagaaccttatttcattgggatcttttgctttgaagctgggatcaaaattgtggccctggggttcatcttccataagggctcttacctccgcaatggctggaatgtcatggacttcatcgtggtcctcagtggcatcctggccactgcaggaacccacttcaatactcacgtggacctgaggaccctccgggctgtgcgtgtcctgcggcctttgaagctcgtgtcagggatacctagcctgcagattgtgttgaagtccatcatgaaggccatggtacctcttctgcagattggccttctgctcttctttgccatcctgatgtttgctatcattggtttggagttctacagtggcaagttacatcgagcatgcttcatgaacaattcaggtattctagaaggatttgacccccctcacccatgtggtgtgcagggctgcccagctggttatgaatgcaaggactggatcggccccaatgatgggatcacccagtttgataacatcctttttgctgtgctgactgtcttccagtgcatcaccatggaagggtggaccactgtgctgtacaataccaatgatgccttaggagccacctggaattggctgtacttcatccccctcatcatcattggatccttctttgttctcaacctagtcctgggagtgctttccggggaatttgccaaagagagagagagagtggagaaccgaagggctttcatgaagctgcggcgccagcagcagattgagcgtgagctgaatggctaccgtgcctggatagacaaagcagaggaagtcatgctcgctgaagaaaataaaaatgctggaacatccgccttagaagtgcttcgaagggcaaccatcaagaggagccggacagaggccatgactcgagactccagtgatgagcactgtgttgatatctcctctgtgggcacacctctggcccgagccagtatcaaaagtgcaaaggtagacggggtctcttatttccggcacaaggaaaggcttctgcgcatctccattcgccacatggttaaatcccaggtgttttactggattgtgctgagccttgtggcactcaacactgcctgtgtggccattgtccatcacaaccagccccagtggctcacccacctcctctactatgcagaatttctgtttctgggactcttcctcttggagatgtccctgaagatgtatggcatggggcctcgcctttattttcactcttcattcaactgctttgattttggggtcacagtgggcagtatctttgaagtggtctgggcaatcttcagacctggtacgtcttttggaatcagtgtcttgcgagccctccggcttctaagaatatttaaaataaccaagtattgggcttccctacggaatttggtggtctccttgatgagctcaatgaagtctatcatcagtttgcttttcctcctcttcctcttcatcgttgtctttgctctcctaggaatgcagttatttggaggcaggtttaactttaatgatgggactccttcggcaaattttgataccttccctgcagccatcatgactgtgttccagatcctgacgggtgaggactggaatgaggtgatgtacaatgggatccgctcccagggtggggtcagctcaggcatgtggtctgccatctacttcattgtgctcaccttgtttggcaactacacgctactgaatgtgttcttggctatcgctgtggataatctcgccaacgcccaggaactgaccaaggatgaacaggaggaagaagaggccttcaaccagaaacatgcactgcagaaggccaaggaggtcagcccgatgtctgcacccaacatgccttcgatcgagagggagcggaggcgccggcaccacatgtccgtgtgggagcagcgtaccagccagctgaggaagcacatgcagatgtccagccaggaggccctcaacagagaggaggcgccgaccatgaacccgctcaaccccctcaacccgctcagctccctcaacccgctcaatgcccaccccagcctttatcggcgacccagggccattgagggcctggccctgggcctggccctggagaagttcgaggaggagcgcatcagccgtggggggtccctcaagggggatggaggggaccgatccagtgccctggacaaccagaggacccctttgtccctgggccagcgggagccaccatggctggccaggccctgtcatggaaactgtgacccgactcagcaggaggcagggggaggagaggctgtggtgacctttgaggaccgggccaggcacaggcagagccaacggcgcagccggcatcgccgcgtcaggacagaaggcaaggagtcctcttcagcctcccggagcaggtctgccagccaggaacgcagtctggatgaagccatgcccactgaaggggagaaggaccatgagctcaggggcaaccatggtgccaaggagccaacgatccaagaagagagagcccaggatttaaggaggaccaacagtctgatggtgtccagaggctccgggctggcaggaggccttgatgaggctgacacccccctagtcctgccccatcctgagctggaagtggggaagcacgtggtgctgacggagcaggagccagaaggcagcagtgagcaggccctgctggggaatgtgcagctagacatgggccgggtcatcagccagagcgagcctgacctctcctgcatcacggccaacacggacaaggccaccaccgagagcaccagcgtcaccgtcgccatccccgacgtggaccccttggtggactcaaccgtggtgcacattagcaacaagacggatggggaagccagtcccttgaaggaggcagagatcagagaggatgaggaggaggtggagaagaagaagcagaagaaggagaagcgtgagacaggcaaagccatggtgccccacagctcaatgttcatcttcagcaccaccaacccgatccggagggcctgccactacatcgtgaacctgcgctactttgagatgtgcatcctcctggtgattgcagccagcagcatcgccctggcggcagaggaccccgtcctgaccaactcggagcgcaacaaagtcctgaggtattttgactatgtgttcacgggcgtgttcacctttgagatggttataaagatgatagaccaaggcttgatcctgcaggatgggtcctacttccgagacttgtggaacatcctggactttgtggtggtcgttggcgcattggtggcctttgctctggcgaacgctttgggaaccaacaaaggacgggacatcaagaccatcaagtctctgcgggtgctccgagttctaaggccactgaaaaccatcaagcgcttgcccaagctcaaggccgtcttcgactgcgtagtgacctccttgaagaatgtcttcaacatactcattgtgtacaagctcttcatgttcatctttgctgtcatcgcagttcagctcttcaagggaaagttcttttattgcacggacagttccaaggacacagagaaggagtgcataggcaactatgtagatcatgagaaaaacaagatggaggtgaagggccgggaatggaagcgccatgaattccactacgacaacattatctgggccctgctgaccctcttcaccgtctccacaggggaaggatggcctcaagttctgcagcactctgtagatgtgacagaggaagaccgaggcccaagccgcagcaaccgcatggagatgtctatcttttatgtagtctactttgtggtcttccccttcttctttgtcaatatctttgtggctctcatcatcatcaccttccaggagcaaggggataagatgatggaggagtgcagcctggagaagaatgagagggcgtgcatcgacttcgccatcagcgccaaacctctcacccgctacatgccgcagaacagacacaccttccagtaccgcgtgtggcactttgtggtgtctccgtcctttgagtacaccattatggccatgatcgccttgaatactgttgtgctgatgatgaagtattattctgctccctgtacctatgagctggccctgaagtacctgaatatcgccttcaccatggtgttttccctggaatgtgtcctgaaggtcatcgcttttggctttttgaactatttccgagacacctggaatatctttgacttcatcaccgtgattggcagtatcacagaaattatcctgacagacagcaagctggtgaacaccagtggcttcaatatgagctttctgaagctcttccgagctgcccgcctcataaagctcctgcgtcagggctataccatacgcattttgctgtggacctttgtgcagtcctttaaggccctcccttatgtctgccttttaattgccatgcttttcttcatttatgccatcattgggatgcaggtatttggaaacataaaattagacgaggagagtcacatcaaccggcacaacaacttccggagtttctttgggtccctaatgctactcttcaggagtgccacaggtgaggcctggcaggagattatgctgtcatgccttggggagaagggctgtgagcctgacaccaccgcaccatcagggcagaacgagaacgaacgctgcggcaccgatctggcctacgtgtactttgtctccttcatcttcttctgctccttcttgatgctcaacctgtttgtggccgtcatcatggacaactttgagtacctgactcgggactcctccatcctggggcctcaccacttggacgagtttgtccgcgtctgggcagaatatgaccgagcagcatgtggccgcatccattacactgagatgtatgaaatgctgactctcatgtcacctccgctaggcctcggcaagagatgtccctccaaagtggcatataagaggttggtcctgatgaacatgccagtagctgaggacatgacggtccacttcacctccacacttatggctctgatccggacagctctggacattaaaattgccaaaggtggtgcagacaggcagcagctagactcagagctacaaaaggagaccctagccatctggcctcacctatcccagaagatgctggatctgcttgtgcccatgcccaaagcctctgacctgactgtgggcaaaatctatgcagcaatgatgatcatggactactataagcagagtaaggtgaagaagcagaggcagcagctggaggaacagaaaaatgcccccatgttccagcgcatggagccttcatctctgcctcaggagatcattgctaatgccaaagccctgccttacctccagcaggaccccgtttcaggcctgagtggccggagtggatacccttcgatgagtccactctctccccaggatatattccagttggcttgtatggaccccgccgatgacggacagttccaagaacggcagtctctggagccagaggttagtgaattaaaaagcgtgcagccctctaaccatggcatctaccttccttcggacacccaggagcatgcgggatctgggagggcatcttctatgccacgtctgactgtggatccccaggtggtgacagaccctagctccatgagacgttcattttccactattcgggataagcgttcaaattcctcgtggttggaggaattctccatggagcgaagcagtgaaaatacctacaagtcccgtcgccggagttaccactcctccttgcggctgtcagcccaccgcctgaactctgattcaggccacaagtctgacactcaccgctcagggggcagggagcggggacgatcaaaagagcgaaagcatcttctctctcctgatgtctcccgctgcaattcagaagagcgagggacccaggctgactgggagtccccagagcgccgtcaatccaggtcacccagtgagggcaggtcacagacgcccaacagacagggcacaggttccctaagtgagagctccatcccctctgtctctgacaccagcaccccaagaagaagtcgtcggcagctcccacccgtcccgccaaagccccggcccctcctttcctacagctccctgattcgacacgcgggcagcatctctccacctgctgatggaagcgaggagggctccccgctgacctcccaagctctggagagcaacaatgcttgcctgaccgagtcttccaactctccgcacccccagcagagccaacatgcctccccacagcgctacatctccgagccctacttggccctgcacgaagactcccacgcctcagactgtggtgaggaggagacgctcactttcgaagcagccgtggctactagcctgggccgttccaacaccatcggctcagccccacccctgcggcatagctggcagatgcccaacgggcactatcggcggcggaggcgcggggggcctgggccaggcatgatgtgtggggctgtcaacaacctgctaagtgacacggaagaagatgacaaatgctagaggctgctcccccctccgatgcatgctcttctctcacatggagaaaaccaagacagaattgggaagccagtgcggccc

SEQ ID NO: 4218 - DNA, 9719 bp, Homo sapiens
gctgctgctgcctctccgaagagctcgcggagctccccagaggcggtggtccccgtgcttgtctggatgcggctctgagtctccgtgtgtctttctgcttgttgctgtgtgcgggtgttcggccgcgatcacctttgtgtgtcttctgtctgtttaaacctcaggatggctcgcttcggggaggcggtggtcgccaggccagggtccggcgatggagactcggaccagagcaggaaccggcaaggaacccccgtgccggcctcggggcaggcggccgcctacaagcagacgaaagcacagagggcgcggactatggctttgtacaaccccattcccgtccggcagaactgtttcaccgtcaacagatccctgttcatcttcggagaagataacattgtcaggaaatatgccaagaagctcatcgattggccgccatttgagtacatgatcctggccaccatcattgccaactgcatcgtcctggccctggagcagcatcttcctgaggatgacaagacccccatgtcccgaagactggagaagacagaaccttatttcattgggatcttttgctttgaagctgggatcaaaattgtggccctggggttcatcttccataagggctcttacctccgcaatggctggaatgtcatggacttcatcgtggtcctcagtggcatcctggccactgcaggaacccacttcaatactcacgtggacctgaggaccctccgggctgtgcgtgtcctgcggcctttgaagctcgtgtcagggatacctagcctgcagattgtgttgaagtccatcatgaaggccatggtacctcttctgcagattggccttctgctcttctttgccatcctgatgtttgctatcattggtttggagttctacagtggcaagttacatcgagcatgcttcatgaacaattcaggtattctagaaggatttgacccccctcacccatgtggtgtgcagggctgcccagctggttatgaatgcaaggactggatcggccccaatgatgggatcacccagtttgataacatcctttttgctgtgctgactgtcttccagtgcatcaccatggaagggtggaccactgtgctgtacaataccaatgatgccttaggagccacctggaattggctgtacttcatccccctcatcatcattggatccttctttgttctcaacctagtcctgggagtgctttccggggaatttgccaaagagagagagagagtggagaaccgaagggctttcatgaagctgcggcgccagcagcagattgagcgtgagctgaatggctaccgtgcctggatagacaaagcagaggaagtcatgctcgctgaagaaaataaaaatgctggaacatccgccttagaagtgcttcgaagggcaaccatcaagaggagccggacagaggccatgactcgagactccagtgatgagcactgtgttgatatctcctctgtgggcacacctctggcccgagccagtatcaaaagtgcaaaggtagacggggtctcttatttccggcacaaggaaaggcttctgcgcatctccattcgccacatggttaaatcccaggtgttttactggattgtgctgagccttgtggcactcaacactgcctgtgtggccattgtccatcacaaccagccccagtggctcacccacctcctctactatgcagaatttctgtttctgggactcttcctcttggagatgtccctgaagatgtatggcatggggcctcgcctttattttcactcttcattcaactgctttgattttggggtcacagtgggcagtatctttgaagtggtctgggcaatcttcagacctggtacgtcttttggaatcagtgtcttgcgagccctccggcttctaagaatatttaaaataaccaagtattgggcttccctacggaatttggtggtctccttgatgagctcaatgaagtctatcatcagtttgcttttcctcctcttcctcttcatcgttgtctttgctctcctaggaatgcagttatttggaggcaggtttaactttaatgatgggactccttcggcaaattttgataccttccctgcagccatcatgactgtgttccagatcctgacgggtgaggactggaatgaggtgatgtacaatgggatccgctcccagggtggggtcagctcaggcatgtggtctgccatctacttcattgtgctcaccttgtttggcaactacacgctactgaatgtgttcttggctatcgctgtggataatctcgccaacgcccaggaactgaccaaggatgaacaggaggaagaagaggccttcaaccagaaacatgcactgcagaaggccaaggaggtcagcccgatgtctgcacccaacatgccttcgatcgaaagagacagaaggagaagacaccacatgtcgatgtgggagccacgcagcagccacctgagggagcggaggcgccggcaccacatgtccgtgtgggagcagcgtaccagccagctgaggaagcacatgcagatgtccagccaggaggccctcaacagagaggaggcgccgaccatgaacccgctcaaccccctcaacccgctcagctccctcaacccgctcaatgcccaccccagcctttatcggcgacccagggccattgagggcctggccctgggcctggccctggagaagttcgaggaggagcgcatcagccgtggggggtccctcaagggggatggaggggaccgatccagtgccctggacaaccagaggacccctttgtccctgggccagcgggagccaccatggctggccaggccctgtcatggaaactgtgacccgactcagcaggaggcagggggaggagaggctgtggtgacctttgaggaccgggccaggcacaggcagagccaacggcgcagccggcatcgccgcgtcaggacagaaggcaaggagtcctcttcagcctcccggagcaggtctgccagccaggaacgcagtctggatgaagccatgcccactgaaggggagaaggaccatgagctcaggggcaaccatggtgccaaggagccaacgatccaagaagagagagcccaggatttaaggaggaccaacagtctgatggtgtccagaggctccgggctggcaggaggccttgatgaggctgacacccccctagtcctgccccatcctgagctggaagtggggaagcacgtggtgctgacggagcaggagccagaaggcagcagtgagcaggccctgctggggaatgtgcagctagacatgggccgggtcatcagccagagcgagcctgacctctcctgcatcacggccaacacggacaaggccaccaccgagagcaccagcgtcaccgtcgccatccccgacgtggaccccttggtggactcaaccgtggtgcacattagcaacaagacggatggggaagccagtcccttgaaggaggcagagatcagagaggatgaggaggaggtggagaagaagaagcagaagaaggagaagcgtgagacaggcaaagccatggtgccccacagctcaatgttcatcttcagcaccaccaacccgatccggagggcctgccactacatcgtgaacctgcgctactttgagatgtgcatcctcctggtgattgcagccagcagcatcgccctggcggcagaggaccccgtcctgaccaactcggagcgcaacaaagtcctgaggtattttgactatgtgttcacgggcgtgttcacctttgagatggttataaagatgatagaccaaggcttgatcctgcaggatgggtcctacttccgagacttgtggaacatcctggactttgtggtggtcgttggcgcattggtggcctttgctctggcgatgtccctggaaaccaacaaaggacgggacatcaagaccatcaagtctctgcgggtgctccgagttctaaggccactgaaaaccatcaagcgcttgcccaagctcaaggccgtcttcgactgcgtagtgacctccttgaagaatgtcttcaacatactcattgtgtacaagctcttcatgttcatctttgctgtcatcgcagttcagctcttcaagggaaagttcttttattgcacggacagttccaaggacacagagaaggagtgcataggcaactatgtagatcatgagaaaaacaagatggaggtgaagggccgggaatggaagcgccatgaattccactacgacaacattatctgggccctgctgaccctcttcaccgtctccacaggggaaggatggcctcaagttctgcagcactctgtagatgtgacagaggaagaccgaggcccaagccgcagcaaccgcatggagatgtctatcttttatgtagtctactttgtggtcttccccttcttctttgtcaatatctttgtggctctcatcatcatcaccttccaggagcaaggggataagatgatggaggagtgcagcctggagaagaatgagagggcgtgcatcgacttcgccatcagcgccaaacctctcacccgctacatgccgcagaacagacacaccttccagtaccgcgtgtggcactttgtggtgtctccgtcctttgagtacaccattatggccatgatcgccttgaatactgttgtgctgatgatgaagtattattctgctccctgtacctatgagctggccctgaagtacctgaatatcgccttcaccatggtgttttccctggaatgtgtcctgaaggtcatcgcttttggctttttgaactatttccgagacacctggaatatctttgacttcatcaccgtgattggcagtatcacagaaattatcctgacagacagcaagctggtgaacaccagtggcttcaatatgagctttctgaagctcttccgagctgcccgcctcataaagctcctgcgtcagggctataccatacgcattttgctgtggacctttgtgcagtcctttaaggccctcccttatgtctgccttttaattgccatgcttttcttcatttatgccatcattgggatgcaggtatttggaaacataaaattagacgaggagagtcacatcaaccggcacaacaacttccggagtttctttgggtccctaatgctactcttcaggagtgccacaggtgaggcctggcaggagattatgctgtcatgccttggggagaagggctgtgagcctgacaccaccgcaccatcagggcagaacgagaacgaacgctgcggcaccgatctggcctacgtgtactttgtctccttcatcttcttctgctccttcttgatgctcaacctgtttgtggccgtcatcatggacaactttgagtacctgactcgggactcctccatcctggggcctcaccacttggacgagtttgtccgcgtctgggcagaatatgaccgagcagcatgtggccgcatccattacactgagatgtatgaaatgctgactctcatgtcacctccgctaggcctcggcaagagatgtccctccaaagtggcatataagaggttggtcctgatgaacatgccagtagctgaggacatgacggtccacttcacctccacacttatggctctgatccggacagctctggacattaaaattgccaaaggtggtgcagacaggcagcagctagactcagagctacaaaaggagaccctagccatctggcctcacctatcccagaagatgctggatctgcttgtgcccatgcccaaagcctctgacctgactgtgggcaaaatctatgcagcaatgatgatcatggactactataagcagagtaaggtgaagaagcagaggcagcagctggaggaacagaaaaatgcccccatgttccagcgcatggagccttcatctctgcctcaggagatcattgctaatgccaaagccctgccttacctccagcaggaccccgtttcaggcctgagtggccggagtggatacccttcgatgagtccactctctccccaggatatattccagttggcttgtatggaccccgccgatgacggacagttccaagaacggcagtctctggtggtgacagaccctagctccatgagacgttcattttccactattcgggataagcgttcaaattcctcgtggttggaggaattctccatggagcgaagcagtgaaaatacctacaagtcccgtcgccggagttaccactcctccttgcggctgtcagcccaccgcctgaactctgattcaggccacaagtctgacactcaccgctcagggggcagggagcggggacgatcaaaagagcgaaagcatcttctctctcctgatgtctcccgctgcaattcagaagagcgagggacccaggctgactgggagtccccagagcgccgtcaatccaggtcacccagtgagggcaggtcacagacgcccaacagacagggcacaggttccctaagtgagagctccatcccctctgtctctgacaccagcaccccaagaagaagtcgtcggcagctcccacccgtcccgccaaagccccggcccctcctttcctacagctccctgattcgacacgcgggcagcatctctccacctgctgatggaagcgaggagggctccccgctgacctcccaagctctggagagcaacaatgcttgcctgaccgagtcttccaactctccgcacccccagcagagccaacatgcctccccacagcgctacatctccgagccctacttggccctgcacgaagactcccacgcctcagactgtggtgaggaggagacgctcactttcgaagcagccgtggctactagcctgggccgttccaacaccatcggctcagccccacccctgcggcatagctggcagatgcccaacgggcactatcggcggcggaggcgcggggggcctgggccaggcatgatgtgtggggctgtcaacaacctgctaagtgacacggaagaagatgacaaatgctagaggctgctcccccctccgatgcatgctcttctctcacatggagaaaaccaagacagaattgggaagccagtgcggcccgggggggaggaagagggaaaaggaagatggaaggacaccatgcattatcagagaagaggaagtaaaggacaatcagaacaccagtcaaacccaccaaattgctttattcccctttgcaagatgggcactgccatagttctgcctctttgctggggaaagaaaccaggaacgtggagggttattactgcgggagaagggacacgaggatggctttgcttccccttgccccttcccacttttctaaaagctgtggagggatctagctggcctatgtctacactcagtgccctgagaagcctggaagactttctggctcttaactggggagtagtggagaccataggagaggactctcctccctcaccagctcttacgcctcagccagcaccactgccaccagggcaactgcagcagcatctcatgcataaccctgtggcttgcttcccccagggcagcacaggctaagtcaggaacatcggatgccagggagggaggagaaagccgaagcgaaaggggtcagggtgctgaggcaacagcagcaagggctggtctggacaagaaaagccatagcccggcagcccctaccatgagggagacagagaaacagaactggtggtgctggggggtatagccccccatccttgaggcctgtcacccacacagtaggtgctgagagttaggacaggtcaggaagtcccccagggtccacaaaggtgcctgaggctctggtaagggtgaagataaaagtatttaacaaccgctatggcatcaatgtaagtggagtttggtcctagtgccggagcccatgctattccaggcattggctctttagatgccagtcatgggggaaccctgagggtgtgggtagagtagcaggggccacctaagagattaaaaacagtctgttttccaaccagtgtggaagcaattaaatatgcgtaacagtgctacggccacaccagcacctcctggctgaaggtcagcccacactctggtccatgaggcagcaaggccagtgctgtgccaagcccggtaaggccaagtgccgaggcccagccttccctgccactcctctgagagggcagaacacacatatccaagtaggctacccaccactgggtagggatttctgtaaagatgggaaaggctgatagattgaaataagcttctgtgaaagtctggatttactgaggacctcccctgaggagggaccgttgggaccgcagattctgcagctggtgtggggttcaggtcagtttgtcaggatgctttaaggtgattagtaaatatacctcagcttagacttgggctgctccttctagcaaagcaggctccagtggggcctcatcatacaggatgacaagactggggccctgttcaccttgaacatgcccctgggccaagatggggcttcacccctccccagagtaagagctggggctgacagtcccaccctgtcattcctaatagcccaaacgcagaagcactgagcaagagagccctttcttgccaagccagtgctcttttggtatatggcatacagctccattggaggggacacatcactggctttatctggtggaaatgtacctttcccttaagttcctccttagtgccatcacagcaggtgaatgggtgccctacggggccctccttcccccaccaggaacagatggaacctgccacccaggatcctgatctgccctgcactgagcactcagtggataaacactcctccagcccagacacactcctcctcttgggcaggagcaatccagagttgttatttttcttagaaggagcctcttttccctctattttttaaattgaaatataatagctgcatcagccctgaaaagccaaattcaaccacatggctggagaatcatttgtcatggccccgccttctcttctgatactaatggagcttcatgacccacggtcagcccccaaaccaaagttgtcccaacagaggaggccagtgaggcagagacagagctctcccactctcagaccctcttttgtcttcattttcctctcccacttagcacatgtgtgcttgagggtggctgggaatgtgatatacagcaccctgatcctaacaggtgtgattgttacgtaagacgctgatactgggccttgtattgcttttaaagtttcctctgctcagcatcatttcatgccaaagtgctgctatgggctgctttgtgtgcacaaaattgctttttccacctcggaaatgcagctttccctagggggaggcctacaacaggacgaccattctgagccagtgagtctattgcatggtgttttgagaaagggaattttagtgacaccttatgccatttcaagaggagaaatgcaggctggcagagcaatttccagaaatggaatttgcctgcaaatagtataaacaacactaaatttactgtgccaggaaatcttcctgaactccttgaactcatacacacaggtatttgagtcctgaataaagtgttggaaagcactgcagatgcggtcacctgactgaccacctgggttttctattaccagtgaatttcttttattcaccttcccttgaccaagaaattgggtttcttttccctcagcctgcacttactcttctattaagaccagaaaataaaataattttccgttgagtc

SEQ ID NO: 4219 - DNA, 9724 bp, Homo sapiens
gctgctgctgcctctccgaagagctcgcggagctccccagaggcggtggtccccgtgcttgtctggatgcggctctgagtctccgtgtgtctttctgcttgttgctgtgtgcgggtgttcggccgcgatcacctttgtgtgtcttctgtctgtttaaacctcaggatggctcgcttcggggaggcggtggtcgccaggccagggtccggcgatggagactcggaccagagcaggaaccggcaaggaacccccgtgccggcctcggggcaggcggccgcctacaagcagacgaaagcacagagggcgcggactatggctttgtacaaccccattcccgtccggcagaactgtttcaccgtcaacagatccctgttcatcttcggagaagataacattgtcaggaaatatgccaagaagctcatcgattggccgccatttgagtacatgatcctggccaccatcattgccaactgcatcgtcctggccctggagcagcatcttcctgaggatgacaagacccccatgtcccgaagactggagaagacagaaccttatttcattgggatcttttgctttgaagctgggatcaaaattgtggccctggggttcatcttccataagggctcttacctccgcaatggctggaatgtcatggacttcatcgtggtcctcagtggcatcctggccactgcaggaacccacttcaatactcacgtggacctgaggaccctccgggctgtgcgtgtcctgcggcctttgaagctcgtgtcagggatacctagcctgcagattgtgttgaagtccatcatgaaggccatggtacctcttctgcagattggccttctgctcttctttgccatcctgatgtttgctatcattggtttggagttctacagtggcaagttacatcgagcatgcttcatgaacaattcaggtattctagaaggatttgacccccctcacccatgtggtgtgcagggctgcccagctggttatgaatgcaaggactggatcggccccaatgatgggatcacccagtttgataacatcctttttgctgtgctgactgtcttccagtgcatcaccatggaagggtggaccactgtgctgtacaataccaatgatgccttaggagccacctggaattggctgtacttcatccccctcatcatcattggatccttctttgttctcaacctagtcctgggagtgctttccggggaatttgccaaagagagagagagagtggagaaccgaagggctttcatgaagctgcggcgccagcagcagattgagcgtgagctgaatggctaccgtgcctggatagacaaagcagaggaagtcatgctcgctgaagaaaataaaaatgctggaacatccgccttagaagtgcttcgaagggcaaccatcaagaggagccggacagaggccatgactcgagactccagtgatgagcactgtgttgatatctcctctgtgggcacacctctggcccgagccagtatcaaaagtgcaaaggtagacggggtctcttatttccggcacaaggaaaggcttctgcgcatctccattcgccacatggttaaatcccaggtgttttactggattgtgctgagccttgtggcactcaacactgcctgtgtggccattgtccatcacaaccagccccagtggctcacccacctcctctactatgcagaatttctgtttctgggactcttcctcttggagatgtccctgaagatgtatggcatggggcctcgcctttattttcactcttcattcaactgctttgattttggggtcacagtgggcagtatctttgaagtggtctgggcaatcttcagacctggtacgtcttttggaatcagtgtcttgcgagccctccggcttctaagaatatttaaaataaccaagtattgggcttccctacggaatttggtggtctccttgatgagctcaatgaagtctatcatcagtttgcttttcctcctcttcctcttcatcgttgtctttgctctcctaggaatgcagttatttggaggcaggtttaactttaatgatgggactccttcggcaaattttgataccttccctgcagccatcatgactgtgttccagatcctgacgggtgaggactggaatgaggtgatgtacaatgggatccgctcccagggtggggtcagctcaggcatgtggtctgccatctacttcattgtgctcaccttgtttggcaactacacgctactgaatgtgttcttggctatcgctgtggataatctcgccaacgcccaggaactgaccaaggatgaacaggaggaagaagaggccttcaaccagaaacatgcactgcagaaggccaaggaggtcagcccgatgtctgcacccaacatgccttcgatcgaaagagacagaaggagaagacaccacatgtcgatgtgggagccacgcagcagccacctgagggagcggaggcgccggcaccacatgtccgtgtgggagcagcgtaccagccagctgaggaagcacatgcagatgtccagccaggaggccctcaacagagaggaggcgccgaccatgaacccgctcaaccccctcaacccgctcagctccctcaacccgctcaatgcccaccccagcctttatcggcgacccagggccattgagggcctggccctgggcctggccctggagaagttcgaggaggagcgcatcagccgtggggggtccctcaagggggatggaggggaccgatccagtgccctggacaaccagaggacccctttgtccctgggccagcgggagccaccatggctggccaggccctgtcatggaaactgtgacccgactcagcaggaggcagggggaggagaggctgtggtgacctttgaggaccgggccaggcacaggcagagccaacggcgcagccggcatcgccgcgtcaggacagaaggcaaggagtcctcttcagcctcccggagcaggtctgccagccaggaacgcagtctggatgaagccatgcccactgaaggggagaaggaccatgagctcaggggcaaccatggtgccaaggagccaacgatccaagaagagagagcccaggatttaaggaggaccaacagtctgatggtgtccagaggctccgggctggcaggaggccttgatgaggctgacacccccctagtcctgccccatcctgagctggaagtggggaagcacgtggtgctgacggagcaggagccagaaggcagcagtgagcaggccctgctggggaatgtgcagctagacatgggccgggtcatcagccagagcgagcctgacctctcctgcatcacggccaacacggacaaggccaccaccgagagcaccagcgtcaccgtcgccatccccgacgtggaccccttggtggactcaaccgtggtgcacattagcaacaagacggatggggaagccagtcccttgaaggaggcagagatcagagaggatgaggaggaggtggagaagaagaagcagaagaaggagaagcgtgagacaggcaaagccatggtgccccacagctcaatgttcatcttcagcaccaccaacccgatccggagggcctgccactacatcgtgaacctgcgctactttgagatgtgcatcctcctggtgattgcagccagcagcatcgccctggcggcagaggaccccgtcctgaccaactcggagcgcaacaaagtcctgaggtattttgactatgtgttcacgggcgtgttcacctttgagatggttataaagatgatagaccaaggcttgatcctgcaggatgggtcctacttccgagacttgtggaacatcctggactttgtggtggtcgttggcgcattggtggcctttgctctggcgaacgctttgggaaccaacaaaggacgggacatcaagaccatcaagtctctgcgggtgctccgagttctaaggccactgaaaaccatcaagcgcttgcccaagctcaaggccgtcttcgactgcgtagtgacctccttgaagaatgtcttcaacatactcattgtgtacaagctcttcatgttcatctttgctgtcatcgcagttcagctcttcaagggaaagttcttttattgcacggacagttccaaggacacagagaaggagtgcataggcaactatgtagatcatgagaaaaacaagatggaggtgaagggccgggaatggaagcgccatgaattccactacgacaacattatctgggccctgctgaccctcttcaccgtctccacaggggaaggatggcctcaagttctgcagcactctgtagatgtgacagaggaagaccgaggcccaagccgcagcaaccgcatggagatgtctatcttttatgtagtctactttgtggtcttccccttcttctttgtcaatatctttgtggctctcatcatcatcaccttccaggagcaaggggataagatgatggaggagtgcagcctggagaagaatgagagggcgtgcatcgacttcgccatcagcgccaaacctctcacccgctacatgccgcagaacagacacaccttccagtaccgcgtgtggcactttgtggtgtctccgtcctttgagtacaccattatggccatgatcgccttgaatactgttgtgctgatgatgaagtattattctgctccctgtacctatgagctggccctgaagtacctgaatatcgccttcaccatggtgttttccctggaatgtgtcctgaaggtcatcgcttttggctttttgaactatttccgagacacctggaatatctttgacttcatcaccgtgattggcagtatcacagaaattatcctgacagacagcaagctggtgaacaccagtggcttcaatatgagctttctgaagctcttccgagctgcccgcctcataaagctcctgcgtcagggctataccatacgcattttgctgtggacctttgtgcagtcctttaaggccctcccttatgtctgccttttaattgccatgcttttcttcatttatgccatcattgggatgcaggtatttggaaacataaaattagacgaggagagtcacatcaaccggcacaacaacttccggagtttctttgggtccctaatgctactcttcaggagtgccacaggtgaggcctggcaggagattatgctgtcatgccttggggagaagggctgtgagcctgacaccaccgcaccatcagggcagaacgagaacgaacgctgcggcaccgatctggcctacgtgtactttgtctccttcatcttcttctgctccttcttgatgctcaacctgtttgtggccgtcatcatggacaactttgagtacctgactcgggactcctccatcctggggcctcaccacttggacgagtttgtccgcgtctgggcagaatatgaccgagcagcatgtggccgcatccattacactgagatgtatgaaatgctgactctcatgtcacctccgctaggcctcggcaagagatgtccctccaaagtggcatataagaggttggtcctgatgaacatgccagtagctgaggacatgacggtccacttcacctccacacttatggctctgatccggacagctctggacattaaaattgccaaaggtggtgcagacaggcagcagctagactcagagctacaaaaggagaccctagccatctggcctcacctatcccagaagatgctggatctgcttgtgcccatgcccaaagcctctgacctgactgtgggcaaaatctatgcagcaatgatgatcatggactactataagcagagtaaggtgaagaagcagaggcagcagctggaggaacagaaaaatgcccccatgttccagcgcatggagccttcatctctgcctcaggagatcattgctaatgccaaagccctgccttacctccagcaggaccccgtttcaggcctgagtggccggagtggatacccttcgatgagtccactctctccccaggatatattccagttggcttgtatggaccccgccgatgacggacagttccaagaacggcagtctctggtggtgacagaccctagctccatgagacgttcattttccactattcgggataagcgttcaaattcctcgtggttggaggaattctccatggagcgaagcagtgaaaatacctacaagtcccgtcgccggagttaccactcctccttgcggctgtcagcccaccgcctgaactctgattcaggccacaagtctgacactcaccgctcagggggcagggagcggggacgatcaaaagagcgaaagcatcttctctctcctgatgtctcccgctgcaattcagaagagcgagggacccaggctgactgggagtccccagagcgccgtcaatccaggtcacccagtgagggcaggtcacagacgcccaacagacagggcacaggttccctaagtgagagctccatcccctctgtctctgacaccagcaccccaagaagaagtcgtcggcagctcccacccgtcccgccaaagccccggcccctcctttcctacagctccctgattcgacacgcgggcagcatctctccacctgctgatggaagcgaggagggctccccgctgacctcccaagctctggagagcaacaatgcttgcctgaccgagtcttccaactctccgcacccccagcagagccaacatgcctccccacagcgctacatctccgagccctacttggccctgcacgaagactcccacgcctcagactgtggtgaggaggagacgctcactttcgaagcagccgtggctactagcctgggccgttccaacaccatcggctcagccccacccctgcggcatagctggcagatgcccaacgggcactatcggcggcggaggcgcggggggcctgggccaggcatgatgtgtggggctgtcaacaacctgctaagtgacacggaagaagatgacaaatgctagaggctgctcccccctccgatgcatgctcttctctcacatggagaaaaccaagacagaattgggaagccagtgcggcccgggggggaggaagagggaaaaggaagatggaaggacaccatgcattatcagagaagaggaagtaaaggacaatcagaacaccagtcaaacccaccaaattgctttattcccctttgcaagatgggcactgccatagttctgcctctttgctggggaaagaaaccaggaacgtggagggttattactgcgggagaagggacacgaggatggctttgcttccccttgccccttcccacttttctaaaagctgtggagggatctagctggcctatgtctacactcagtgccctgagaagcctggaagactttctggctcttaactggggagtagtggagaccataggagaggactctcctccctcaccagctcttacgcctcagccagcaccactgccaccagggcaactgcagcagcatctcatgcataaccctgtggcttgcttcccccagggcagcacaggctaagtcaggaacatcggatgccagggagggaggagaaagccgaagcgaaaggggtcagggtgctgaggcaacagcagcaagggctggtctggacaagaaaagccatagcccggcagcccctaccatgagggagacagagaaacagaactggtggtgctggggggtatagccccccatccttgaggcctgtcacccacacagtaggtgctgagagttaggacaggtcaggaagtcccccagggtccacaaaggtgcctgaggctctggtaagggtgaagataaaagtatttaacaaccgctatggcatcaatgtaagtggagtttggtcctagtgccggagcccatgctattccaggcattggctctttagatgccagtcatgggggaaccctgagggtgtgggtagagtagcaggggccacctaagagattaaaaacagtctgttttccaaccagtgtggaagcaattaaatatgcgtaacagtgctacggccacaccagcacctcctggctgaaggtcagcccacactctggtccatgaggcagcaaggccagtgctgtgccaagcccggtaaggccaagtgccgaggcccagccttccctgccactcctctgagagggcagaacacacatatccaagtaggctacccaccactgggtagggatttctgtaaagatgggaaaggctgatagattgaaataagcttctgtgaaagtctggatttactgaggacctcccctgaggagggaccgttgggaccgcagattctgcagctggtgtggggttcaggtcagtttgtcaggatgctttaaggtgattagtaaatatacctcagcttagacttgggctgctccttctagcaaagcaggctccagtggggcctcatcatacaggatgacaagactggggccctgttcaccttgaacatgcccctgggccaagatggggcttcacccctccccagagtaagagctggggctgacagtcccaccctgtcattcctaatagcccaaacgcagaagcactgagcaagagagccctttcttgccaagccagtgctcttttggtatatggcatacagctccattggaggggacacatcactggctttatctggtggaaatgtacctttcccttaagttcctccttagtgccatcacagcaggtgaatgggtgccctacggggccctccttcccccaccaggaacagatggaacctgccacccaggatcctgatctgccctgcactgagcactcagtggataaacactcctccagcccagacacactcctcctcttgggcaggagcaatccagagttgttatttttcttagaaggagcctcttttccctctattttttaaattgaaatataatagctgcatcagccctgaaaagccaaattcaaccacatggctggagaatcatttgtcatggccccgccttctcttctgatactaatggagcttcatgacccacggtcagcccccaaaccaaagttgtcccaacagaggaggccagtgaggcagagacagagctctcccactctcagaccctcttttgtcttcattttcctctcccacttagcacatgtgtgcttgagggtggctgggaatgtgatatacagcaccctgatcctaacaggtgtgattgttacgtaagacgctgatactgggccttgtattgcttttaaagtttcctctgctcagcatcatttcatgccaaagtgctgctatgggctgctttgtgtgcacaaaattgctttttccacctcggaaatgcagctttccctagggggaggcctacaacaggacgaccattctgagccagtgagtctattgcatggtgttttgagaaagggaattttagtgacaccttatgccatttcaagaggagaaatgcaggctggcagagcaatttccagaaatggaatttgcctgcaaatagtataaacaacactaaatttactgtgccaggaaatcttcctgaactccttgaactcatacacacaggtatttgagtcctgaataaagtgttggaaagcactgcagatgcggtcacctgactgaccacctgggttttctattaccagtgaatttcttttattcaccttcccttgaccaagaaattgggtttcttttccctcagcctgcacttactcttctattaagaccagaaaataaaataattttccgttgagtcacaaa

SEQ ID NO: 4220 - DNA, 7067 bp, Homo sapiens
atggctcgcttcggggaggcggtggtcgccaggccagggtccggcgatggagactcggaccagagcaggaaccggcaaggaacccccgtgccggcctcggggcaggcggccgcctacaagcagacgaaagcacagagggcgcggactatggctttgtacaaccccattcccgtccggcagaactgtttcaccgtcaacagatccctgttcatcttcggagaagataacattgtcaggaaatatgccaagaagctcatcgattggccgccatttgagtacatgatcctggccaccatcattgccaactgcatcgtcctggccctggagcagcatcttcctgaggatgacaagacccccatgtcccgaagactggagaagacagaaccttatttcattgggatcttttgctttgaagctgggatcaaaattgtggccctggggttcatcttccataagggctcttacctccgcaatggctggaatgtcatggacttcatcgtggtcctcagtggcatcctggccactgcaggaacccacttcaatactcacgtggacctgaggaccctccgggctgtgcgtgtcctgcggcctttgaagctcgtgtcagggatacctagcctgcagattgtgttgaagtccatcatgaaggccatggtacctcttctgcagattggccttctgctcttctttgccatcctgatgtttgctatcattggtttggagttctacagtggcaagttacatcgagcatgcttcatgaacaattcaggtattctagaaggatttgacccccctcacccatgtggtgtgcagggctgcccagctggttatgaatgcaaggactggatcggccccaatgatgggatcacccagtttgataacatcctttttgctgtgctgactgtcttccagtgcatcaccatggaagggtggaccactgtgctgtacaataccaatgatgccttaggagccacctggaattggctgtacttcatccccctcatcatcattggatccttctttgttctcaacctagtcctgggagtgctttccggggaatttgccaaagagagagagagagtggagaaccgaagggctttcatgaagctgcggcgccagcagcagattgagcgtgagctgaatggctaccgtgcctggatagacaaagcagaggaagtcatgctcgctgaagaaaataaaaatgctggaacatccgccttagaagtgcttcgaagggcaaccatcaagaggagccggacagaggccatgactcgagactccagtgatgagcactgtgttgatatctcctctgtgggcacacctctggcccgagccagtatcaaaagtgcaaaggtagacggggtctcttatttccggcacaaggaaaggcttctgcgcatctccattcgccacatggttaaatcccaggtgttttactggattgtgctgagccttgtggcactcaacactgcctgtgtggccattgtccatcacaaccagccccagtggctcacccacctcctctactatgcagaatttctgtttctgggactcttcctcttggagatgtccctgaagatgtatggcatggggcctcgcctttattttcactcttcattcaactgctttgattttggggtcacagtgggcagtatctttgaagtggtctgggcaatcttcagacctggtacgtcttttggaatcagtgtcttgcgagccctccggcttctaagaatatttaaaataaccaagtattgggcttccctacggaatttggtggtctccttgatgagctcaatgaagtctatcatcagtttgcttttcctcctcttcctcttcatcgttgtctttgctctcctaggaatgcagttatttggaggcaggtttaactttaatgatgggactccttcggcaaattttgataccttccctgcagccatcatgactgtgttccagatcctgacgggtgaggactggaatgaggtgatgtacaatgggatccgctcccagggtggggtcagctcaggcatgtggtctgccatctacttcattgtgctcaccttgtttggcaactacacgctactgaatgtgttcttggctatcgctgtggataatctcgccaacgcccaggaactgaccaaggatgaacaggaggaagaagaggccttcaaccagaaacatgcactgcagaaggccaaggaggtcagcccgatgtctgcacccaacatgccttcgatcgaaagagacagaaggagaagacaccacatgtcgatgtgggagccacgcagcagccacctgagggagcggaggcgccggcaccacatgtccgtgtgggagcagcgtaccagccagctgaggaagcacatgcagatgtccagccaggaggccctcaacagagaggaggcgccgaccatgaacccgctcaaccccctcaacccgctcagctccctcaacccgctcaatgcccaccccagcctttatcggcgacccagggccattgagggcctggccctgggcctggccctggagaagttcgaggaggagcgcatcagccgtggggggtccctcaagggggatggaggggaccgatccagtgccctggacaaccagaggacccctttgtccctgggccagcgggagccaccatggctggccaggccctgtcatggaaactgtgacccgactcagcaggaggcagggggaggagaggctgtggtgacctttgaggaccgggccaggcacaggcagagccaacggcgcagccggcatcgccgcgtcaggacagaaggcaaggagtcctcttcagcctcccggagcaggtctgccagccaggaacgcagtctggatgaagccatgcccactgaaggggagaaggaccatgagctcaggggcaaccatggtgccaaggagccaacgatccaagaagagagagcccaggatttaaggaggaccaacagtctgatggtgtccagaggctccgggctggcaggaggccttgatgaggctgacacccccctagtcctgccccatcctgagctggaagtggggaagcacgtggtgctgacggagcaggagccagaaggcagcagtgagcaggccctgctggggaatgtgcagctagacatgggccgggtcatcagccagagcgagcctgacctctcctgcatcacggccaacacggacaaggccaccaccgagagcaccagcgtcaccgtcgccatccccgacgtggaccccttggtggactcaaccgtggtgcacattagcaacaagacggatggggaagccagtcccttgaaggaggcagagatcagagaggatgaggaggaggtggagaagaagaagcagaagaaggagaagcgtgagacaggcaaagccatggtgccccacagctcaatgttcatcttcagcaccaccaacccgatccggagggcctgccactacatcgtgaacctgcgctactttgagatgtgcatcctcctggtgattgcagccagcagcatcgccctggcggcagaggaccccgtcctgaccaactcggagcgcaacaaagtcctgaggtattttgactatgtgttcacgggcgtgttcacctttgagatggttataaagatgatagaccaaggcttgatcctgcaggatgggtcctacttccgagacttgtggaacatcctggactttgtggtggtcgttggcgcattggtggcctttgctctggcgaacgctttgggaaccaacaaaggacgggacatcaagaccatcaagtctctgcgggtgctccgagttctaaggccactgaaaaccatcaagcgcttgcccaagctcaaggccgtcttcgactgcgtagtgacctccttgaagaatgtcttcaacatactcattgtgtacaagctcttcatgttcatctttgctgtcatcgcagttcagctcttcaagggaaagttcttttattgcacggacagttccaaggacacagagaaggagtgcataggcaactatgtagatcatgagaaaaacaagatggaggtgaagggccgggaatggaagcgccatgaattccactacgacaacattatctgggccctgctgaccctcttcaccgtctccacaggggaaggatggcctcaagttctgcagcactctgtagatgtgacagaggaagaccgaggcccaagccgcagcaaccgcatggagatgtctatcttttatgtagtctactttgtggtcttccccttcttctttgtcaatatctttgtggctctcatcatcatcaccttccaggagcaaggggataagatgatggaggagtgcagcctggagaagaatgagagggcgtgcatcgacttcgccatcagcgccaaacctctcacccgctacatgccgcagaacagacacaccttccagtaccgcgtgtggcactttgtggtgtctccgtcctttgagtacaccattatggccatgatcgccttgaatactgttgtgctgatgatgaagtattattctgctccctgtacctatgagctggccctgaagtacctgaatatcgccttcaccatggtgttttccctggaatgtgtcctgaaggtcatcgcttttggctttttgaactatttccgagacacctggaatatctttgacttcatcaccgtgattggcagtatcacagaaattatcctgacagacagcaagctggtgaacaccagtggcttcaatatgagctttctgaagctcttccgagctgcccgcctcataaagctcctgcgtcagggctataccatacgcattttgctgtggacctttgtgcagtcctttaaggccctcccttatgtctgccttttaattgccatgcttttcttcatttatgccatcattgggatgcaggtatttggaaacataaaattagacgaggagagtcacatcaaccggcacaacaacttccggagtttctttgggtccctaatgctactcttcaggagtgccacaggtgaggcctggcaggagattatgctgtcatgccttggggagaagggctgtgagcctgacaccaccgcaccatcagggcagaacgagaacgaacgctgcggcaccgatctggcctacgtgtactttgtctccttcatcttcttctgctccttcttgatgctcaacctgtttgtggccgtcatcatggacaactttgagtacctgactcgggactcctccatcctggggcctcaccacttggacgagtttgtccgcgtctgggcagaatatgaccgagcagcatgtggccgcatccattacactgagatgtatgaaatgctgactctcatgtcacctccgctaggcctcggcaagagatgtccctccaaagtggcatataagaggttggtcctgatgaacatgccagtagctgaggacatgacggtccacttcacctccacacttatggctctgatccggacagctctggacattaaaattgccaaaggtggtgcagacaggcagcagctagactcagagctacaaaaggagaccctagccatctggcctcacctatcccagaagatgctggatctgcttgtgcccatgcccaaagcctctgacctgactgtgggcaaaatctatgcagcaatgatgatcatggactactataagcagagtaaggtgaagaagcagaggcagcagctggaggaacagaaaaatgcccccatgttccagcgcatggagccttcatctctgcctcaggagatcattgctaatgccaaagccctgccttacctccagcaggaccccgtttcaggcctgagtggccggagtggatacccttcgatgagtccactctctccccaggatatattccagttggcttgtatggaccccgccgatgacggacagttccaagaacggcagtctctggagccagaggttagtgaattaaaaagcgtgcagccctctaaccatggcatctaccttccttcggacacccaggagcatgcgggatctgggagggcatcttctatgccacgtctgactgtggatccccaggtggtgacagaccctagctccatgagacgttcattttccactattcgggataagcgttcaaattcctcgtggttggaggaattctccatggagcgaagcagtgaaaatacctacaagtcccgtcgccggagttaccactcctccttgcggctgtcagcccaccgcctgaactctgattcaggccacaagtctgacactcaccgctcagggggcagggagcggggacgatcaaaagagcgaaagcatcttctctctcctgatgtctcccgctgcaattcagaagagcgagggacccaggctgactgggagtccccagagcgccgtcaatccaggtcacccagtgagggcaggtcacagacgcccaacagacagggcacaggttccctaagtgagagctccatcccctctgtctctgacaccagcaccccaagaagaagtcgtcggcagctcccacccgtcccgccaaagccccggcccctcctttcctacagctccctgattcgacacgcgggcagcatctctccacctgctgatggaagcgaggagggctccccgctgacctcccaagctctggagagcaacaatgcttgcctgaccgagtcttccaactctccgcacccccagcagagccaacatgcctccccacagcgctacatctccgagccctacttggccctgcacgaagactcccacgcctcagactgtggtgaggaggagacgctcactttcgaagcagccgtggctactagcctgggccgttccaacaccatcggctcagccccacccctgcggcatagctggcagatgcccaacgggcactatcggcggcggaggcgcggggggcctgggccaggcatgatgtgtggggctgtcaacaacctgctaagtgacacggaagaagatgacaaatgctagaggctgctcccccctccgatgcatgctcttctctcacatggagaaaaccaagacagaattgggaagccagtgcggcccgggggggaggaagagggaaaaggaagatggaaggacaccatgcatta

SEQ ID NO: 4221 - DNA, 1795 bp, Homo sapiens
actccttgtctctgccctctccctcccacagagcaatgttctgtgatggtgcccgagatgcgtggactgagcccagaccgcaggctgcccgagcccgccccctgcccggctgcggggagccctgagcccaggtccgcgggccgccgccaacgccacgtcctggccctgccggaagaagaggcatggcggccccagcagtgcgctctgctcgaggccgacgcctcggacgaggtgggcatgctgccggcttccccgcgcgccgcctctggcttcgacaacttcttccaggtgcaggagggcgagggccagggctgggagggcgccatggcactggaggcgggctccagccctttcctgccggtgagccccgaggtcatgaagcggcggcgcgggggcctcatcgagcagcgcgacatcatcaaggcccacgaggcgcacaagatgcagagcaccccgcaggcccggcgcaaggaatgggagatggctcgcttcggggaggcggtggtcgccaggccagggtccggcgatggagactcggaccagagcaggaaccggcaaggaacccccgtgccggcctcggggcaggcggccgcctacaagcagacgaaagcacagagggcgcggactatggctttgtacaaccccattcccgtccggcagaactgtttcaccgtcaacagatccctgttcatcttcggagaagataacattgtcaggaaatatgccaagaagctcatcgattggccgccatttgagtacatgatcctggccaccatcattgccaactgcatcgtcctggccctggagcagcatcttcctgaggatgacaagacccccatgtcccgaagactggagaagacagaaccttatttcattgggatcttttgctttgaagctgggatcaaaattgtggccctggggttcatcttccataagggctcttacctccgcaatggctggaatgtcatggacttcatcgtggtcctcagtggcatcctggccactgcaggaacccacttcaatactcacgtggacctgaggaccctccgggctgtgcgtgtcctgcggcctttgaagctcgtgtcagggatacctagcctgcagattgtgttgaagtccatcatgaaggccatggtacctcttctgcagattggccttctgctcttctttgccatcctgatgtttgctatcattggtttggagttctacagtggcaagttacatcgagcatgcttcatgaacaattcaggtattctagaaggatttgacccccctcacccatgtggtgtgcagggctgcccagctggttatgaatgcaaggactggatcggccccaatgatgggatcacccagtttgataacatcctttttgctgtgctgactgtcttccagtgcatcaccatggaagggtggaccactgtgctgtacaataccaatgatgccttaggagccacctggaattggctgtacttcatccccctcatcatcattggatccttctttgttctcaacctagtcctgggagtgctttccggggaatttgccaaagagagagagagagtggagaaccgaagggctttcatgaagctgcggcgccagcagcagattgagcgtgagctgaatggctaccgtgcctggatagacaaagcagaggaagtcatgctcgctgaagaaaataaaaatgctggaacatccgccttagaagtgcttcgaagggcaaccatcaagaggagccggacagaggccatgactcgagactccagtgatgagcactgtgttgatatctcctctgtgg

SEQ ID NO: 4222 - DNA, 16170 bp, Homo sapiens
gctgctgctgcctctccgaagagctcgcggagctccccagaggcggtggtccccgtgcttgtctggatgcggctctgagtctccgtgtgtctttctgcttgttgctgtgtgcgggtgttcggccgcgatcacctttgtgtgtcttctgtctgtttaaacctcaggatggctcgcttcggggaggcggtggtcgccaggccagggtccggcgatggagactcggaccagagcaggaaccggcaaggaacccccgtgccggcctcggggcaggcggccgcctacaagcagacgaaagcacagagggcgcggactatggctttgtacaaccccattcccgtccggcagaactgtttcaccgtcaacagatccctgttcatcttcggagaagataacattgtcaggaaatatgccaagaagctcatcgattggccgccatttgagtacatgatcctggccaccatcattgccaactgcatcgtcctggccctggagcagcatcttcctgaggatgacaagacccccatgtcccgaagactggagaagacagaaccttatttcattgggatcttttgctttgaagctgggatcaaaattgtggccctggggttcatcttccataagggctcttacctccgcaatggctggaatgtcatggacttcatcgtggtcctcagtggcatcctggccactgcaggaacccacttcaatactcacgtggacctgaggaccctccgggctgtgcgtgtcctgcggcctttgaagctcgtgtcagggatacctagcctgcagattgtgttgaagtccatcatgaaggccatggtacctcttctgcagattggccttctgctcttctttgccatcctgatgtttgctatcattggtttggagttctacagtggcaagttacatcgagcatgcttcatgaacaattcaggtattctagaaggatttgacccccctcacccatgtggtgtgcagggctgcccagctggttatgaatgcaaggactggatcggccccaatgatgggatcacccagtttgataacatcctttttgctgtgctgactgtcttccagtgcatcaccatggaagggtggaccactgtgctgtacaataccaatgatgccttaggagccacctggaattggctgtacttcatccccctcatcatcattggatccttctttgttctcaacctagtcctgggagtgctttccggggaatttgccaaagagagagagagagtggagaaccgaagggctttcatgaagctgcggcgccagcagcagattgagcgtgagctgaatggctaccgtgcctggatagacaaagcagaggaagtcatgctcgctgaagaaaataaaaatgctggaacatccgccttagaagtgcttcgaagggcaaccatcaagaggagccggacagaggccatgactcgagactccagtgatgagcactgtgttgatatctcctctgtgggcacacctctggcccgagccagtatcaaaagtgcaaaggtagacggggtctcttatttccggcacaaggaaaggcttctgcgcatctccattcgccacatggttaaatcccaggtgttttactggattgtgctgagccttgtggcactcaacactgcctgtgtggccattgtccatcacaaccagccccagtggctcacccacctcctctactatgcagaatttctgtttctgggactcttcctcttggagatgtccctgaagatgtatggcatggggcctcgcctttattttcactcttcattcaactgctttgattttggggtcacagtgggcagtatctttgaagtggtctgggcaatcttcagacctggtacgtcttttggaatcagtgtcttgcgagccctccggcttctaagaatatttaaaataaccaagtattgggcttccctacggaatttggtggtctccttgatgagctcaatgaagtctatcatcagtttgcttttcctcctcttcctcttcatcgttgtctttgctctcctaggaatgcagttatttggaggcaggtttaactttaatgatgggactccttcggcaaattttgataccttccctgcagccatcatgactgtgttccagatcctgacgggtgaggactggaatgaggtgatgtacaatgggatccgctcccagggtggggtcagctcaggcatgtggtctgccatctacttcattgtgctcaccttgtttggcaactacacgctactgaatgtgttcttggctatcgctgtggataatctcgccaacgcccaggaactgaccaaggatgaacaggaggaagaagaggccttcaaccagaaacatgcactgcagaaggccaaggaggtcagcccgatgtctgcacccaacatgccttcgatcgagagggagcggaggcgccggcaccacatgtccgtgtgggagcagcgtaccagccagctgaggaagcacatgcagatgtccagccaggaggccctcaacagagaggaggcgccgaccatgaacccgctcaaccccctcaacccgctcagctccctcaacccgctcaatgcccaccccagcctttatcggcgacccagggccattgagggcctggccctgggcctggccctggagaagttcgaggaggagcgcatcagccgtggggggtccctcaagggggatggaggggaccgatccagtgccctggacaaccagaggacccctttgtccctgggccagcgggagccaccatggctggccaggccctgtcatggaaactgtgacccgactcagcaggaggcagggggaggagaggctgtggtgacctttgaggaccgggccaggcacaggcagagccaacggcgcagccggcatcgccgcgtcaggacagaaggcaaggagtcctcttcagcctcccggagcaggtctgccagccaggaacgcagtctggatgaagccatgcccactgaaggggagaaggaccatgagctcaggggcaaccatggtgccaaggagccaacgatccaagaagagagagcccaggatttaaggaggaccaacagtctgatggtgtccagaggctccgggctggcaggaggccttgatgaggctgacacccccctagtcctgccccatcctgagctggaagtggggaagcacgtggtgctgacggagcaggagccagaaggcagcagtgagcaggccctgctggggaatgtgcagctagacatgggccgggtcatcagccagagcgagcctgacctctcctgcatcacggccaacacggacaaggccaccaccgagagcaccagcgtcaccgtcgccatccccgacgtggaccccttggtggactcaaccgtggtgcacattagcaacaagacggatggggaagccagtcccttgaaggaggcagagatcagagaggatgaggaggaggtggagaagaagaagcagaagaaggagaagcgtgagacaggcaaagccatggtgccccacagctcaatgttcatcttcagcaccaccaacccgatccggagggcctgccactacatcgtgaacctgcgctactttgagatgtgcatcctcctggtgattgcagccagcagcatcgccctggcggcagaggaccccgtcctgaccaactcggagcgcaacaaagtcctgaggtattttgactatgtgttcacgggcgtgttcacctttgagatggttataaagatgatagaccaaggcttgatcctgcaggatgggtcctacttccgagacttgtggaacatcctggactttgtggtggtcgttggcgcattggtggcctttgctctggcgaacgctttgggaaccaacaaaggacgggacatcaagaccatcaagtctctgcgggtgctccgagttctaaggccactgaaaaccatcaagcgcttgcccaagctcaaggccgtcttcgactgcgtagtgacctccttgaagaatgtcttcaacatactcattgtgtacaagctcttcatgttcatctttgctgtcatcgcagttcagctcttcaagggaaagttcttttattgcacggacagttccaaggacacagagaaggagtgcataggcaactatgtagatcatgagaaaaacaagatggaggtgaagggccgggaatggaagcgccatgaattccactacgacaacattatctgggccctgctgaccctcttcaccgtctccacaggggaaggatggcctcaagttctgcagcactctgtagatgtgacagaggaagaccgaggcccaagccgcagcaaccgcatggagatgtctatcttttatgtagtctactttgtggtcttccccttcttctttgtcaatatctttgtggctctcatcatcatcaccttccaggagcaaggggataagatgatggaggagtgcagcctggagaagaatgagagggcgtgcatcgacttcgccatcagcgccaaacctctcacccgctacatgccgcagaacagacacaccttccagtaccgcgtgtggcactttgtggtgtctccgtcctttgagtacaccattatggccatgatcgccttgaatactgttgtgctgatgatgaagtattattctgctccctgtacctatgagctggccctgaagtacctgaatatcgccttcaccatggtgttttccctggaatgtgtcctgaaggtcatcgcttttggctttttgaactatttccgagacacctggaatatctttgacttcatcaccgtgattggcagtatcacagaaattatcctgacagacagcaagctggtgaacaccagtggcttcaatatgagctttctgaagctcttccgagctgcccgcctcataaagctcctgcgtcagggctataccatacgcattttgctgtggacctttgtgcagtcctttaaggccctcccttatgtctgccttttaattgccatgcttttcttcatttatgccatcattgggatgcaggtatttggaaacataaaattagacgaggagagtcacatcaaccggcacaacaacttccggagtttctttgggtccctaatgctactcttcaggagtgccacaggtgaggcctggcaggagattatgctgtcatgccttggggagaagggctgtgagcctgacaccaccgcaccatcagggcagaacgagaacgaacgctgcggcaccgatctggcctacgtgtactttgtctccttcatcttcttctgctccttcttgatgctcaacctgtttgtggccgtcatcatggacaactttgagtacctgactcgggactcctccatcctggggcctcaccacttggacgagtttgtccgcgtctgggcagaatatgaccgagcagcatgtggccgcatccattacactgagatgtatgaaatgctgactctcatgtcacctccgctaggcctcggcaagagatgtccctccaaagtggcatataagaggttggtcctgatgaacatgccagtagctgaggacatgacggtccacttcacctccacacttatggctctgatccggacagctctggacattaaaattgccaaaggtggtgcagacaggcagcagctagactcagagctacaaaaggagaccctagccatctggcctcacctatcccagaagatgctggatctgcttgtgcccatgcccaaagcctctgacctgactgtgggcaaaatctatgcagcaatgatgatcatggactactataagcagagtaaggtgaagaagcagaggcagcagctggaggaacagaaaaatgcccccatgttccagcgcatggagccttcatctctgcctcaggagatcattgctaatgccaaagccctgccttacctccagcaggaccccgtttcaggcctgagtggccggagtggatacccttcgatgagtccactctctccccaggatatattccagttggcttgtatggaccccgccgatgacggacagttccaagaacggcagtctctggtggtgacagaccctagctccatgagacgttcattttccactattcgggataagcgttcaaattcctcgtggttggaggaattctccatggagcgaagcagtgaaaatacctacaagtcccgtcgccggagttaccactcctccttgcggctgtcagcccaccgcctgaactctgattcaggccacaagtctgacactcaccgctcagggggcagggagcggggacgatcaaaagagcgaaagcatcttctctctcctgatgtctcccgctgcaattcagaagagcgagggacccaggctgactgggagtccccagagcgccgtcaatccaggtcacccagtgagggcaggtcacagacgcccaacagacagggcacaggttccctaagtgagagctccatcccctctgtctctgacaccagcaccccaagaagaagtcgtcggcagctcccacccgtcccgccaaagccccggcccctcctttcctacagctccctgattcgacacgcgggcagcatctctccacctgctgatggaagcgaggagggctccccgctgacctcccaagctctggagagcaacaatgcttgcctgaccgagtcttccaactctccgcacccccagcagagccaacatgcctccccacagcgctacatctccgagccctacttggccctgcacgaagactcccacgcctcagactgtggtgaggaggagacgctcactttcgaagcagccgtggctactagcctgggccgttccaacaccatcggctcagccccacccctgcggcatagctggcagatgcccaacgggcactatcggcggcggaggcgcggggggcctgggccaggcatgatgtgtggggctgtcaacaacctgctaagtgacacggaagaagatgacaaatgctagaggctgctcccccctccgatgcatgctcttctctcacatggagaaaaccaagacagaattgggaagccagtgcggcccgggggggaggaagagggaaaaggaagatggaaggacaccatgcattatcagagaagaggaagtaaaggacaatcagaacaccagtcaaacccaccaaattgctttattcccctttgcaagatgggcactgccatagttctgcctctttgctggggaaagaaaccaggaacgtggagggttattactgcgggagaagggacacgaggatggctttgcttccccttgccccttcccacttttctaaaagctgtggagggatctagctggcctatgtctacactcagtgccctgagaagcctggaagactttctggctcttaactggggagtagtggagaccataggagaggactctcctccctcaccagctcttacgcctcagccagcaccactgccaccagggcaactgcagcagcatctcatgcataaccctgtggcttgcttcccccagggcagcacaggctaagtcaggaacatcggatgccagggagggaggagaaagccgaagcgaaaggggtcagggtgctgaggcaacagcagcaagggctggtctggacaagaaaagccatagcccggcagcccctaccatgagggagacagagaaacagaactggtggtgctggggggtatagccccccatccttgaggcctgtcacccacacagtaggtgctgagagttaggacaggtcaggaagtcccccagggtccacaaaggtgcctgaggctctggtaagggtgaagataaaagtatttaacaaccgctatggcatcaatgtaagtggagtttggtcctagtgccggagcccatgctattccaggcattggctctttagatgccagtcatgggggaaccctgagggtgtgggtagagtagcaggggccacctaagagattaaaaacagtctgttttccaaccagtgtggaagcaattaaatatgcgtaacagtgctacggccacaccagcacctcctggctgaaggtcagcccacactctggtccatgaggcagcaaggccagtgctgtgccaagcccggtaaggccaagtgccgaggcccagccttccctgccactcctctgagagggcagaacacacatatccaagtaggctacccaccactgggtagggatttctgtaaagatgggaaaggctgatagattgaaataagcttctgtgaaagtctggatttactgaggacctcccctgaggagggaccgttgggaccgcagattctgcagctggtgtggggttcaggtcagtttgtcaggatgctttaaggtgattagtaaatatacctcagcttagacttgggctgctccttctagcaaagcaggctccagtggggcctcatcatacaggatgacaagactggggccctgttcaccttgaacatgcccctgggccaagatggggcttcacccctccccagagtaagagctggggctgacagtcccaccctgtcattcctaatagcccaaacgcagaagcactgagcaagagagccctttcttgccaagccagtgctcttttggtatatggcatacagctccattggaggggacacatcactggctttatctggtggaaatgtacctttcccttaagttcctccttagtgccatcacagcaggtgaatgggtgccctacggggccctccttcccccaccaggaacagatggaacctgccacccaggatcctgatctgccctgcactgagcactcagtggataaacactcctccagcccagacacactcctcctcttgggcaggagcaatccagagttgttatttttcttagaaggagcctcttttccctctattttttaaattgaaatataatagctgcatcagccctgaaaagccaaattcaaccacatggctggagaatcatttgtcatggccccgccttctcttctgatactaatggagcttcatgacccacggtcagcccccaaaccaaagttgtcccaacagaggaggccagtgaggcagagacagagctctcccactctcagaccctcttttgtcttcattttcctctcccacttagcacatgtgtgcttgagggtggctgggaatgtgatatacagcaccctgatcctaacaggtgtgattgttacgtaagacgctgatactgggccttgtattgcttttaaagtttcctctgctcagcatcatttcatgccaaagtgctgctatgggctgctttgtgtgcacaaaattgctttttccacctcggaaatgcagctttccctagggggaggcctacaacaggacgaccattctgagccagtgagtctattgcatggtgttttgagaaagggaattttagtgacaccttatgccatttcaagaggagaaatgcaggctggcagagcaatttccagaaatggaatttgcctgcaaatagtataaacaacactaaatttactgtgccaggaaatcttcctgaactccttgaactcatacacacaggtatttgagtcctgaataaagtgttggaaagcactgcagatgcggtcacctgactgaccacctgggttttctattaccagtgaatttcttttattcaccttcccttgaccaagaaattgggtttcttttccctcagcctgcacttactcttctattaagaccagaaaataaaataattttccgttgagtcacaaactcatcatcttgtttggtgttctgctgcctctgaacaaaagtgaatgccagccttcccttgctgggtgtcagagtctgcctcccttgaaaagaggcccctgtagaccccaacacctattcttttctctggttaattacagcagcatctgagaaattccatgcaaaagaagactacaaccagtgtttcagatataccacaagatcaaatttgggcactggtggtccacctcagaagactcttgagtcatatattcagtttctcttgctaatatatgactcgtcttcaccatctcctcaaaacaagagcaaagccaagatagaggaaggtaaaaggaggaggaaaggaaaccaaggcagggagatgttctaagtaggtttgcatttagttacccctcatttcacttaaggctccagacagactccaggtagggaatgcatgctgtctctttctctgtgtctgtctccccatctcctagaggacagagtgccagcgacctctggacaggggcagggctccagccaaggtgcccctgagccagggtcaacatagaatttcctgccccgtgaagggctggcaccagctagcatccccttggctccacatgagtcatgaacacaattgtcagtgggggtctctgctgctcttctggctgaagaatctgtttttcttctgggcttcacttgtagttcctattcaatgtctccatagggcactgagatcaccaagaacattacccagaagctgaagtccaaatgttctagattttgacctctcttgactctggggccacaaagagaaggccccataatccacctctcagccagtatctcccttctttgcacagattcctcccaaccccatagagcctatgtggtgagcatgagggtcgtcttccctctgttctcccatcccagcctctgttttgctgcatgttagcgctgatccagctcctgagatggttaattccacccaatccaagcttatttgcttgcctgactgactccaccactctctcagctatgggggaatattgcattctaatgaaatagggtttggaactcacctggtgctcctcgcaagacaactgacacaaggtgtagggtgtgggggtggacaaaatgcccacctactggataaaagctcactgcaggaaaatgaggtctcctggcataatgcaacaaaaatctcatataattttgatttttaaaaagttgttctcaatttttcattacatcctacttctcagccctctggatgtttcatttttttggacaaagtgtttctttagtggttggggccagggacaggttgagggatatttctcggctcatttataagatataaatattatgaggttgtatgtaaagaaagggcaaacgtacagcagaaggggagcaaatagctacctttcaaggattttgagatttgaaggttaaggaatttttactgctatttttgttcatcagtttcatgtctgttatgttttgagatcctcagaggcctagggttagcgtataccaagaatcctggtgagaggcgttgccatgccttggggtgaattcttccccactagctctctcacccagcctacaagtccttctctcatagatcccagagcaatgggcaccgtccaggaggtacaggagaggactttatgatgcaggaaagaaggaagaagtgggtcccttgcaagtggccagacagggaatgatggtttgactccagaaatcaggaatcaggttcaggtttggataacttctctttaaaatatctccacattgagactcttattttaacaaaatccaaacaaaattaactcagggcttgtgacctaacctttgtaagaaggtgatcaaagagatcctacattaataagcactgcctgtagcaccagctttgtctttttgtcttttgttgtttctttcctgaaccaccctgtacatcatagccaggtctaccccaaatagagcagcagctgatggcttctctgctgtctgtggagggagggctcggctgcagacctatggtgttttgtcagctgttaggtgctacagcccacccagtcagagtacatagacatagcgctttaagggacaaaggacaaacagaactatctttgctttccggaggccatctttttctttccttgaatcctttctgctttaaacttctgaggtttatgcatcccagagaggtcacaccaagccaaagagaaaaaattcatagattgtcccagcctacccaaagggcctgaaaagcctctctaaacaaaactcaagatagctgagaagtatgaatggggttcacagcaaagtccaattgatggcttttgaggctgggacacccccaaactgcccttctgtttttgtagttttgctttcttccacccaccctctctccgcatgctgtaagttaggggagttagtatcttgaacttctaaatgcaaaaggagattttataataagccatgctacctgtaaatacattattgaggtttgcatttttatttttggaggtatgaaagagttgagtagaccaagtcaaaagaggtgtggggatttatgtttatttttatttgtttggggttgtttggttggtggctgggtttcttgtaacagacctattctggaatagcaaagaaggataccttggtgatctgcaatgtttctgaatctgtttctctttaggaagtgattgccatcaaatttagtgatatgatatttgagtcaaaaatctgaggttatagtaccagctgtcttttctctctggtctcctttttgtcgtctttctctttctgtctaaattggcctctgtcttttcctaaggacttaaaatataacccaaattaatgaagaactgccccaaaacttcagtgaaagccaaggaggtacagaattttttcaggacatctttaaccaatacaaaatttatgtcttaagaagataatttttacaatagtgtagtaatctgataaatgaaaactattggaagtcaatagttttttatattccagctttctgtattcaaacttgtgccttcagcaagcatctcttcactttctttcccttgtcaattgaaacatgaatgtttggctaactcatgatgtaaagtgtctgttaagttaataatacataatttaaagcacttagtctccacaaagcaatttagaaaaatcttcacttgttagatcccatgaagtacctatgaaattctcagcattgctataagcatttgattttttttaaggaaacttcctgtttaatggaatctgaatccaagatttgctttaatttcactctattcttcccattttcccttattcttcttgttgtctctctaattaaaaaaaaaaaaaacctaggcttttttttttctatccagaaagttgggttttcatgatctgagcttccttatgtctccttctctttgtgcaaacttaaaccagtcatagattgtcacccagacatattctccaacccagcattggaaatctgaacgaatcttttctctttttgtcctacaagtttgtcagagatgagaatggattgctgtctacattctacaaccagaccctagactttataccaggctgtgccacttcctcttcacttcactcagaggatggccccaaaactgaaaaggaaatgaaataatcaaatataccaaatccgaatttgactttatttgatgactcaatattttccttccagtactctaatttttttttatggcaatggcctatatggcacaagaaccaccacttaaagcaaatctgttgaacatttttataagggatgagcaagaaaaacacactccaaaattttaaagtgccattaatcaatttttaagaataaaggtaatatgaaatgagggctaaacaatgtaatataactgccagttaaggtagacagtagttgtggtcttagttacatttgatatggagttgtgtaatattaagcagatcccagtggagttagtaaaaacataggtattgagttttaatggctaccaattgggatatatacttagcctgcaggctgaactttagtcagtgtttttctatcatgttgttttgtgaacaagtcaaaatttatacaaagctaccctaagtgctgcaattgcagaggaacttgcctcttcgtgatattagagggcagtccaactccgctcaaactgagtccaagatttgaattcatccagaaaaacaaatggaggagaaaagcctaatgcaccacatgtgtttggcatttcatggctgggacaatggagtagagggtaggaagacaagctgtagaacaaaagcaaagtgaggtagaaagtaacaggtcccagacgaggacagacttagagatgtgtaaccttggatcctctttttcacttagaatatgggtaaacttcttagcacaagactggattaagagaagttctttctgttaaactcacctagggtagtggctttgaaggcctcagaggattaatagattcccaaaattttcttccagacctgggagatggagagaaagaggttcttgctttaaagcggctcgaagacaatctttatgacttcagcaactcttcaacatagtagcaccaataaaggagagattatgttaacttcctagtggtgagaataccatgggatgggagaagggccagtgagtgggatgggaatgagcttcatcaggaacagatttcagactctgcagggtgcaccggttctagcctcaaataacaacattgcaaggaggtggactacagggtccacaccctctgtccttcggggcccatggtcaggccattccctctttgttttgctcctagaggatgagcatgtaagatgagatcaggagggaaattgggtgctctgcctcaggctgttaaaatgctgctacctgcattctaaaacgtgcaagtcatgccccacaagacacctccttagggcagcatccactgtggtgtgccagcctgacacccctgcagtcacggtgtttgaatggcagctgatgctggcccacccagagtatcggtgcatctctcctaaagccacagttcagcactgcatgttgaccaggcggatatcctataatatagatgctcgtttggatccaaaaggaaaaccattaaaaataaaagaaagatgaaaaactttaatgttttgggggggataaaagaaaagaataaataaaaccttgttgtaaagaatgcatcggcctgatttccctcacttgatgtgtttctttgctgctaccagaaagggaaatcatgggagtgaagcctgccaggaccctcagggtaagctggcagcaggctctgcagctgcacttagttggggtctgctcagaccagtcaggaggaattcagaggctttcaaagtcccaaggacatcctggctctgaaaggttttcttttgttaaaaaatgcactttgtgctgtgtgtggtagctcgtatgtgttaccccagctattcaggaagctagggcagaaggattgcttgaggctaggaattcaagactggcctggatgacagagtgaaaccctcatctcttaaaaaaaaaaaaaaggaataaaaatgttctctgccttggataacatttttttttaaagattccatacaaactcattccctgaaagagaaaaacagattttctaatcaggacattgtcctgatctgcaagcgaggagtttaacaaggtaggcagagaacttccttatggaacaacagggctctgtgaccagaaaaactatgaccagcctcctctgaaaaaaggtggggggattatagggcaccagctcagccgccaagttcaggaagcagctgattcccaagactcttaggagatactgtccattcttcctcctgtccacatcactccccatttaactgcaattgctcccttgccacagggaaagcagcaagccccaggcccaggcctccatttgatttgccactccgagaactgtctgcttcattctgcttgaggagatatcttcacctaatcctagtgttaattattttaatctgagcaacgcttttatcaattagatagaaaccagcattccaaaataagtcccctaagtttgtagtttgagccaagatattttcttgagccctaagatatatgactttattagctaggatttttcttatgattaaaaacatccaaaaatgtgatatgtggtcatctctcagggaggtctaggtccttgcaggctggattttagaaatttctaagattctctacaacttttaaattttatgttatttttcaatcataatttctttcctgtggcttctatcaccattggagttagaatctgacaacctttaacttcacacttttatgagataataagttggtttcttgggcaaaggttggtttgtaagccatttacatggattgatgatttctgttcttgttttcttctaacctagaactcaggtccacagttttccacaggctaatggcactatgaaacagatataaagaaaaatagacactg

SEQ ID NO: 4223 - DNA, 8087 bp, Homo sapiens
cgaggccgccgccgtcgcctccgccgggcgagccggagccggagtcgagccgcggccgggagccgggcgggctggggacgcgggccgggggcggaggcgctgggggccggggccggggccgggggcggaggcgctgggggccggggccggggccgggcgccgagcggggtccgcggtgaccgcgccgcccgggcgatgcccgcggggacgccgccggccagcagagcgaggtgctgccggccgccaccatgaccgagggcgcacgggccgccgacgaggtccgggtgcccctgggcgcgccgccccctggccctgcggcgttggtgggggcgtccccggagagccccggggcgccgggacgcgaggcggagcgggggtccgagctcggcgtgtcaccctccgagagcccggcggccgagcgcggcgcggagctgggtgccgacgaggagcagcgcgtcccgtacccggccttggcggccacggtcttcttctgcctcggtcagaccacgcggccgcgcagctggtgcctccggctggtctgcaacccatggttcgagcacgtgagcatgctggtaatcatgctcaactgcgtgaccctgggcatgttccggccctgtgaggacgttgagtgcggctccgagcgctgcaacatcctggaggcctttgacgccttcattttcgccttttttgcggtggagatggtcatcaagatggtggccttggggctgttcgggcagaagtgttacctgggtgacacgtggaacaggctggatttcttcatcgtcgtggcgggcatgatggagtactcgttggacggacacaacgtgagcctctcggctatcaggaccgtgcgggtgctgcggcccctccgcgccatcaaccgcgtgcctagcatgcggatcctggtcactctgctgctggatacgctgcccatgctcgggaacgtccttctgctgtgcttcttcgtcttcttcattttcggcatcgttggcgtccagctctgggctggcctcctgcggaaccgctgcttcctggacagtgcctttgtcaggaacaacaacctgaccttcctgcggccgtactaccagacggaggagggcgaggagaacccgttcatctgctcctcacgccgagacaacggcatgcagaagtgctcgcacatccccggccgccgcgagctgcgcatgccctgcaccctgggctgggaggcctacacgcagccgcaggccgagggggtgggcgctgcacgcaacgcctgcatcaactggaaccagtactacaacgtgtgccgctcgggtgactccaacccccacaacggtgccatcaacttcgacaacatcggctacgcctggattgccatcttccaggtgatcacgctggaaggctgggtggacatcatgtactacgtcatggacgcccactcattctacaacttcatctatttcatcctgctcatcatcgtgggctccttcttcatgatcaacctgtgcctggtggtgattgccacgcagttctcggagacgaagcagcgggagagtcagctgatgcgggagcagcgggcacgccacctgtccaacgacagcacgctggccagcttctccgagcctggcagctgctacgaagagctgctgaagtacgtgggccacatattccgcaaggtcaagcggcgcagcttgcgcctctacgcccgctggcagagccgctggcgcaagaaggtggaccccagtgctgtgcaaggccagggtcccgggcaccgccagcgccgggcaggcaggcacacagcctcggtgcaccacctggtctaccaccaccatcaccaccaccaccaccactaccatttcagccatggcagcccccgcaggcccggccccgagccaggcgcctgcgacaccaggctggtccgagctggcgcgcccccctcgccaccttccccaggccgcggaccccccgacgcagagtctgtgcacagcatctaccatgccgactgccacatagaggggccgcaggagagggcccgggtggcacatgccgcagccactgccgctgccagcctcagactggccacagggctgggcaccatgaactaccccacgatcctgccctcaggggtgggcagcggcaaaggcagcaccagccccggacccaaggggaagtgggccggtggaccgccaggcaccggggggcacggcccgttgagcttgaacagccctgatccctacgagaagatcccgcatgtggtcggggagcatggactgggccaggcccctggccatctgtcgggcctcagtgtgccctgccccctgcccagccccccagcgggcacactgacctgtgagctgaagagctgcccgtactgcacccgtgccctggaggacccggagggtgagctcagcggctcggaaagtggagactcagatggccgtggcgtctatgaattcacgcaggacgtccggcacggtgaccgctgggaccccacgcgaccaccccgtgcgacggacacaccaggcccaggcccaggcagcccccagcggcgggcacagcagagggcagccccgggcgagccaggctggatgggccgcctctgggttaccttcagcggcaagctgcgccgcatcgtggacagcaagtacttcagccgtggcatcatgatggccatccttgtcaacacgctgagcatgggcgtggagtaccatgagcagcccgaggagctgactaatgctctggagatcagcaacatcgtgttcaccagcatgtttgccctggagatgctgctgaagctgctggcctgcggccctctgggctacatccggaacccgtacaacatcttcgacggcatcatcgtggtcatcagcgtctgggagatcgtggggcaggcggacggtggcttgtctgtgctgcgcaccttccggctgctgcgtgtgctgaagctggtgcgctttctgccagccctgcggcgccagctcgtggtgctggtgaagaccatggacaacgtggctaccttctgcacgctgctcatgctcttcattttcatcttcagcatcctgggcatgcaccttttcggctgcaagttcagcctgaagacagacaccggagacaccgtgcctgacaggaagaacttcgactccctgctgtgggccatcgtcaccgtgttccagatcctgacccaggaggactggaacgtggtcctgtacaacggcatggcctccacctcctcctgggccgccctctacttcgtggccctcatgaccttcggcaactatgtgctcttcaacctgctggtggccatcctcgtggagggcttccaggcggagggcgatgccaacagatccgacacggacgaggacaagacgtcggtccacttcgaggaggacttccacaagctcagagaactccagaccacagagctgaagatgtgttccctggccgtgacccccaacgggcacctggagggacgaggcagcctgtcccctcccctcatcatgtgcacagctgccacgcccatgcctacccccaagagctcaccattcctggatgcagcccccagcctcccagactctcggcgtggcagcagcagctccggggacccgccactgggagaccagaagcctccggccagcctccgaagttctccctgtgccccctggggccccagtggcgcctggagcagccggcgctccagctggagcagcctgggccgtgcccccagcctcaagcgccgcggccagtgtggggaacgtgagtccctgctgtctggcgagggcaagggcagcaccgacgacgaagctgaggacggcagggccgcgcccgggccccgtgccaccccactgcggcgggccgagtccctggacccacggcccctgcggccggccgccctcccgcctaccaagtgccgcgatcgcgacgggcaggtggtggccctgcccagcgacttcttcctgcgcatcgacagccaccgtgaggatgcagccgagcttgacgacgactcggaggacagctgctgcctccgcctgcataaagtgctggagccctacaagccccagtggtgccggagccgcgaggcctgggccctctacctcttctccccacagaaccggttccgcgtctcctgccagaaggtcatcacacacaagatgtttgatcacgtggtcctcgtcttcatcttcctcaactgcgtcaccatcgccctggagaggcctgacattgatcccggcagcaccgagcgggtcttcctcagcgtctccaattacatcttcacggccatcttcgtggcggagatgatggtgaaggtggtggccctggggctgctgtccggcgagcacgcctacctgcagagcagctggaacctgctggatgggctgctggtgctggtgtccctggtggacattgtcgtggccatggcctcggctggtggcgccaagatcctgggtgttctgcgcgtgctgcgtctgctgcggaccctgcggcctctgagggtcatcagccgggccccgggcctcaagctggtggtggagacgctgatatcatcactcaggcccattgggaacatcgtcctcatctgctgcgccttcttcatcatttttggcattttgggtgtgcagctcttcaaagggaagttctactactgcgagggccccgacaccaggaacatctccaccaaggcacagtgccgggccgcccactaccgctgggtgcgacgcaagtacaacttcgacaacctgggccaggccctgatgtcgctgttcgtgctgtcatccaaggatggatgggtgaacatcatgtacgacgggctggatgccgtgggtgtcgaccagcagcctgtgcagaaccacaacccctggatgctgctgtacttcatctccttcctgctcatcgtcagcttcttcgtgctcaacatgttcgtgggcgtcgtggtcgagaacttccacaagtgccggcagcaccaggaggcggaggaggcgcggcggcgagaggagaagcggctgcggcgcctagagaggaggcgcaggagcactttccccagcccagaggcccagcgccggccctactatgccgactactcgcccacgcgccgctccattcactcgctgtgcaccagccactatctcgacctcttcatcaccttcatcatctgtgtcaacgtcatcaccatgtccatggagcactataaccaacccaagtcgctggacgaggccctcaagtactgcaactacgtcttcaccatcgtgtttgtcttcgaggctgcactgaagctggtagcatttgggttccgtcggttcttcaaggacaggtggaaccagctggacctggccatcgtgctgctgtcactcatgggcatcacgctggaggagatagagatgagcgccgcgctgcccatcaaccccaccatcatccgcatcatgcgcgtgcttcgcattgcccgtgtgctgaagctgctgaagatggctacgggcatgcgcgccctgctggacactgtggtgcaagctctcccccaggtggggaacctgggccttcttttcatgctcctgttttttatctatgctgcgctgggagtggagctgttcgggaggctggagtgcagtgaagacaacccctgcgagggcctgagcaggcacgccaccttcagcaacttcggcatggccttcctcacgctgttccgcgtgtccacgggggacaactggaacgggatcatgaaggacacgctgcgcgagtgctcccgtgaggacaagcactgcctgagctacctgccggccctgtcgcccgtctacttcgtgaccttcgtgctggtggcccagttcgtgctggtgaacgtggtggtggccgtgctcatgaagcacctggaggagagcaacaaggaggcacgggaggatgcggagctggacgccgagatcgagctggagatggcgcagggccccgggagtgcacgccgggtggacgcggacaggcctcccttgccccaggagagtccgggcgccagggacgccccaaacctggttgcacgcaaggtgtccgtgtccaggatgctctcgctgcccaacgacagctacatgttcaggcccgtggtgcctgcctcggcgccccacccccgcccgctgcaggaggtggagatggagacctatggggccggcacccccttgggctccgttgcctctgtgcactctccgcccgcagagtcctgtgcctccctccagatcccattggctgtgtcgtccccagccaggagcggcgagcccctccacgccctgtcccctcggggcacagcccgctcccccagtctcagccggctgctctgcagacaggaggctgtgcacaccgattccttggaagggaagattgacagccctagggacaccctggatcctgcagagcctggtgagaaaaccccggtgaggccggtgacccaggggggctccctgcagtccccaccacgctccccacggcccgccagcgtccgcactcgtaagcataccttcggacagcgctgcgtctccagccggccggcggccccaggcggagaggaggccgaggcctcggacccagccgacgaggaggtcagccacatcaccagctccgcctgcccctggcagcccacagccgagccccatggccccgaagcctctccggtggccggcggcgagcgggacctgcgcaggctctacagcgtggatgctcagggcttcctggacaagccgggccgggcagacgagcagtggcggccctcggcggagctgggcagcggggagcctggggaggcgaaggcctggggccctgaggccgagcccgctctgggtgcgcgcagaaagaagaagatgagccccccctgcatctcggtggaaccccctgcggaggacgagggctctgcgcggccctccgcggcagagggcggcagcaccacactgaggcgcaggaccccgtcctgtgaggccacgcctcacagggactccctggagcccacagagggctcaggcgccgggggggaccctgcagccaagggggagcgctggggccaggcctcctgccgggctgagcacctgaccgtccccagctttgcctttgagccgctggacctcggggtccccagtggagaccctttcttggacggtagccacagtgtgaccccagaatccagagcttcctcttcaggggccatagtgcccctggaacccccagaatcagagcctcccatgcccgtcggtgaccccccagagaagaggcgggggctgtacctcacagtcccccagtgtcctctggagaaaccagggtccccctcagccacccctgccccagggggtggtgcagatgaccccgtgtagctcggggcttggtgccgcccacggctttggccctggggtctgggggccccgctggggtggaggcccaggcagaaccctgcatggaccctgacttgggtcccgtcgtgagcagaaaggcccggggaggatgacggcccaggccctggttctctgcccagcgaagcaggagtagctgccgggccccacgagcctccgtccgttctggttcgggtttctccgagttttgctaccagccgaggctgtgcgggcaactgggtcagcctcccgtcaggagagaagccgcgtctgtgggacgaagaccgggcacccgccagagaggggaaggtaccaggttgcgtcctttcaggccccgcgttgttacaggacactcgctgggggccctgtgcccttgccggcggcaggttgcagccaccgcggcccaatgtcaccttcactcacagtctgagttcttgtccgcctgtcacgccctcaccaccctccccttccagccaccaccctttccgttccgctcgggccttcccagaagcgtcctgtgactctgggagaggtgacacctcactaaggggccgaccccatggagtaacgcgcccggccccgatgcgaatcaggcctcccctacatctgggggcgttggccgcgagattcccattgacacctttgtttcgtgtgcttttaaattcaggttaaatgttgcaataatctgatgcagaagactcagcttctcaagggagagggagggggcggagcggaataaatagtaacttatttaagaaatgc

SEQ ID NO: 4224 - DNA, 8069 bp, Homo sapiens
cgaggccgccgccgtcgcctccgccgggcgagccggagccggagtcgagccgcggccgggagccgggcgggctggggacgcgggccgggggcggaggcgctgggggccggggccggggccgggggcggaggcgctgggggccggggccggggccgggcgccgagcggggtccgcggtgaccgcgccgcccgggcgatgcccgcggggacgccgccggccagcagagcgaggtgctgccggccgccaccatgaccgagggcgcacgggccgccgacgaggtccgggtgcccctgggcgcgccgccccctggccctgcggcgttggtgggggcgtccccggagagccccggggcgccgggacgcgaggcggagcgggggtccgagctcggcgtgtcaccctccgagagcccggcggccgagcgcggcgcggagctgggtgccgacgaggagcagcgcgtcccgtacccggccttggcggccacggtcttcttctgcctcggtcagaccacgcggccgcgcagctggtgcctccggctggtctgcaacccatggttcgagcacgtgagcatgctggtaatcatgctcaactgcgtgaccctgggcatgttccggccctgtgaggacgttgagtgcggctccgagcgctgcaacatcctggaggcctttgacgccttcattttcgccttttttgcggtggagatggtcatcaagatggtggccttggggctgttcgggcagaagtgttacctgggtgacacgtggaacaggctggatttcttcatcgtcgtggcgggcatgatggagtactcgttggacggacacaacgtgagcctctcggctatcaggaccgtgcgggtgctgcggcccctccgcgccatcaaccgcgtgcctagcatgcggatcctggtcactctgctgctggatacgctgcccatgctcgggaacgtccttctgctgtgcttcttcgtcttcttcattttcggcatcgttggcgtccagctctgggctggcctcctgcggaaccgctgcttcctggacagtgcctttgtcaggaacaacaacctgaccttcctgcggccgtactaccagacggaggagggcgaggagaacccgttcatctgctcctcacgccgagacaacggcatgcagaagtgctcgcacatccccggccgccgcgagctgcgcatgccctgcaccctgggctgggaggcctacacgcagccgcaggccgagggggtgggcgctgcacgcaacgcctgcatcaactggaaccagtactacaacgtgtgccgctcgggtgactccaacccccacaacggtgccatcaacttcgacaacatcggctacgcctggattgccatcttccaggtgatcacgctggaaggctgggtggacatcatgtactacgtcatggacgcccactcattctacaacttcatctatttcatcctgctcatcatcgtgggctccttcttcatgatcaacctgtgcctggtggtgattgccacgcagttctcggagacgaagcagcgggagagtcagctgatgcgggagcagcgggcacgccacctgtccaacgacagcacgctggccagcttctccgagcctggcagctgctacgaagagctgctgaagtacgtgggccacatattccgcaaggtcaagcggcgcagcttgcgcctctacgcccgctggcagagccgctggcgcaagaaggtggaccccagtgctgtgcaaggccagggtcccgggcaccgccagcgccgggcaggcaggcacacagcctcggtgcaccacctggtctaccaccaccatcaccaccaccaccaccactaccatttcagccatggcagcccccgcaggcccggccccgagccaggcgcctgcgacaccaggctggtccgagctggcgcgcccccctcgccaccttccccaggccgcggaccccccgacgcagagtctgtgcacagcatctaccatgccgactgccacatagaggggccgcaggagagggcccgggtggcacatgccgcagccactgccgctgccagcctcagactggccacagggctgggcaccatgaactaccccacgatcctgccctcaggggtgggcagcggcaaaggcagcaccagccccggacccaaggggaagtgggccggtggaccgccaggcaccggggggcacggcccgttgagcttgaacagccctgatccctacgagaagatcccgcatgtggtcggggagcatggactgggccaggcccctggccatctgtcgggcctcagtgtgccctgccccctgcccagccccccagcgggcacactgacctgtgagctgaagagctgcccgtactgcacccgtgccctggaggacccggagggtgagctcagcggctcggaaagtggagactcagatggccgtggcgtctatgaattcacgcaggacgtccggcacggtgaccgctgggaccccacgcgaccaccccgtgcgacggacacaccaggcccaggcccaggcagcccccagcggcgggcacagcagagggcagccccgggcgagccaggctggatgggccgcctctgggttaccttcagcggcaagctgcgccgcatcgtggacagcaagtacttcagccgtggcatcatgatggccatccttgtcaacacgctgagcatgggcgtggagtaccatgagcagcccgaggagctgactaatgctctggagatcagcaacatcgtgttcaccagcatgtttgccctggagatgctgctgaagctgctggcctgcggccctctgggctacatccggaacccgtacaacatcttcgacggcatcatcgtggtcatcagcgtctgggagatcgtggggcaggcggacggtggcttgtctgtgctgcgcaccttccggctgctgcgtgtgctgaagctggtgcgctttctgccagccctgcggcgccagctcgtggtgctggtgaagaccatggacaacgtggctaccttctgcacgctgctcatgctcttcattttcatcttcagcatcctgggcatgcaccttttcggctgcaagttcagcctgaagacagacaccggagacaccgtgcctgacaggaagaacttcgactccctgctgtgggccatcgtcaccgtgttccagatcctgacccaggaggactggaacgtggtcctgtacaacggcatggcctccacctcctcctgggccgccctctacttcgtggccctcatgaccttcggcaactatgtgctcttcaacctgctggtggccatcctcgtggagggcttccaggcggagggcgatgccaacagatccgacacggacgaggacaagacgtcggtccacttcgaggaggacttccacaagctcagagaactccagaccacagagctgaagatgtgttccctggccgtgacccccaacgggcacctggagggacgaggcagcctgtcccctcccctcatcatgtgcacagctgccacgcccatgcctacccccaagagctcaccattcctggatgcagcccccagcctcccagactctcggcgtggcagcagcagctccggggacccgccactgggagaccagaagcctccggccagcctccgaagttctccctgtgccccctggggccccagtggcgcctggagcagccggcgctccagctggagcagcctgggccgtgcccccagcctcaagcgccgcggccagtgtggggaacgtgagtccctgctgtctggcgagggcaagggcagcaccgacgacgaagctgaggacggcagggccgcgcccgggccccgtgccaccccactgcggcgggccgagtccctggacccacggcccctgcggccggccgccctcccgcctaccaagtgccgcgatcgcgacgggcaggtggtggccctgcccagcgacttcttcctgcgcatcgacagccaccgtgaggatgcagccgagcttgacgacgactcggaggacagctgctgcctccgcctgcataaagtgctggagccctacaagccccagtggtgccggagccgcgaggcctgggccctctacctcttctccccacagaaccggttccgcgtctcctgccagaaggtcatcacacacaagatgtttgatcacgtggtcctcgtcttcatcttcctcaactgcgtcaccatcgccctggagaggcctgacattgatcccggcagcaccgagcgggtcttcctcagcgtctccaattacatcttcacggccatcttcgtggcggagatgatggtgaaggtggtggccctggggctgctgtccggcgagcacgcctacctgcagagcagctggaacctgctggatgggctgctggtgctggtgtccctggtggacattgtcgtggccatggcctcggctggtggcgccaagatcctgggtgttctgcgcgtgctgcgtctgctgcggaccctgcggcctctgagggtcatcagccgggccccgggcctcaagctggtggtggagacgctgatatcatcactcaggcccattgggaacatcgtcctcatctgctgcgccttcttcatcatttttggcattttgggtgtgcagctcttcaaagggaagttctactactgcgagggccccgacaccaggaacatctccaccaaggcacagtgccgggccgcccactaccgctgggtgcgacgcaagtacaacttcgacaacctgggccaggccctgatgtcgctgttcgtgctgtcatccaaggatggatgggtgaacatcatgtacgacgggctggatgccgtgggtgtcgaccagcagcctgtgcagaaccacaacccctggatgctgctgtacttcatctccttcctgctcatcgtcagcttcttcgtgctcaacatgttcgtgggcgtcgtggtcgagaacttccacaagtgccggcagcaccaggaggcggaggaggcgcggcggcgagaggagaagcggctgcggcgcctagagaggaggcgcaggaaggcccagcgccggccctactatgccgactactcgcccacgcgccgctccattcactcgctgtgcaccagccactatctcgacctcttcatcaccttcatcatctgtgtcaacgtcatcaccatgtccatggagcactataaccaacccaagtcgctggacgaggccctcaagtactgcaactacgtcttcaccatcgtgtttgtcttcgaggctgcactgaagctggtagcatttgggttccgtcggttcttcaaggacaggtggaaccagctggacctggccatcgtgctgctgtcactcatgggcatcacgctggaggagatagagatgagcgccgcgctgcccatcaaccccaccatcatccgcatcatgcgcgtgcttcgcattgcccgtgtgctgaagctgctgaagatggctacgggcatgcgcgccctgctggacactgtggtgcaagctctcccccaggtggggaacctgggccttcttttcatgctcctgttttttatctatgctgcgctgggagtggagctgttcgggaggctggagtgcagtgaagacaacccctgcgagggcctgagcaggcacgccaccttcagcaacttcggcatggccttcctcacgctgttccgcgtgtccacgggggacaactggaacgggatcatgaaggacacgctgcgcgagtgctcccgtgaggacaagcactgcctgagctacctgccggccctgtcgcccgtctacttcgtgaccttcgtgctggtggcccagttcgtgctggtgaacgtggtggtggccgtgctcatgaagcacctggaggagagcaacaaggaggcacgggaggatgcggagctggacgccgagatcgagctggagatggcgcagggccccgggagtgcacgccgggtggacgcggacaggcctcccttgccccaggagagtccgggcgccagggacgccccaaacctggttgcacgcaaggtgtccgtgtccaggatgctctcgctgcccaacgacagctacatgttcaggcccgtggtgcctgcctcggcgccccacccccgcccgctgcaggaggtggagatggagacctatggggccggcacccccttgggctccgttgcctctgtgcactctccgcccgcagagtcctgtgcctccctccagatcccattggctgtgtcgtccccagccaggagcggcgagcccctccacgccctgtcccctcggggcacagcccgctcccccagtctcagccggctgctctgcagacaggaggctgtgcacaccgattccttggaagggaagattgacagccctagggacaccctggatcctgcagagcctggtgagaaaaccccggtgaggccggtgacccaggggggctccctgcagtccccaccacgctccccacggcccgccagcgtccgcactcgtaagcataccttcggacagcgctgcgtctccagccggccggcggccccaggcggagaggaggccgaggcctcggacccagccgacgaggaggtcagccacatcaccagctccgcctgcccctggcagcccacagccgagccccatggccccgaagcctctccggtggccggcggcgagcgggacctgcgcaggctctacagcgtggatgctcagggcttcctggacaagccgggccgggcagacgagcagtggcggccctcggcggagctgggcagcggggagcctggggaggcgaaggcctggggccctgaggccgagcccgctctgggtgcgcgcagaaagaagaagatgagccccccctgcatctcggtggaaccccctgcggaggacgagggctctgcgcggccctccgcggcagagggcggcagcaccacactgaggcgcaggaccccgtcctgtgaggccacgcctcacagggactccctggagcccacagagggctcaggcgccgggggggaccctgcagccaagggggagcgctggggccaggcctcctgccgggctgagcacctgaccgtccccagctttgcctttgagccgctggacctcggggtccccagtggagaccctttcttggacggtagccacagtgtgaccccagaatccagagcttcctcttcaggggccatagtgcccctggaacccccagaatcagagcctcccatgcccgtcggtgaccccccagagaagaggcgggggctgtacctcacagtcccccagtgtcctctggagaaaccagggtccccctcagccacccctgccccagggggtggtgcagatgaccccgtgtagctcggggcttggtgccgcccacggctttggccctggggtctgggggccccgctggggtggaggcccaggcagaaccctgcatggaccctgacttgggtcccgtcgtgagcagaaaggcccggggaggatgacggcccaggccctggttctctgcccagcgaagcaggagtagctgccgggccccacgagcctccgtccgttctggttcgggtttctccgagttttgctaccagccgaggctgtgcgggcaactgggtcagcctcccgtcaggagagaagccgcgtctgtgggacgaagaccgggcacccgccagagaggggaaggtaccaggttgcgtcctttcaggccccgcgttgttacaggacactcgctgggggccctgtgcccttgccggcggcaggttgcagccaccgcggcccaatgtcaccttcactcacagtctgagttcttgtccgcctgtcacgccctcaccaccctccccttccagccaccaccctttccgttccgctcgggccttcccagaagcgtcctgtgactctgggagaggtgacacctcactaaggggccgaccccatggagtaacgcgcccggccccgatgcgaatcaggcctcccctacatctgggggcgttggccgcgagattcccattgacacctttgtttcgtgtgcttttaaattcaggttaaatgttgcaataatctgatgcagaagactcagcttctcaagggagagggagggggcggagcggaataaatagtaacttatttaagaaatgc

SEQ ID NO: 4225 - DNA, 10015 bp, Homo sapiens
atggctgagagcgcctccccgccctcctcatctgcagcagccccagccgctgagccaggagtcaccacggagcagcccggaccccggagccccccatcctccccgccaggcctggaggagcctctggatggagctgatcctcatgtcccacacccagacctggcgcctattgccttcttctgcctgcgacagaccaccagcccccggaactggtgcatcaagatggccactgggccttggtggtggtgcctgtgcatgctggtgatcctgctgaactgcgtgacacttggcatgtaccagccgtgcgacgacatggactgcctgtccgaccgctgcaagatcctgcaggtctttgatgacttcatctttatcttctttgccatggagatggtgctcaagatggtggccctggggatttttggcaagaagtgctacctcggggacacatggaaccgcctggatttcttcatcgtcatggcagggatggtcgagtactccctggaccttcagaacatcaacctgtcagccatccgcaccgtgcgcgtcctgaggcccctcaaagccatcaaccgcgtgcccagtatgcggatcctggtgaacctgctcctggacacactgcccatgctggggaatgtcctgctgctctgcttctttgtcttcttcatctttggcatcataggtgtgcagctctgggcgggcctgctgcgtaaccgctgcttcctggaggagaacttcaccatacaaggggatgtggccttgcccccatactaccagccggaggaggatgatgagatgcccttcatctgctccctgtcgggcgacaatgggataatgggctgccatgagatccccccgctcaaggagcagggccgtgagtgctgcctgtccaaggacgacgtctacgactttggggcggggcgccaggacctcaatgccagcggcctctgtgtcaactggaaccgttactacaatgtgtgccgcacgggcagcgccaacccccacaagggtgccatcaactttgacaacatcggttatgcttggattgtcatcttccaggtgatcactctggaaggctgggtggagatcatgtactacgtgatggatgctcactccttctacaacttcatctacttcatcctgcttatcatagtgggctccttcttcatgatcaacctgtgcctcgttgtcatagcgacccagttctcggagaccaagcaacgggagcaccggctgatgctggagcagcggcagcgctacctgtcctccagcacggtggccagctacgccgagcctggcgactgctacgaggagatcttccagtatgtctgccacatcctgcgcaaggccaagcgccgcgccctgggcctctaccaggccctgcagagccggcgccaggccctgggcccggaggccccggcccccgccaaacctgggccccacgccaaggagccccggcactaccatgggaagactaagggtcagggagatgaagggagacatctcggaagccggcattgccagactttgcatgggcctgcctcccctggaaatgatcactcgggaagaggcaagccagggccacgggagctgtgcccgcaacatagccccctggatgcgacgccccacaccctggtgcagcccatccccgccacgctggcttccgatcccgccagctgcccttgctgccagcatgaggacggccggcggccctcgggcctgggcagcaccgactcgggccaggagggctcgggctccgggagctccgctggtggcgaggacgaggcggatggggacggggcccggagcagcgaggacggagcctcctcagaactggggaaggaggaggaggaggaggagcaggcggatggggcggtctggctgtgcggggatgtgtggcgggagacgcgagccaagctgcgcggcatcgtggacagcaagtacttcaaccggggcatcatgatggccatcctggtcaacaccgtcagcatgggcatcgagcaccacgagcaggccaatgagctgaccaacatcctggagatctgcaatgtggtcttcaccagcatgtttgccctggagatgatcctgaagctggctgcatttgggctcttcgactacctgcgtaacccctacaacatcttcgacagcatcattgtcatcatcagcatctgggagattgtggggcaggcggacggtgggctgtcggtgctgcggaccttccggctgctgcgcgtgctgaaactggtgcgcttcatgcctgccctgcggcgccagctcgtggtgctcatgaagaccatggacaacgtggccaccttctgcatgctgctcatgctcttcatcttcatcttcagcatccttgggatgcatatttttggctgcaagttcagcctccgcacggacactggagacacggtgcccgacaggaagaacttcgactccctgctgtgggccatcgtcactgtgttccagatcctcacccaggaggactggaacgtcgttctctacaatggcatggcctccacttctccctgggcctccctctactttgtcgccctcatgaccttcggcaactatgtgctcttcaacctgctggtggccatcctggtggagggcttccaggcggagggtgacgccaatcgctcctactcggacgaggaccagagctcatccaacatagaagagtttgataagctccaggaaggcctggacagcagcggagatcccaagctctgcccaatccccatgacccccaatgggcacctggaccccagtctcccactgggtgggcacctaggtcctgctggggctgcgggacctgccccccgactctcactgcagccggaccccatgctggtggccctgggctcccgaaagagcagtgtcatgtctctagggaggatgagctatgaccagcgctccctgtccagctcccggagctcctactacgggccatggggccgcagcgcggcctgggccagccgtcgctccagctggaacagcctcaagcacaagccgccgtcggcggagcatgagtccctgctctctgcggagcgcggcggcggcgcccgggtctgcgaggttgccgcggacgaggggccgccgcgggccgcacccctgcacaccccacacgcccaccacattcatcacgggccccatctggcgcaccgccaccgccaccaccgccggacgctgtccctcgacaacagggactcggtggacctggccgagctggtgcccgcggtgggcgcccacccccgggccgcctggagggcggcaggcccggcccccgggcatgaggactgcaatggcaggatgcccagcatcgccaaagacgtcttcaccaagatgggcgaccgcggggatcgcggggaggatgaggaggaaatcgactacaccctgtgcttccgcgtccgcaagatgatcgacgtctataagcccgactggtgcgaggtccgcgaagactggtctgtctacctcttctctcccgagaacaggttccgggtcctgtgtcagaccattattgcccacaaactcttcgactacgtcgtcctggccttcatctttctcaactgcatcaccatcgccctggagcggcctcagatcgaggccggcagcaccgaacgcatctttctcaccgtgtccaactacatcttcacggccatcttcgtgggcgagatgacattgaaggtagtctcgctgggcctgtacttcggcgagcaggcgtacctacgcagcagctggaacgtgctggatggctttcttgtcttcgtgtccatcatcgacatcgtggtgtccctggcctcagccgggggagccaagatcttgggggtcctccgagtcttgcggctcctgcgcaccctacgccccctgcgtgtcatcagccgggcgccgggcctgaagctggtggtggagacactcatctcctccctcaagcccatcggcaacatcgtgctcatctgctgtgccttcttcatcatctttggcatcctgggagtgcagctcttcaagggcaagttctaccactgtctgggcgtggacacccgcaacatcaccaaccgctcggactgcatggccgccaactaccgctgggtccatcacaaatacaacttcgacaacctgggccaggctctgatgtccctctttgtcctggcatccaaggatggttgggtgaacatcatgtacaatggactggatgctgttgctgtggaccagcagcctgtgaccaaccacaacccctggatgctgctgtacttcatctccttcctgctcatcgtcagcttctttgtgctcaacatgtttgtgggtgtcgtggtggagaacttccacaagtgccggcagcaccaggaggctgaagaggcacggcggcgtgaggagaagcggctgcggcgcctggagaagaagcgccggaaggcccagcggctgccctactatgccacctattgtcacacccggctgctcatccactccatgtgcaccagccactacctggacatcttcatcaccttcatcatctgcctcaacgtggtcaccatgtccctggagcactacaatcagcccacgtccctggagacagccctcaagtactgcaactatatgttcaccactgtctttgtgctggaggctgtgctgaagctggtggcatttggtctgaggcgcttcttcaaggaccgatggaaccagctggacctggccattgtgctactgtcagtcatgggcatcaccctggaggagatcgagatcaatgcggccctgcccatcaatcccaccatcatccgcatcatgagggttctgcgcattgcccgagtgctgaagctgttgaagatggccacaggaatgcgggccctgctggacacggtggtgcaagctttgccccaggtgggcaacctgggcctcctcttcatgctgctcttcttcatctatgctgctctcggggtggagctctttgggaagctggtctgcaacgacgagaacccgtgcgagggcatgagccggcatgccaccttcgagaacttcggcatggccttcctcacactcttccaggtctccacgggtgacaactggaacgggatcatgaaggacacgctgcgggactgcacccacgacgagcgcagctgcctgagcagcctgcagtttgtgtcgccgctgtacttcgtgagcttcgtgctcaccgcgcagttcgtgctcatcaacgtggtggtggctgtgctcatgaagcacctggacgacagcaacaaggaggcgcaggaggacgccgagatggatgccgagctcgagctggagatggcccatggcctgggccctggcccgaggctgcctaccggctccccgggcgcccctggccgagggccgggaggggcgggcggcgggggcgacaccgagggcggcttgtgccggcgctgctactcgcctgcccaggagaacctgtggctggacagcgtctctttaatcatcaaggactccttggagggggagctgaccatcatcgacaacctgtcgggctccatcttccaccactactcctcgcctgccggctgcaagaagtgtcaccacgacaagcaagaggtgcagctggctgagacggaggccttctccctgaactcagacaggtcctcgtccatcctgctgggtgacgacctgagtctcgaggaccccacagcctgcccacctggccgcaaagacagcaagggtgagctggacccacctgagcccatgcgtgtgggagacctgggcgaatgcttcttccccttgtcctctacggccgtctcgccggatccagagaacttcctgtgtgagatggaggagatcccattcaaccctgtccggtcctggctgaaacatgacagcagtcaagcacccccaagtcccttctccccggatgcctccagccctctcctgcccatgccagccgagttcttccaccctgcagtgtctgccagccagaaaggcccagaaaagggcactggcactggaaccctccccaagattgcgctgcagggctcctgggcatctctgcggtcaccaagggtcaactgtaccctcctccggcaggccaccgggagcgacacgtcgctggacgccagccccagcagctccgcgggcagcctgcagaccacgctcgaggacagcctgaccctgagcgacagcccccggcgtgccctggggccgcccgcgcctgctccaggaccccgggccggcctgtcccccgccgctcgccgccgcctgagcctgcgcggccggggcctcttcagcctgcgggggctgcgggcgcatcagcgcagccacagcagcgggggctccaccagcccgggctgcacccaccacgactccatggacccctcggacgaggagggccgcggtggcgcgggcggcgggggcgcgggcagcgagcactcggagaccctcagcagcctctcgctcacctccctcttctgcccgccgcccccgccgccagcccccggcctcacgcccgccaggaagttcagcagcaccagcagcctggccgcccccggccgcccccacgccgccgccctggcccacggcctggcccggagcccctcgtgggccgcggaccgcagcaaggacccccccggccgggcaccgctgcccatgggcctgggccccttggcgcccccgccgcaaccgctccccggagagctggagccgggagacgccgccagcaagaggaagagatgagggtcgcaggggcccccggccgcccaccgcccgccccgtctcaccttctttacctcaggagccaggagcagacagcaatacttcgtccacacctgggatcgcgcagggcccgcagggcacaggcgcccgacagccgggctgagcggagtctgggttagccaggcctgcgtggcccatggtggcccttccagtgcatatacatacatatatatatatatatgcatatatatatatatatatatatatatgtgtatacacacacacatagacagacatatatatatatatttattttttttactgagagcttatgacttccagaaagtgctaaaggtgggaggtgggccagggcctggacggggcttttgtctgatgctctgggattctggccagacccaccccagggcacatgtcctgcgggggcgtcccagctgtgttttttgatgtctcctccctggttaagagtagcttggagaggaccctcaggcctctgagggcaccaggccctggagaagaggtgcaattcagggtgtgtgtgtgttttttttcctttaaagaagaaacgctgctaagatcccacgtggctcccacgtgtcggggtgtctgtcctgtcatcctgactgtctcgttattgtgaagtctttcgtagacaccccagagcacacacatccccttagtccaccggttagatgtctctctttagaaaaatcaggggtgagtagctgtgtttccttaggcctggggtaggggatggagagcagctccaaggctgagctggggctctggccccaggtgaggtccccagctcctgagcacttctgagggggtgggttccacccccaggagggcgggggtgggtggagcaggagtggaggcagcctgcagaggaagggtgcgggagactgagccggcagtggcttgcttggaggggctagggtacccgcctggtctcggctggctccagctgccctgcaggtgcccctgggctcaggtagttagttgttcagccactaatgccttttatcccccatatgggcgctgagctgtggctgttcctggacactgtgctgtccccgtcctgagcaactatgcccccgccccagtaggttcaaggcaaagcagctctgaccgaattctaggcaggggtgggggcacctgcctgggccctgggtccagccgcatccccatgcccagcctttcgcgtcacctggaggccacatcttcccaccccacctgccagcccctgtctctcctccccgctgcccctaactgcagctcagctttcactatagcagtgcttcccaaacgggttctagacttgggtgtttgatttgaagagttacgcatttatttcactatttattgggaaaaaaatgcattgaacccgtgatttcacagacattttgcttaggtcaaggctactttttaaaaagggagtgactttcatgaagtcagtttgaagaaggaggttgggagcatgttggtggcagtgatctggagaggctgcaggggccacgagtttgcagatgctgtacttcagcaataaccttgcctttgctaagaccccctccgagggcttcaggggggcctgccaagggggggccttgttcttgttcccaaactctgacttggaagaactcagcttgtggccgggctggtgagggtgtggggtgcgcccttcccttttgggctgagggagagggggccgggaggggttgtcaagcccacccgggaaactgagccctggagaggggaagcagccagcccaggatgcttcagggccctggcagcaaagaagctggggtggtgtggagggccctactccacaccctagagctgtgatgctgagcaaggtgcctgtggcggaaggaactgcccagtcctccctgggggcaggtagacctgtggggatggctcggtccaagcccaacactgcccgctccagagagcctcagccctgcctccctttccacagaggtggttttatgtggaacgaggtaccttgtctggggaagaagtggagctgggcaggcttgactgctcctggctgaccctgagctctcgcagttggagggaagcagacagacttgactttttgcaagtccgcgtgttgctggagggacacgtgtattggagcccagaagaggggctgtgtggcctgggaataccatgtggaaggttgggcttcaagttaacaggatcagacaccagtcaagcagcctcaggtcatcttgcgactccactgagcagcctttcctgttgtcacatgggttcagagcagctgagcagggaacacgtcctaggcaggtctgacgtgaaacctccccttaccctgaaccgtgtgactctgcaagcagacacctcgaggcaggtgttctaggcaaagggatgggcatgagcgaaggctccagggtccacagagcagggagtgtggagaaggtggaagagctgagctcagaggcagagaagctccttgcagggagcactgggagatggcctggcccgtcccaggctcctggaggccccacctgccgatcccaggcacttgaccttgttcctgtgggtgacagagatgagaaccagggaagctgtgatccactggccaggacaagtcaacatgggtgagggttgggcaaagggcccttccttcctccccaaccctgtggtctggggccatggcctcaggcttgtgtctatcacaaaagcacaaacttgccctaacccacatgggcctggctgtggggaaagtggggacccaggtccctgagctgtctgctgggctccgtagagcggtggtgggcaggcaccttggcatctgtgcagagacggcccagtctggccaaatcctcttcctctcccctgctctaccttctccggcaccaggcagccccttaaaggaggacaaagtgtgtaaagcccgtctgctgtcttcccccaaatcctcagctcagagccttccgcttccagggccaaccccagccccgtttgctgcgttgtgtaagggcttggggtcttagaagctgctctttagcccagatacacatactcttttttgtctttgtgcaataatcagtgttcctggcagagcctgggccaagctgcagcctactgaggaggcagaggccacctcctccagaaagccctcggcctgggccgccgccgtgactctagcactctcagtcgctgtacagtttctatggtgtgaatgaacttccctcctagttgctgatggcgctggtacctgctggcccatggcccgggtgtagagaaaccaagcggcagccaccaccagtgttgttttgaataaaagcccagaagcctattt

SEQ ID NO: 4226 - DNA, 9892 bp, Homo sapiens
atggctgagagcgcctccccgccctcctcatctgcagcagccccagccgctgagccaggagtcaccacggagcagcccggaccccggagccccccatcctccccgccaggcctggaggagcctctggatggagctgatcctcatgtcccacacccagacctggcgcctattgccttcttctgcctgcgacagaccaccagcccccggaactggtgcatcaagatggccactgggccttggtggtggtgcctgtgcatgctggtgatcctgctgaactgcgtgacacttggcatgtaccagccgtgcgacgacatggactgcctgtccgaccgctgcaagatcctgcaggtctttgatgacttcatctttatcttctttgccatggagatggtgctcaagatggtggccctggggatttttggcaagaagtgctacctcggggacacatggaaccgcctggatttcttcatcgtcatggcagggatggtcgagtactccctggaccttcagaacatcaacctgtcagccatccgcaccgtgcgcgtcctgaggcccctcaaagccatcaaccgcgtgcccagtatgcggatcctggtgaacctgctcctggacacactgcccatgctggggaatgtcctgctgctctgcttctttgtcttcttcatctttggcatcataggtgtgcagctctgggcgggcctgctgcgtaaccgctgcttcctggaggagaacttcaccatacaaggggatgtggccttgcccccatactaccagccggaggaggatgatgagatgcccttcatctgctccctgtcgggcgacaatgggataatgggctgccatgagatccccccgctcaaggagcagggccgtgagtgctgcctgtccaaggacgacgtctacgactttggggcggggcgccaggacctcaatgccagcggcctctgtgtcaactggaaccgttactacaatgtgtgccgcacgggcagcgccaacccccacaagggtgccatcaactttgacaacatcggttatgcttggattgtcatcttccaggtgatcactctggaaggctgggtggagatcatgtactacgtgatggatgctcactccttctacaacttcatctacttcatcctgcttatcatagtgggctccttcttcatgatcaacctgtgcctcgttgtcatagcgacccagttctcggagaccaagcaacgggagcaccggctgatgctggagcagcggcagcgctacctgtcctccagcacggtggccagctacgccgagcctggcgactgctacgaggagatcttccagtatgtctgccacatcctgcgcaaggccaagcgccgcgccctgggcctctaccaggccctgcagagccggcgccaggccctgggcccggaggccccggcccccgccaaacctgggccccacgccaaggagccccggcactaccagctgtgcccgcaacatagccccctggatgcgacgccccacaccctggtgcagcccatccccgccacgctggcttccgatcccgccagctgcccttgctgccagcatgaggacggccggcggccctcgggcctgggcagcaccgactcgggccaggagggctcgggctccgggagctccgctggtggcgaggacgaggcggatggggacggggcccggagcagcgaggacggagcctcctcagaactggggaaggaggaggaggaggaggagcaggcggatggggcggtctggctgtgcggggatgtgtggcgggagacgcgagccaagctgcgcggcatcgtggacagcaagtacttcaaccggggcatcatgatggccatcctggtcaacaccgtcagcatgggcatcgagcaccacgagcaggccacagagctgaccaacatcctggagatctgcaatgtggtcttcaccagcatgtttgccctggagatgatcctgaagctggctgcatttgggctcttcgactacctgcgtaacccctacaacatcttcgacagcatcattgtcatcatcagcatctgggagattgtggggcaggcggacggtgggctgtcggtgctgcggaccttccggctgctgcgcgtgctgaaactggtgcgcttcatgcctgccctgcggcgccagctcgtggtgctcatgaagaccatggacaacgtggccaccttctgcatgctgctcatgctcttcatcttcatcttcagcatccttgggatgcatatttttggctgcaagttcagcctccgcacggacactggagacacggtgcccgacaggaagaacttcgactccctgctgtgggccatcgtcactgtgttccagatcctcacccaggaggactggaacgtcgttctctacaatggcatggcctccacttctccctgggcctccctctactttgtcgccctcatgaccttcggcaactatgtgctcttcaacctgctggtggccatcctggtggagggcttccaggcggagggtgacgccaatcgctcctactcggacgaggaccagagctcatccaacatagaagagtttgataagctccaggaaggcctggacagcagcggagatcccaagctctgcccaatccccatgacccccaatgggcacctggaccccagtctcccactgggtgggcacctaggtcctgctggggctgcgggacctgccccccgactctcactgcagccggaccccatgctggtggccctgggctcccgaaagagcagtgtcatgtctctagggaggatgagctatgaccagcgctccctgtccagctcccggagctcctactacgggccatggggccgcagcgcggcctgggccagccgtcgctccagctggaacagcctcaagcacaagccgccgtcggcggagcatgagtccctgctctctgcggagcgcggcggcggcgcccgggtctgcgaggttgccgcggacgaggggccgccgcgggccgcacccctgcacaccccacacgcccaccacattcatcacgggccccatctggcgcaccgccaccgccaccaccgccggacgctgtccctcgacaacagggactcggtggacctggccgagctggtgcccgcggtgggcgcccacccccgggccgcctggagggcggcaggcccggcccccgggcatgaggactgcaatggcaggatgcccagcatcgccaaagacgtcttcaccaagatgggcgaccgcggggatcgcggggaggatgaggaggaaatcgactacaccctgtgcttccgcgtccgcaagatgatcgacgtctataagcccgactggtgcgaggtccgcgaagactggtctgtctacctcttctctcccgagaacaggttccgggtcctgtgtcagaccattattgcccacaaactcttcgactacgtcgtcctggccttcatctttctcaactgcatcaccatcgccctggagcggcctcagatcgaggccggcagcaccgaacgcatctttctcaccgtgtccaactacatcttcacggccatcttcgtgggcgagatgacattgaaggtagtctcgctgggcctgtacttcggcgagcaggcgtacctacgcagcagctggaacgtgctggatggctttcttgtcttcgtgtccatcatcgacatcgtggtgtccctggcctcagccgggggagccaagatcttgggggtcctccgagtcttgcggctcctgcgcaccctacgccccctgcgtgtcatcagccgggcgccgggcctgaagctggtggtggagacactcatctcctccctcaagcccatcggcaacatcgtgctcatctgctgtgccttcttcatcatctttggcatcctgggagtgcagctcttcaagggcaagttctaccactgtctgggcgtggacacccgcaacatcaccaaccgctcggactgcatggccgccaactaccgctgggtccatcacaaatacaacttcgacaacctgggccaggctctgatgtccctctttgtcctggcatccaaggatggttgggtgaacatcatgtacaatggactggatgctgttgctgtggaccagcagcctgtgaccaaccacaacccctggatgctgctgtacttcatctccttcctgctcatcgtcagcttctttgtgctcaacatgtttgtgggtgtcgtggtggagaacttccacaagtgccggcagcaccaggaggctgaagaggcacggcggcgtgaggagaagcggctgcggcgcctggagaagaagcgccggaaggcccagcggctgccctactatgccacctattgtcacacccggctgctcatccactccatgtgcaccagccactacctggacatcttcatcaccttcatcatctgcctcaacgtggtcaccatgtccctggagcactacaatcagcccacgtccctggagacagccctcaagtactgcaactatatgttcaccactgtctttgtgctggaggctgtgctgaagctggtggcatttggtctgaggcgcttcttcaaggaccgatggaaccagctggacctggccattgtgctactgtcagtcatgggcatcaccctggaggagatcgagatcaatgcggccctgcccatcaatcccaccatcatccgcatcatgagggttctgcgcattgcccgagtgctgaagctgttgaagatggccacaggaatgcgggccctgctggacacggtggtgcaagctttgccccaggtgggcaacctgggcctcctcttcatgctgctcttcttcatctatgctgctctcggggtggagctctttgggaagctggtctgcaacgacgagaacccgtgcgagggcatgagccggcatgccaccttcgagaacttcggcatggccttcctcacactcttccaggtctccacgggtgacaactggaacgggatcatgaaggacacgctgcgggactgcacccacgacgagcgcagctgcctgagcagcctgcagtttgtgtcgccgctgtacttcgtgagcttcgtgctcaccgcgcagttcgtgctcatcaacgtggtggtggctgtgctcatgaagcacctggacgacagcaacaaggaggcgcaggaggacgccgagatggatgccgagctcgagctggagatggcccatggcctgggccctggcccgaggctgcctaccggctccccgggcgcccctggccgagggccgggaggggcgggcggcgggggcgacaccgagggcggcttgtgccggcgctgctactcgcctgcccaggagaacctgtggctggacagcgtctctttaatcatcaaggactccttggagggggagctgaccatcatcgacaacctgtcgggctccatcttccaccactactcctcgcctgccggctgcaagaagtgtcaccacgacaagcaagaggtgcagctggctgagacggaggccttctccctgaactcagacaggtcctcgtccatcctgctgggtgacgacctgagtctcgaggaccccacagcctgcccacctggccgcaaagacagcaagggtgagctggacccacctgagcccatgcgtgtgggagacctgggcgaatgcttcttccccttgtcctctacggccgtctcgccggatccagagaacttcctgtgtgagatggaggagatcccattcaaccctgtccggtcctggctgaaacatgacagcagtcaagcacccccaagtcccttctccccggatgcctccagccctctcctgcccatgccagccgagttcttccaccctgcagtgtctgccagccagaaaggcccagaaaagggcactggcactggaaccctccccaagattgcgctgcagggctcctgggcatctctgcggtcaccaagggtcaactgtaccctcctccggcaggccaccgggagcgacacgtcgctggacgccagccccagcagctccgcgggcagcctgcagaccacgctcgaggacagcctgaccctgagcgacagcccccggcgtgccctggggccgcccgcgcctgctccaggaccccgggccggcctgtcccccgccgctcgccgccgcctgagcctgcgcggccggggcctcttcagcctgcgggggctgcgggcgcatcagcgcagccacagcagcgggggctccaccagcccgggctgcacccaccacgactccatggacccctcggacgaggagggccgcggtggcgcgggcggcgggggcgcgggcagcgagcactcggagaccctcagcagcctctcgctcacctccctcttctgcccgccgcccccgccgccagcccccggcctcacgcccgccaggaagttcagcagcaccagcagcctggccgcccccggccgcccccacgccgccgccctggcccacggcctggcccggagcccctcgtgggccgcggaccgcagcaaggacccccccggccgggcaccgctgcccatgggcctgggccccttggcgcccccgccgcaaccgctccccggagagctggagccgggagacgccgccagcaagaggaagagatgagggtcgcaggggcccccggccgcccaccgcccgccccgtctcaccttctttacctcaggagccaggagcagacagcaatacttcgtccacacctgggatcgcgcagggcccgcagggcacaggcgcccgacagccgggctgagcggagtctgggttagccaggcctgcgtggcccatggtggcccttccagtgcatatacatacatatatatatatatatgcatatatatatatatatatatatatatgtgtatacacacacacatagacagacatatatatatatatttattttttttactgagagcttatgacttccagaaagtgctaaaggtgggaggtgggccagggcctggacggggcttttgtctgatgctctgggattctggccagacccaccccagggcacatgtcctgcgggggcgtcccagctgtgttttttgatgtctcctccctggttaagagtagcttggagaggaccctcaggcctctgagggcaccaggccctggagaagaggtgcaattcagggtgtgtgtgtgttttttttcctttaaagaagaaacgctgctaagatcccacgtggctcccacgtgtcggggtgtctgtcctgtcatcctgactgtctcgttattgtgaagtctttcgtagacaccccagagcacacacatccccttagtccaccggttagatgtctctctttagaaaaatcaggggtgagtagctgtgtttccttaggcctggggtaggggatggagagcagctccaaggctgagctggggctctggccccaggtgaggtccccagctcctgagcacttctgagggggtgggttccacccccaggagggcgggggtgggtggagcaggagtggaggcagcctgcagaggaagggtgcgggagactgagccggcagtggcttgcttggaggggctagggtacccgcctggtctcggctggctccagctgccctgcaggtgcccctgggctcaggtagttagttgttcagccactaatgccttttatcccccatatgggcgctgagctgtggctgttcctggacactgtgctgtccccgtcctgagcaactatgcccccgccccagtaggttcaaggcaaagcagctctgaccgaattctaggcaggggtgggggcacctgcctgggccctgggtccagccgcatccccatgcccagcctttcgcgtcacctggaggccacatcttcccaccccacctgccagcccctgtctctcctccccgctgcccctaactgcagctcagctttcactatagcagtgcttcccaaacgggttctagacttgggtgtttgatttgaagagttacgcatttatttcactatttattgggaaaaaaatgcattgaacccgtgatttcacagacattttgcttaggtcaaggctactttttaaaaagggagtgactttcatgaagtcagtttgaagaaggaggttgggagcatgttggtggcagtgatctggagaggctgcaggggccacgagtttgcagatgctgtacttcagcaataaccttgcctttgctaagaccccctccgagggcttcaggggggcctgccaagggggggccttgttcttgttcccaaactctgacttggaagaactcagcttgtggccgggctggtgagggtgtggggtgcgcccttcccttttgggctgagggagagggggccgggaggggttgtcaagcccacccgggaaactgagccctggagaggggaagcagccagcccaggatgcttcagggccctggcagcaaagaagctggggtggtgtggagggccctactccacaccctagagctgtgatgctgagcaaggtgcctgtggcggaaggaactgcccagtcctccctgggggcaggtagacctgtggggatggctcggtccaagcccaacactgcccgctccagagagcctcagccctgcctccctttccacagaggtggttttatgtggaacgaggtaccttgtctggggaagaagtggagctgggcaggcttgactgctcctggctgaccctgagctctcgcagttggagggaagcagacagacttgactttttgcaagtccgcgtgttgctggagggacacgtgtattggagcccagaagaggggctgtgtggcctgggaataccatgtggaaggttgggcttcaagttaacaggatcagacaccagtcaagcagcctcaggtcatcttgcgactccactgagcagcctttcctgttgtcacatgggttcagagcagctgagcagggaacacgtcctaggcaggtctgacgtgaaacctccccttaccctgaaccgtgtgactctgcaagcagacacctcgaggcaggtgttctaggcaaagggatgggcatgagcgaaggctccagggtccacagagcagggagtgtggagaaggtggaagagctgagctcagaggcagagaagctccttgcagggagcactgggagatggcctggcccgtcccaggctcctggaggccccacctgccgatcccaggcacttgaccttgttcctgtgggtgacagagatgagaaccagggaagctgtgatccactggccaggacaagtcaacatgggtgagggttgggcaaagggcccttccttcctccccaaccctgtggtctggggccatggcctcaggcttgtgtctatcacaaaagcacaaacttgccctaacccacatgggcctggctgtggggaaagtggggacccaggtccctgagctgtctgctgggctccgtagagcggtggtgggcaggcaccttggcatctgtgcagagacggcccagtctggccaaatcctcttcctctcccctgctctaccttctccggcaccaggcagccccttaaaggaggacaaagtgtgtaaagcccgtctgctgtcttcccccaaatcctcagctcagagccttccgcttccagggccaaccccagccccgtttgctgcgttgtgtaagggcttggggtcttagaagctgctctttagcccagatacacatactcttttttgtctttgtgcaataatcagtgttcctggcagagcctgggccaagctgcagcctactgaggaggcagaggccacctcctccagaaagccctcggcctgggccgccgccgtgactctagcactctcagtcgctgtacagtttctatggtgtgaatgaacttccctcctagttgctgatggcgctggtacctgctggcccatggcccgggtgtagagaaaccaagcggcagccaccaccagtgttgttttgaataaaagcccagaagcctattt

SEQ ID NO: 4227 - DNA, 6740 bp, Homo sapiens
atggctgagagcgcctccccgccctcctcatctgcagcagccccagccgctgagccaggagtcaccacggagcagcccggaccccggagccccccatcctccccgccaggcctggaggagcctctggatggagctgatcctcatgtcccacacccagacctggcgcctattgccttcttctgcctgcgacagaccaccagcccccggaactggtgcatcaagatggtgtgcaacccgtggtttgaatgtgtcagcatgctggtgatcctgctgaactgcgtgacacttggcatgtaccagccgtgcgacgacatggactgcctgtccgaccgctgcaagatcctgcaggtctttgatgacttcatctttatcttctttgccatggagatggtgctcaagatggtggccctggggatttttggcaagaagtgctacctcggggacacatggaaccgcctggatttcttcatcgtcatggcagggatggtcgagtactccctggaccttcagaacatcaacctgtcagccatccgcaccgtgcgcgtcctgaggcccctcaaagccatcaaccgcgtgcccagtatgcggatcctggtgaacctgctcctggacacactgcccatgctggggaatgtcctgctgctctgcttctttgtcttcttcatctttggcatcataggtgtgcagctctgggcgggcctgctgcgtaaccgctgcttcctggaggagaacttcaccatacaaggggatgtggccttgcccccatactaccagccggaggaggatgatgagatgcccttcatctgctccctgtcgggcgacaatgggataatgggctgccatgagatccccccgctcaaggagcagggccgtgagtgctgcctgtccaaggacgacgtctacgactttggggcggggcgccaggacctcaatgccagcggcctctgtgtcaactggaaccgttactacaatgtgtgccgcacgggcagcgccaacccccacaagggtgccatcaactttgacaacatcggttatgcttggattgtcatcttccaggtgatcactctggaaggctgggtggagatcatgtactacgtgatggatgctcactccttctacaacttcatctacttcatcctgcttatcatagtgggctccttcttcatgatcaacctgtgcctcgttgtcatagcgacccagttctcggagaccaagcaacgggagcaccggctgatgctggagcagcggcagcgctacctgtcctccagcacggtggccagctacgccgagcctggcgactgctacgaggagatcttccagtatgtctgccacatcctgcgcaaggccaagcgccgcgccctgggcctctaccaggccctgcagagccggcgccaggccctgggcccggaggccccggcccccgccaaacctgggccccacgccaaggagccccggcactaccatgggaagactaagggtcagggagatgaagggagacatctcggaagccggcattgccagactttgcatgggcctgcctcccctggaaatgatcactcgggaagagagctgtgcccgcaacatagccccctggatgcgacgccccacaccctggtgcagcccatccccgccacgctggcttccgatcccgccagctgcccttgctgccagcatgaggacggccggcggccctcgggcctgggcagcaccgactcgggccaggagggctcgggctccgggagctccgctggtggcgaggacgaggcggatggggacggggcccggagcagcgaggacggagcctcctcagaactggggaaggaggaggaggaggaggagcaggcggatggggcggtctggctgtgcggggatgtgtggcgggagacgcgagccaagctgcgcggcatcgtggacagcaagtacttcaaccggggcatcatgatggccatcctggtcaacaccgtcagcatgggcatcgagcaccacgagcagccggaggagctgaccaacatcctggagatctgcaatgtggtcttcaccagcatgtttgccctggagatgatcctgaagctggctgcatttgggctcttcgactacctgcgtaacccctacaacatcttcgacagcatcattgtcatcatcagcatctgggagattgtggggcaggcggacggtgggctgtcggtgctgcggaccttccggctgctgcgcgtgctgaaactggtgcgcttcatgcctgccctgcggcgccagctcgtggtgctcatgaagaccatggacaacgtggccaccttctgcatgctgctcatgctcttcatcttcatcttcagcatccttgggatgcatatttttggctgcaagttcagcctccgcacggacactggagacacggtgcccgacaggaagaacttcgactccctgctgtgggccatcgtcactgtgttccagatcctcacccaggaggactggaacgtcgttctctacaatggcatggcctccacttctccctgggcctccctctactttgtcgccctcatgaccttcggcaactatgtgctcttcaacctgctggtggccatcctggtggagggcttccaggcggagggtgacgccaatcgctcctactcggacgaggaccagagctcatccaacatagaagagtttgataagctccaggaaggcctggacagcagcggagatcccaagctctgcccaatccccatgacccccaatgggcacctggaccccagtctcccactgggtgggcacctaggtcctgctggggctgcgggacctgccccccgactctcactgcagccggaccccatgctggtggccctgggctcccgaaagagcagtgtcatgtctctagggaggatgagctatgaccagcgctccctgtccagctcccggagctcctactacgggccatggggccgcagcgcggcctgggccagccgtcgctccagctggaacagcctcaagcacaagccgccgtcggcggagcatgagtccctgctctctgcggagcgcggcggcggcgcccgggtctgcgaggttgccgcggacgaggggccgccgcgggccgcacccctgcacaccccacacgcccaccacattcatcacgggccccatctggcgcaccgccaccgccaccaccgccggacgctgtccctcgacaacagggactcggtggacctggccgagctggtgcccgcggtgggcgcccacccccgggccgcctggagggcggcaggcccggcccccgggcatgaggactgcaatggcaggatgcccagcatcgccaaagacgtcttcaccaagatgggcgaccgcggggatcgcggggaggatgaggaggaaatcgactacaccctgtgcttccgcgtccgcaagatgatcgacgtctataagcccgactggtgcgaggtccgcgaagactggtctgtctacctcttctctcccgagaacaggttccgggtcctgtgtcagaccattattgcccacaaactcttcgactacgtcgtcctggccttcatctttctcaactgcatcaccatcgccctggagcggcctcagatcgaggccggcagcaccgaacgcatctttctcaccgtgtccaactacatcttcacggccatcttcgtgggcgagatgacattgaaggtagtctcgctgggcctgtacttcggcgagcaggcgtacctacgcagcagctggaacgtgctggatggctttcttgtcttcgtgtccatcatcgacatcgtggtgtccctggcctcagccgggggagccaagatcttgggggtcctccgagtcttgcggctcctgcgcaccctacgccccctgcgtgtcatcagccgggcgccgggcctgaagctggtggtggagacactcatctcctccctcaagcccatcggcaacatcgtgctcatctgctgtgccttcttcatcatctttggcatcctgggagtgcagctcttcaagggcaagttctaccactgtctgggcgtggacacccgcaacatcaccaaccgctcggactgcatggccgccaactaccgctgggtccatcacaaatacaacttcgacaacctgggccaggctctgatgtccctctttgtcctggcatccaaggatggttgggtgaacatcatgtacaatggactggatgctgttgctgtggaccagcagcctgtgaccaaccacaacccctggatgctgctgtacttcatctccttcctgctcatcgtcagcttctttgtgctcaacatgtttgtgggtgtcgtggtggagaacttccacaagtgccggcagcaccaggaggctgaagaggcacggcggcgtgaggagaagcggctgcggcgcctggagaagaagcgccggaaggcccagcggctgccctactatgccacctattgtcacacccggctgctcatccactccatgtgcaccagccactacctggacatcttcatcaccttcatcatctgcctcaacgtggtcaccatgtccctggagcactacaatcagcccacgtccctggagacagccctcaagtactgcaactatatgttcaccactgtctttgtgctggaggctgtgctgaagctggtggcatttggtctgaggcgcttcttcaaggaccgatggaaccagctggacctggccattgtgctactgtcagtcatgggcatcaccctggaggagatcgagatcaatgcggccctgcccatcaatcccaccatcatccgcatcatgagggttctgcgcattgcccgagtgctgaagctgttgaagatggccacaggaatgcgggccctgctggacacggtggtgcaagctttgccccaggtgggcaacctgggcctcctcttcatgctgctcttcttcatctatgctgctctcggggtggagctctttgggaagctggtctgcaacgacgagaacccgtgcgagggcatgagccggcatgccaccttcgagaacttcggcatggccttcctcacactcttccaggtctccacgggtgacaactggaacgggatcatgaaggacacgctgcgggactgcacccacgacgagcgcagctgcctgagcagcctgcagtttgtgtcgccgctgtacttcgtgagcttcgtgctcaccgcgcagttcgtgctcatcaacgtggtggtggctgtgctcatgaagcacctggacgacagcaacaaggaggcgcaggaggacgccgagatggatgccgagctcgagctggagatggcccatggcctgggccctggcccgaggctgcctaccggctccccgggcgcccctggccgagggccgggaggggcgggcggcgggggcgacaccgagggcggcttgtgccggcgctgctactcgcctgcccaggagaacctgtggctggacagcgtctctttaatcatcaaggactccttggagggggagctgaccatcatcgacaacctgtcgggctccatcttccaccactactcctcgcctgccggctgcaagaagtgtcaccacgacaagcaagaggtgcagctggctgagacggaggccttctccctgaactcagacaggtcctcgtccatcctgctgggtgacgacctgagtctcgaggaccccacagcctgcccacctggccgcaaagacagcaagggtgagctggacccacctgagcccatgcgtgtgggagacctgggcgaatgcttcttccccttgtcctctacggccgtctcgccggatccagagaacttcctgtgtgagatggaggagatcccattcaaccctgtccggtcctggctgaaacatgacagcagtcaagcacccccaagtcccttctccccggatgcctccagccctctcctgcccatgccagccgagttcttccaccctgcagtgtctgccagccagaaaggcccagaaaagggcactggcactggaaccctccccaagattgcgctgcagggctcctgggcatctctgcggtcaccaagggtcaactgtaccctcctccggcaggtaccgacacctcccaggccctagagcactggtctgtgggcaaggggcaggatctaagccaggcctggaagtccaagggactgggaggggaaggacccaaccaaaggccgagggcaccaccgtgcaagggggtttgggaacgctggggtgacgctgagactggagggggaggtggcactggggcggatggagtgggcggggctgggtcctggggacagcagagtgtggggaggaccccaaggcgggtctggaagaggcctgtgatccctagcttgaggggaggggaggagaggaggaggagtactggaggttttgcagggtggcggggtgctggcagtggggaggacaccctgggtgctctgggtgggtgtgagtgggggcttgattactaggaatggaggtgggagggcgggtctggtggatgagaagcctcgggctgcagggtcccccgtactggattggccagggccacagccctcctacccacgggcacacagaggtctgaagcactgagggctccgctgtgggggtggggaaatggggccgggccggctcccacagtgagtgcagttgattcactgggtgactgtctgacccgtcacaccaggctgtgtgctctggcgggcaggacacaaactccctgcctgccgggctcactgtttagtgctgagagtgagctgcctgggtgcaggagggatgataaccaaaataaa

SEQ ID NO: 4228 - DNA, 10004 bp, Homo sapiens
atggctgagagcgcctccccgccctcctcatctgcagcagccccagccgctgagccaggagtcaccacggagcagcccggaccccggagccccccatcctccccgccaggcctggaggagcctctggatggagctgatcctcatgtcccacacccagacctggcgcctattgccttcttctgcctgcgacagaccaccagcccccggaactggtgcatcaagatggtgtgcaacccgtggtttgaatgtgtcagcatgctggtgatcctgctgaactgcgtgacacttggcatgtaccagccgtgcgacgacatggactgcctgtccgaccgctgcaagatcctgcaggtctttgatgacttcatctttatcttctttgccatggagatggtgctcaagatggtggccctggggatttttggcaagaagtgctacctcggggacacatggaaccgcctggatttcttcatcgtcatggcagggatggtcgagtactccctggaccttcagaacatcaacctgtcagccatccgcaccgtgcgcgtcctgaggcccctcaaagccatcaaccgcgtgcccagtatgcggatcctggtgaacctgctcctggacacactgcccatgctggggaatgtcctgctgctctgcttctttgtcttcttcatctttggcatcataggtgtgcagctctgggcgggcctgctgcgtaaccgctgcttcctggaggagaacttcaccatacaaggggatgtggccttgcccccatactaccagccggaggaggatgatgagatgcccttcatctgctccctgtcgggcgacaatgggataatgggctgccatgagatccccccgctcaaggagcagggccgtgagtgctgcctgtccaaggacgacgtctacgactttggggcggggcgccaggacctcaatgccagcggcctctgtgtcaactggaaccgttactacaatgtgtgccgcacgggcagcgccaacccccacaagggtgccatcaactttgacaacatcggttatgcttggattgtcatcttccaggtgatcactctggaaggctgggtggagatcatgtactacgtgatggatgctcactccttctacaacttcatctacttcatcctgcttatcatagtgggctccttcttcatgatcaacctgtgcctcgttgtcatagcgacccagttctcggagaccaagcaacgggagcaccggctgatgctggagcagcggcagcgctacctgtcctccagcacggtggccagctacgccgagcctggcgactgctacgaggagatcttccagtatgtctgccacatcctgcgcaaggccaagcgccgcgccctgggcctctaccaggccctgcagagccggcgccaggccctgggcccggaggccccggcccccgccaaacctgggccccacgccaaggagccccggcactaccatgggaagactaagggtcagggagatgaagggagacatctcggaagccggcattgccagactttgcatgggcctgcctcccctggaaatgatcactcgggaagagagctgtgcccgcaacatagccccctggatgcgacgccccacaccctggtgcagcccatccccgccacgctggcttccgatcccgccagctgcccttgctgccagcatgaggacggccggcggccctcgggcctgggcagcaccgactcgggccaggagggctcgggctccgggagctccgctggtggcgaggacgaggcggatggggacggggcccggagcagcgaggacggagcctcctcagaactggggaaggaggaggaggaggaggagcaggcggatggggcggtctggctgtgcggggatgtgtggcgggagacgcgagccaagctgcgcggcatcgtggacagcaagtacttcaaccggggcatcatgatggccatcctggtcaacaccgtcagcatgggcatcgagcaccacgagcagccggaggagctgaccaacatcctggagatctgcaatgtggtcttcaccagcatgtttgccctggagatgatcctgaagctggctgcatttgggctcttcgactacctgcgtaacccctacaacatcttcgacagcatcattgtcatcatcagcatctgggagattgtggggcaggcggacggtgggctgtcggtgctgcggaccttccggctgctgcgcgtgctgaaactggtgcgcttcatgcctgccctgcggcgccagctcgtggtgctcatgaagaccatggacaacgtggccaccttctgcatgctgctcatgctcttcatcttcatcttcagcatccttgggatgcatatttttggctgcaagttcagcctccgcacggacactggagacacggtgcccgacaggaagaacttcgactccctgctgtgggccatcgtcactgtgttccagatcctcacccaggaggactggaacgtcgttctctacaatggcatggcctccacttctccctgggcctccctctactttgtcgccctcatgaccttcggcaactatgtgctcttcaacctgctggtggccatcctggtggagggcttccaggcggagggtgacgccaatcgctcctactcggacgaggaccagagctcatccaacatagaagagtttgataagctccaggaaggcctggacagcagcggagatcccaagctctgcccaatccccatgacccccaatgggcacctggaccccagtctcccactgggtgggcacctaggtcctgctggggctgcgggacctgccccccgactctcactgcagccggaccccatgctggtggccctgggctcccgaaagagcagtgtcatgtctctagggaggatgagctatgaccagcgctccctgtccagctcccggagctcctactacgggccatggggccgcagcgcggcctgggccagccgtcgctccagctggaacagcctcaagcacaagccgccgtcggcggagcatgagtccctgctctctgcggagcgcggcggcggcgcccgggtctgcgaggttgccgcggacgaggggccgccgcgggccgcacccctgcacaccccacacgcccaccacattcatcacgggccccatctggcgcaccgccaccgccaccaccgccggacgctgtccctcgacaacagggactcggtggacctggccgagctggtgcccgcggtgggcgcccacccccgggccgcctggagggcggcaggcccggcccccgggcatgaggactgcaatggcaggatgcccagcatcgccaaagacgtcttcaccaagatgggcgaccgcggggatcgcggggaggatgaggaggaaatcgactacaccctgtgcttccgcgtccgcaagatgatcgacgtctataagcccgactggtgcgaggtccgcgaagactggtctgtctacctcttctctcccgagaacaggttccgggtcctgtgtcagaccattattgcccacaaactcttcgactacgtcgtcctggccttcatctttctcaactgcatcaccatcgccctggagcggcctcagatcgaggccggcagcaccgaacgcatctttctcaccgtgtccaactacatcttcacggccatcttcgtgggcgagatgacattgaaggtagtctcgctgggcctgtacttcggcgagcaggcgtacctacgcagcagctggaacgtgctggatggctttcttgtcttcgtgtccatcatcgacatcgtggtgtccctggcctcagccgggggagccaagatcttgggggtcctccgagtcttgcggctcctgcgcaccctacgccccctgcgtgtcatcagccgggcgccgggcctgaagctggtggtggagacactcatctcctccctcaagcccatcggcaacatcgtgctcatctgctgtgccttcttcatcatctttggcatcctgggagtgcagctcttcaagggcaagttctaccactgtctgggcgtggacacccgcaacatcaccaaccgctcggactgcatggccgccaactaccgctgggtccatcacaaatacaacttcgacaacctgggccaggctctgatgtccctctttgtcctggcatccaaggatggttgggtgaacatcatgtacaatggactggatgctgttgctgtggaccagcagcctgtgaccaaccacaacccctggatgctgctgtacttcatctccttcctgctcatcgtcagcttctttgtgctcaacatgtttgtgggtgtcgtggtggagaacttccacaagtgccggcagcaccaggaggctgaagaggcacggcggcgtgaggagaagcggctgcggcgcctggagaagaagcgccggaaggcccagcggctgccctactatgccacctattgtcacacccggctgctcatccactccatgtgcaccagccactacctggacatcttcatcaccttcatcatctgcctcaacgtggtcaccatgtccctggagcactacaatcagcccacgtccctggagacagccctcaagtactgcaactatatgttcaccactgtctttgtgctggaggctgtgctgaagctggtggcatttggtctgaggcgcttcttcaaggaccgatggaaccagctggacctggccattgtgctactgtcagtcatgggcatcaccctggaggagatcgagatcaatgcggccctgcccatcaatcccaccatcatccgcatcatgagggttctgcgcattgcccgagtgctgaagctgttgaagatggccacaggaatgcgggccctgctggacacggtggtgcaagctttgccccaggtgggcaacctgggcctcctcttcatgctgctcttcttcatctatgctgctctcggggtggagctctttgggaagctggtctgcaacgacgagaacccgtgcgagggcatgagccggcatgccaccttcgagaacttcggcatggccttcctcacactcttccaggtctccacgggtgacaactggaacgggatcatgaaggacacgctgcgggactgcacccacgacgagcgcagctgcctgagcagcctgcagtttgtgtcgccgctgtacttcgtgagcttcgtgctcaccgcgcagttcgtgctcatcaacgtggtggtggctgtgctcatgaagcacctggacgacagcaacaaggaggcgcaggaggacgccgagatggatgccgagctcgagctggagatggcccatggcctgggccctggcccgaggctgcctaccggctccccgggcgcccctggccgagggccgggaggggcgggcggcgggggcgacaccgagggcggcttgtgccggcgctgctactcgcctgcccaggagaacctgtggctggacagcgtctctttaatcatcaaggactccttggagggggagctgaccatcatcgacaacctgtcgggctccatcttccaccactactcctcgcctgccggctgcaagaagtgtcaccacgacaagcaagaggtgcagctggctgagacggaggccttctccctgaactcagacaggtcctcgtccatcctgctgggtgacgacctgagtctcgaggaccccacagcctgcccacctggccgcaaagacagcaagggtgagctggacccacctgagcccatgcgtgtgggagacctgggcgaatgcttcttccccttgtcctctacggccgtctcgccggatccagagaacttcctgtgtgagatggaggagatcccattcaaccctgtccggtcctggctgaaacatgacagcagtcaagcacccccaagtcccttctccccggatgcctccagccctctcctgcccatgccagccgagttcttccaccctgcagtgtctgccagccagaaaggcccagaaaagggcactggcactggaaccctccccaagattgcgctgcagggctcctgggcatctctgcggtcaccaagggtcaactgtaccctcctccggcaggccaccgggagcgacacgtcgctggacgccagccccagcagctccgcgggcagcctgcagaccacgctcgaggacagcctgaccctgagcgacagcccccggcgtgccctggggccgcccgcgcctgctccaggaccccgggccggcctgtcccccgccgctcgccgccgcctgagcctgcgcggccggggcctcttcagcctgcgggggctgcgggcgcatcagcgcagccacagcagcgggggctccaccagcccgggctgcacccaccacgactccatggacccctcggacgaggagggccgcggtggcgcgggcggcgggggcgcgggcagcgagcactcggagaccctcagcagcctctcgctcacctccctcttctgcccgccgcccccgccgccagcccccggcctcacgcccgccaggaagttcagcagcaccagcagcctggccgcccccggccgcccccacgccgccgccctggcccacggcctggcccggagcccctcgtgggccgcggaccgcagcaaggacccccccggccgggcaccgctgcccatgggcctgggccccttggcgcccccgccgcaaccgctccccggagagctggagccgggagacgccgccagcaagaggaagagatgagggtcgcaggggcccccggccgcccaccgcccgccccgtctcaccttctttacctcaggagccaggagcagacagcaatacttcgtccacacctgggatcgcgcagggcccgcagggcacaggcgcccgacagccgggctgagcggagtctgggttagccaggcctgcgtggcccatggtggcccttccagtgcatatacatacatatatatatatatatgcatatatatatatatatatatatatatgtgtatacacacacacatagacagacatatatatatatatttattttttttactgagagcttatgacttccagaaagtgctaaaggtgggaggtgggccagggcctggacggggcttttgtctgatgctctgggattctggccagacccaccccagggcacatgtcctgcgggggcgtcccagctgtgttttttgatgtctcctccctggttaagagtagcttggagaggaccctcaggcctctgagggcaccaggccctggagaagaggtgcaattcagggtgtgtgtgtgttttttttcctttaaagaagaaacgctgctaagatcccacgtggctcccacgtgtcggggtgtctgtcctgtcatcctgactgtctcgttattgtgaagtctttcgtagacaccccagagcacacacatccccttagtccaccggttagatgtctctctttagaaaaatcaggggtgagtagctgtgtttccttaggcctggggtaggggatggagagcagctccaaggctgagctggggctctggccccaggtgaggtccccagctcctgagcacttctgagggggtgggttccacccccaggagggcgggggtgggtggagcaggagtggaggcagcctgcagaggaagggtgcgggagactgagccggcagtggcttgcttggaggggctagggtacccgcctggtctcggctggctccagctgccctgcaggtgcccctgggctcaggtagttagttgttcagccactaatgccttttatcccccatatgggcgctgagctgtggctgttcctggacactgtgctgtccccgtcctgagcaactatgcccccgccccagtaggttcaaggcaaagcagctctgaccgaattctaggcaggggtgggggcacctgcctgggccctgggtccagccgcatccccatgcccagcctttcgcgtcacctggaggccacatcttcccaccccacctgccagcccctgtctctcctccccgctgcccctaactgcagctcagctttcactatagcagtgcttcccaaacgggttctagacttgggtgtttgatttgaagagttacgcatttatttcactatttattgggaaaaaaatgcattgaacccgtgatttcacagacattttgcttaggtcaaggctactttttaaaaagggagtgactttcatgaagtcagtttgaagaaggaggttgggagcatgttggtggcagtgatctggagaggctgcaggggccacgagtttgcagatgctgtacttcagcaataaccttgcctttgctaagaccccctccgagggcttcaggggggcctgccaagggggggccttgttcttgttcccaaactctgacttggaagaactcagcttgtggccgggctggtgagggtgtggggtgcgcccttcccttttgggctgagggagagggggccgggaggggttgtcaagcccacccgggaaactgagccctggagaggggaagcagccagcccaggatgcttcagggccctggcagcaaagaagctggggtggtgtggagggccctactccacaccctagagctgtgatgctgagcaaggtgcctgtggcggaaggaactgcccagtcctccctgggggcaggtagacctgtggggatggctcggtccaagcccaacactgcccgctccagagagcctcagccctgcctccctttccacagaggtggttttatgtggaacgaggtaccttgtctggggaagaagtggagctgggcaggcttgactgctcctggctgaccctgagctctcgcagttggagggaagcagacagacttgactttttgcaagtccgcgtgttgctggagggacacgtgtattggagcccagaagaggggctgtgtggcctgggaataccatgtggaaggttgggcttcaagttaacaggatcagacaccagtcaagcagcctcaggtcatcttgcgactccactgagcagcctttcctgttgtcacatgggttcagagcagctgagcagggaacacgtcctaggcaggtctgacgtgaaacctccccttaccctgaaccgtgtgactctgcaagcagacacctcgaggcaggtgttctaggcaaagggatgggcatgagcgaaggctccagggtccacagagcagggagtgtggagaaggtggaagagctgagctcagaggcagagaagctccttgcagggagcactgggagatggcctggcccgtcccaggctcctggaggccccacctgccgatcccaggcacttgaccttgttcctgtgggtgacagagatgagaaccagggaagctgtgatccactggccaggacaagtcaacatgggtgagggttgggcaaagggcccttccttcctccccaaccctgtggtctggggccatggcctcaggcttgtgtctatcacaaaagcacaaacttgccctaacccacatgggcctggctgtggggaaagtggggacccaggtccctgagctgtctgctgggctccgtagagcggtggtgggcaggcaccttggcatctgtgcagagacggcccagtctggccaaatcctcttcctctcccctgctctaccttctccggcaccaggcagccccttaaaggaggacaaagtgtgtaaagcccgtctgctgtcttcccccaaatcctcagctcagagccttccgcttccagggccaaccccagccccgtttgctgcgttgtgtaagggcttggggtcttagaagctgctctttagcccagatacacatactcttttttgtctttgtgcaataatcagtgttcctggcagagcctgggccaagctgcagcctactgaggaggcagaggccacctcctccagaaagccctcggcctgggccgccgccgtgactctagcactctcagtcgctgtacagtttctatggtgtgaatgaacttccctcctagttgctgatggcgctggtacctgctggcccatggcccgggtgtagagaaaccaagcggcagccaccaccagtgttgttttgaataaaagcccagaagcctatttaagaatt

SEQ ID NO: 4229 - DNA, 9892 bp, Homo sapiens
atggctgagagcgcctccccgccctcctcatctgcagcagccccagccgctgagccaggagtcaccacggagcagcccggaccccggagccccccatcctccccgccaggcctggaggagcctctggatggagctgatcctcatgtcccacacccagacctggcgcctattgccttcttctgcctgcgacagaccaccagcccccggaactggtgcatcaagatggtgtgcaacccgtggtttgaatgtgtcagcatgctggtgatcctgctgaactgcgtgacacttggcatgtaccagccgtgcgacgacatggactgcctgtccgaccgctgcaagatcctgcaggtctttgatgacttcatctttatcttctttgccatggagatggtgctcaagatggtggccctggggatttttggcaagaagtgctacctcggggacacatggaaccgcctggatttcttcatcgtcatggcagggatggtcgagtactccctggaccttcagaacatcaacctgtcagccatccgcaccgtgcgcgtcctgaggcccctcaaagccatcaaccgcgtgcccagtatgcggatcctggtgaacctgctcctggacacactgcccatgctggggaatgtcctgctgctctgcttctttgtcttcttcatctttggcatcataggtgtgcagctctgggcgggcctgctgcgtaaccgctgcttcctggaggagaacttcaccatacaaggggatgtggccttgcccccatactaccagccggaggaggatgatgagatgcccttcatctgctccctgtcgggcgacaatgggataatgggctgccatgagatccccccgctcaaggagcagggccgtgagtgctgcctgtccaaggacgacgtctacgactttggggcggggcgccaggacctcaatgccagcggcctctgtgtcaactggaaccgttactacaatgtgtgccgcacgggcagcgccaacccccacaagggtgccatcaactttgacaacatcggttatgcttggattgtcatcttccaggtgatcactctggaaggctgggtggagatcatgtactacgtgatggatgctcactccttctacaacttcatctacttcatcctgcttatcatagtgggctccttcttcatgatcaacctgtgcctcgttgtcatagcgacccagttctcggagaccaagcaacgggagcaccggctgatgctggagcagcggcagcgctacctgtcctccagcacggtggccagctacgccgagcctggcgactgctacgaggagatcttccagtatgtctgccacatcctgcgcaaggccaagcgccgcgccctgggcctctaccaggccctgcagagccggcgccaggccctgggcccggaggccccggcccccgccaaacctgggccccacgccaaggagccccggcactaccagctgtgcccgcaacatagccccctggatgcgacgccccacaccctggtgcagcccatccccgccacgctggcttccgatcccgccagctgcccttgctgccagcatgaggacggccggcggccctcgggcctgggcagcaccgactcgggccaggagggctcgggctccgggagctccgctggtggcgaggacgaggcggatggggacggggcccggagcagcgaggacggagcctcctcagaactggggaaggaggaggaggaggaggagcaggcggatggggcggtctggctgtgcggggatgtgtggcgggagacgcgagccaagctgcgcggcatcgtggacagcaagtacttcaaccggggcatcatgatggccatcctggtcaacaccgtcagcatgggcatcgagcaccacgagcagccggaggagctgaccaacatcctggagatctgcaatgtggtcttcaccagcatgtttgccctggagatgatcctgaagctggctgcatttgggctcttcgactacctgcgtaacccctacaacatcttcgacagcatcattgtcatcatcagcatctgggagattgtggggcaggcggacggtgggctgtcggtgctgcggaccttccggctgctgcgcgtgctgaaactggtgcgcttcatgcctgccctgcggcgccagctcgtggtgctcatgaagaccatggacaacgtggccaccttctgcatgctgctcatgctcttcatcttcatcttcagcatccttgggatgcatatttttggctgcaagttcagcctccgcacggacactggagacacggtgcccgacaggaagaacttcgactccctgctgtgggccatcgtcactgtgttccagatcctcacccaggaggactggaacgtcgttctctacaatggcatggcctccacttctccctgggcctccctctactttgtcgccctcatgaccttcggcaactatgtgctcttcaacctgctggtggccatcctggtggagggcttccaggcggagggtgacgccaatcgctcctactcggacgaggaccagagctcatccaacatagaagagtttgataagctccaggaaggcctggacagcagcggagatcccaagctctgcccaatccccatgacccccaatgggcacctggaccccagtctcccactgggtgggcacctaggtcctgctggggctgcgggacctgccccccgactctcactgcagccggaccccatgctggtggccctgggctcccgaaagagcagtgtcatgtctctagggaggatgagctatgaccagcgctccctgtccagctcccggagctcctactacgggccatggggccgcagcgcggcctgggccagccgtcgctccagctggaacagcctcaagcacaagccgccgtcggcggagcatgagtccctgctctctgcggagcgcggcggcggcgcccgggtctgcgaggttgccgcggacgaggggccgccgcgggccgcacccctgcacaccccacacgcccaccacattcatcacgggccccatctggcgcaccgccaccgccaccaccgccggacgctgtccctcgacaacagggactcggtggacctggccgagctggtgcccgcggtgggcgcccacccccgggccgcctggagggcggcaggcccggcccccgggcatgaggactgcaatggcaggatgcccagcatcgccaaagacgtcttcaccaagatgggcgaccgcggggatcgcggggaggatgaggaggaaatcgactacaccctgtgcttccgcgtccgcaagatgatcgacgtctataagcccgactggtgcgaggtccgcgaagactggtctgtctacctcttctctcccgagaacaggttccgggtcctgtgtcagaccattattgcccacaaactcttcgactacgtcgtcctggccttcatctttctcaactgcatcaccatcgccctggagcggcctcagatcgaggccggcagcaccgaacgcatctttctcaccgtgtccaactacatcttcacggccatcttcgtgggcgagatgacattgaaggtagtctcgctgggcctgtacttcggcgagcaggcgtacctacgcagcagctggaacgtgctggatggctttcttgtcttcgtgtccatcatcgacatcgtggtgtccctggcctcagccgggggagccaagatcttgggggtcctccgagtcttgcggctcctgcgcaccctacgccccctgcgtgtcatcagccgggcgccgggcctgaagctggtggtggagacactcatctcctccctcaagcccatcggcaacatcgtgctcatctgctgtgccttcttcatcatctttggcatcctgggagtgcagctcttcaagggcaagttctaccactgtctgggcgtggacacccgcaacatcaccaaccgctcggactgcatggccgccaactaccgctgggtccatcacaaatacaacttcgacaacctgggccaggctctgatgtccctctttgtcctggcatccaaggatggttgggtgaacatcatgtacaatggactggatgctgttgctgtggaccagcagcctgtgaccaaccacaacccctggatgctgctgtacttcatctccttcctgctcatcgtcagcttctttgtgctcaacatgtttgtgggtgtcgtggtggagaacttccacaagtgccggcagcaccaggaggctgaagaggcacggcggcgtgaggagaagcggctgcggcgcctggagaagaagcgccggaaggcccagcggctgccctactatgccacctattgtcacacccggctgctcatccactccatgtgcaccagccactacctggacatcttcatcaccttcatcatctgcctcaacgtggtcaccatgtccctggagcactacaatcagcccacgtccctggagacagccctcaagtactgcaactatatgttcaccactgtctttgtgctggaggctgtgctgaagctggtggcatttggtctgaggcgcttcttcaaggaccgatggaaccagctggacctggccattgtgctactgtcagtcatgggcatcaccctggaggagatcgagatcaatgcggccctgcccatcaatcccaccatcatccgcatcatgagggttctgcgcattgcccgagtgctgaagctgttgaagatggccacaggaatgcgggccctgctggacacggtggtgcaagctttgccccaggtgggcaacctgggcctcctcttcatgctgctcttcttcatctatgctgctctcggggtggagctctttgggaagctggtctgcaacgacgagaacccgtgcgagggcatgagccggcatgccaccttcgagaacttcggcatggccttcctcacactcttccaggtctccacgggtgacaactggaacgggatcatgaaggacacgctgcgggactgcacccacgacgagcgcagctgcctgagcagcctgcagtttgtgtcgccgctgtacttcgtgagcttcgtgctcaccgcgcagttcgtgctcatcaacgtggtggtggctgtgctcatgaagcacctggacgacagcaacaaggaggcgcaggaggacgccgagatggatgccgagctcgagctggagatggcccatggcctgggccctggcccgaggctgcctaccggctccccgggcgcccctggccgagggccgggaggggcgggcggcgggggcgacaccgagggcggcttgtgccggcgctgctactcgcctgcccaggagaacctgtggctggacagcgtctctttaatcatcaaggactccttggagggggagctgaccatcatcgacaacctgtcgggctccatcttccaccactactcctcgcctgccggctgcaagaagtgtcaccacgacaagcaagaggtgcagctggctgagacggaggccttctccctgaactcagacaggtcctcgtccatcctgctgggtgacgacctgagtctcgaggaccccacagcctgcccacctggccgcaaagacagcaagggtgagctggacccacctgagcccatgcgtgtgggagacctgggcgaatgcttcttccccttgtcctctacggccgtctcgccggatccagagaacttcctgtgtgagatggaggagatcccattcaaccctgtccggtcctggctgaaacatgacagcagtcaagcacccccaagtcccttctccccggatgcctccagccctctcctgcccatgccagccgagttcttccaccctgcagtgtctgccagccagaaaggcccagaaaagggcactggcactggaaccctccccaagattgcgctgcagggctcctgggcatctctgcggtcaccaagggtcaactgtaccctcctccggcaggccaccgggagcgacacgtcgctggacgccagccccagcagctccgcgggcagcctgcagaccacgctcgaggacagcctgaccctgagcgacagcccccggcgtgccctggggccgcccgcgcctgctccaggaccccgggccggcctgtcccccgccgctcgccgccgcctgagcctgcgcggccggggcctcttcagcctgcgggggctgcgggcgcatcagcgcagccacagcagcgggggctccaccagcccgggctgcacccaccacgactccatggacccctcggacgaggagggccgcggtggcgcgggcggcgggggcgcgggcagcgagcactcggagaccctcagcagcctctcgctcacctccctcttctgcccgccgcccccgccgccagcccccggcctcacgcccgccaggaagttcagcagcaccagcagcctggccgcccccggccgcccccacgccgccgccctggcccacggcctggcccggagcccctcgtgggccgcggaccgcagcaaggacccccccggccgggcaccgctgcccatgggcctgggccccttggcgcccccgccgcaaccgctccccggagagctggagccgggagacgccgccagcaagaggaagagatgagggtcgcaggggcccccggccgcccaccgcccgccccgtctcaccttctttacctcaggagccaggagcagacagcaatacttcgtccacacctgggatcgcgcagggcccgcagggcacaggcgcccgacagccgggctgagcggagtctgggttagccaggcctgcgtggcccatggtggcccttccagtgcatatacatacatatatatatatatatgcatatatatatatatatatatatatatgtgtatacacacacacatagacagacatatatatatatatttattttttttactgagagcttatgacttccagaaagtgctaaaggtgggaggtgggccagggcctggacggggcttttgtctgatgctctgggattctggccagacccaccccagggcacatgtcctgcgggggcgtcccagctgtgttttttgatgtctcctccctggttaagagtagcttggagaggaccctcaggcctctgagggcaccaggccctggagaagaggtgcaattcagggtgtgtgtgtgttttttttcctttaaagaagaaacgctgctaagatcccacgtggctcccacgtgtcggggtgtctgtcctgtcatcctgactgtctcgttattgtgaagtctttcgtagacaccccagagcacacacatccccttagtccaccggttagatgtctctctttagaaaaatcaggggtgagtagctgtgtttccttaggcctggggtaggggatggagagcagctccaaggctgagctggggctctggccccaggtgaggtccccagctcctgagcacttctgagggggtgggttccacccccaggagggcgggggtgggtggagcaggagtggaggcagcctgcagaggaagggtgcgggagactgagccggcagtggcttgcttggaggggctagggtacccgcctggtctcggctggctccagctgccctgcaggtgcccctgggctcaggtagttagttgttcagccactaatgccttttatcccccatatgggcgctgagctgtggctgttcctggacactgtgctgtccccgtcctgagcaactatgcccccgccccagtaggttcaaggcaaagcagctctgaccgaattctaggcaggggtgggggcacctgcctgggccctgggtccagccgcatccccatgcccagcctttcgcgtcacctggaggccacatcttcccaccccacctgccagcccctgtctctcctccccgctgcccctaactgcagctcagctttcactatagcagtgcttcccaaacgggttctagacttgggtgtttgatttgaagagttacgcatttatttcactatttattgggaaaaaaatgcattgaacccgtgatttcacagacattttgcttaggtcaaggctactttttaaaaagggagtgactttcatgaagtcagtttgaagaaggaggttgggagcatgttggtggcagtgatctggagaggctgcaggggccacgagtttgcagatgctgtacttcagcaataaccttgcctttgctaagaccccctccgagggcttcaggggggcctgccaagggggggccttgttcttgttcccaaactctgacttggaagaactcagcttgtggccgggctggtgagggtgtggggtgcgcccttcccttttgggctgagggagagggggccgggaggggttgtcaagcccacccgggaaactgagccctggagaggggaagcagccagcccaggatgcttcagggccctggcagcaaagaagctggggtggtgtggagggccctactccacaccctagagctgtgatgctgagcaaggtgcctgtggcggaaggaactgcccagtcctccctgggggcaggtagacctgtggggatggctcggtccaagcccaacactgcccgctccagagagcctcagccctgcctccctttccacagaggtggttttatgtggaacgaggtaccttgtctggggaagaagtggagctgggcaggcttgactgctcctggctgaccctgagctctcgcagttggagggaagcagacagacttgactttttgcaagtccgcgtgttgctggagggacacgtgtattggagcccagaagaggggctgtgtggcctgggaataccatgtggaaggttgggcttcaagttaacaggatcagacaccagtcaagcagcctcaggtcatcttgcgactccactgagcagcctttcctgttgtcacatgggttcagagcagctgagcagggaacacgtcctaggcaggtctgacgtgaaacctccccttaccctgaaccgtgtgactctgcaagcagacacctcgaggcaggtgttctaggcaaagggatgggcatgagcgaaggctccagggtccacagagcagggagtgtggagaaggtggaagagctgagctcagaggcagagaagctccttgcagggagcactgggagatggcctggcccgtcccaggctcctggaggccccacctgccgatcccaggcacttgaccttgttcctgtgggtgacagagatgagaaccagggaagctgtgatccactggccaggacaagtcaacatgggtgagggttgggcaaagggcccttccttcctccccaaccctgtggtctggggccatggcctcaggcttgtgtctatcacaaaagcacaaacttgccctaacccacatgggcctggctgtggggaaagtggggacccaggtccctgagctgtctgctgggctccgtagagcggtggtgggcaggcaccttggcatctgtgcagagacggcccagtctggccaaatcctcttcctctcccctgctctaccttctccggcaccaggcagccccttaaaggaggacaaagtgtgtaaagcccgtctgctgtcttcccccaaatcctcagctcagagccttccgcttccagggccaaccccagccccgtttgctgcgttgtgtaagggcttggggtcttagaagctgctctttagcccagatacacatactcttttttgtctttgtgcaataatcagtgttcctggcagagcctgggccaagctgcagcctactgaggaggcagaggccacctcctccagaaagccctcggcctgggccgccgccgtgactctagcactctcagtcgctgtacagtttctatggtgtgaatgaacttccctcctagttgctgatggcgctggtacctgctggcccatggcccgggtgtagagaaaccaagcggcagccaccaccagtgttgttttgaataaaagcccagaagcctattt

SEQ ID NO: 4230 - DNA, 5952 bp, Homo sapiens
atggctgagagcgcctccccgccctcctcatctgcagcagccccagccgctgagccaggagtcaccacggagcagcccggaccccggagccccccatcctccccgccaggcctggaggagcctctggatggagctgatcctcatgtcccacacccagacctggcgcctattgccttcttctgcctgcgacagaccaccagcccccggaactggtgcatcaagatggtgtgcaacccgtggtttgaatgtgtcagcatgctggtgatcctgctgaactgcgtgacacttggcatgtaccagccgtgcgacgacatggactgcctgtccgaccgctgcaagatcctgcaggtctttgatgacttcatctttatcttctttgccatggagatggtgctcaagatggtggccctggggatttttggcaagaagtgctacctcggggacacatggaaccgcctggatttcttcatcgtcatggcagggatggtcgagtactccctggaccttcagaacatcaacctgtcagccatccgcaccgtgcgcgtcctgaggcccctcaaagccatcaaccgcgtgcccagtatgcggatcctggtgaacctgctcctggacacactgcccatgctggggaatgtcctgctgctctgcttctttgtcttcttcatctttggcatcataggtgtgcagctctgggcgggcctgctgcgtaaccgctgcttcctggaggagaacttcaccatacaaggggatgtggccttgcccccatactaccagccggaggaggatgatgagatgcccttcatctgctccctgtcgggcgacaatgggataatgggctgccatgagatccccccgctcaaggagcagggccgtgagtgctgcctgtccaaggacgacgtctacgactttggggcggggcgccaggacctcaatgccagcggcctctgtgtcaactggaaccgttactacaatgtgtgccgcacgggcagcgccaacccccacaagggtgccatcaactttgacaacatcggttatgcttggattgtcatcttccaggtgatcactctggaaggctgggtggagatcatgtactacgtgatggatgctcactccttctacaacttcatctacttcatcctgcttatcatagtgggctccttcttcatgatcaacctgtgcctcgttgtcatagcgacccagttctcggagaccaagcaacgggagcaccggctgatgctggagcagcggcagcgctacctgtcctccagcacggtggccagctacgccgagcctggcgactgctacgaggagatcttccagtatgtctgccacatcctgcgcaaggccaagcgccgcgccctgggcctctaccaggccctgcagagccggcgccaggccctgggcccggaggccccggcccccgccaaacctgggccccacgccaaggagccccggcactaccagctgtgcccgcaacatagccccctggatgcgacgccccacaccctggtgcagcccatccccgccacgctggcttccgatcccgccagctgcccttgctgccagcatgaggacggccggcggccctcgggcctgggcagcaccgactcgggccaggagggctcgggctccgggagctccgctggtggcgaggacgaggcggatggggacggggcccggagcagcgaggacggagcctcctcagaactggggaaggaggaggaggaggaggagcaggcggatggggcggtctggctgtgcggggatgtgtggcgggagacgcgagccaagctgcgcggcatcgtggacagcaagtacttcaaccggggcatcatgatggccatcctggtcaacaccgtcagcatgggcatcgagcaccacgagcagccggaggagctgaccaacatcctggagatctgcaatgtggtcttcaccagcatgtttgccctggagatgatcctgaagctggctgcatttgggctcttcgactacctgcgtaacccctacaacatcttcgacagcatcattgtcatcatcagcatctgggagattgtggggcaggcggacggtgggctgtcggtgctgcggaccttccggctgctgcgcgtgctgaaactggtgcgcttcatgcctgccctgcggcgccagctcgtggtgctcatgaagaccatggacaacgtggccaccttctgcatgctgctcatgctcttcatcttcatcttcagcatccttgggatgcatatttttggctgcaagttcagcctccgcacggacactggagacacggtgcccgacaggaagaacttcgactccctgctgtgggccatcgtcactgtgttccagatcctcacccaggaggactggaacgtcgttctctacaatggcatggcctccacttctccctgggcctccctctactttgtcgccctcatgaccttcggcaactatgtgctcttcaacctgctggtggccatcctggtggagggcttccaggcggagggtgacgccaatcgctcctactcggacgaggaccagagctcatccaacatagaagagtttgataagctccaggaaggcctggacagcagcggagatcccaagctctgcccaatccccatgacccccaatgggcacctggaccccagtctcccactgggtgggcacctaggtcctgctggggctgcgggacctgccccccgactctcactgcagccggaccccatgctggtggccctgggctcccgaaagagcagtgtcatgtctctagggaggatgagctatgaccagcgctccctgtccagctcccggagctcctactacgggccatggggccgcagcgcggcctgggccagccgtcgctccagctggaacagcctcaagcacaagccgccgtcggcggagcatgagtccctgctctctgcggagcgcggcggcggcgcccgggtctgcgaggttgccgcggacgaggggccgccgcgggccgcacccctgcacaccccacacgcccaccacattcatcacgggccccatctggcgcaccgccaccgccaccaccgccggacgctgtccctcgacaacagggactcggtggacctggccgagctggtgcccgcggtgggcgcccacccccgggccgcctggagggcggcaggcccggcccccgggcatgaggactgcaatggcaggatgcccagcatcgccaaagacgtcttcaccaagatgggcgaccgcggggatcgcggggaggatgaggaggaaatcgactacaccctgtgcttccgcgtccgcaagatgatcgacgtctataagcccgactggtgcgaggtccgcgaagactggtctgtctacctcttctctcccgagaacaggttccgggtcctgtgtcagaccattattgcccacaaactcttcgactacgtcgtcctggccttcatctttctcaactgcatcaccatcgccctggagcggcctcagatcgaggccggcagcaccgaacgcatctttctcaccgtgtccaactacatcttcacggccatcttcgtgggcgagatgacattgaaggtagtctcgctgggcctgtacttcggcgagcaggcgtacctacgcagcagctggaacgtgctggatggctttcttgtcttcgtgtccatcatcgacatcgtggtgtccctggcctcagccgggggagccaagatcttgggggtcctccgagtcttgcggctcctgcgcaccctacgccccctgcgtgtcatcagccgggcgccgggcctgaagctggtggtggagacactcatctcctccctcaagcccatcggcaacatcgtgctcatctgctgtgccttcttcatcatctttggcatcctgggagtgcagctcttcaagggcaagttctaccactgtctgggcgtggacacccgcaacatcaccaaccgctcggactgcatggccgccaactaccgctgggtccatcacaaatacaacttcgacaacctgggccaggctctgatgtccctctttgtcctggcatccaaggatggttgggtgaacatcatgtacaatggactggatgctgttgctgtggaccagcagcctgtgaccaaccacaacccctggatgctgctgtacttcatctccttcctgctcatcgtcagcttctttgtgctcaacatgtttgtgggtgtcgtggtggagaacttccacaagtgccggcagcaccaggaggctgaagaggcacggcggcgtgaggagaagcggctgcggcgcctggagaagaagcgccggaaggcccagcggctgccctactatgccacctattgtcacacccggctgctcatccactccatgtgcaccagccactacctggacatcttcatcaccttcatcatctgcctcaacgtggtcaccatgtccctggagcactacaatcagcccacgtccctggagacagccctcaagtactgcaactatatgttcaccactgtctttgtgctggaggctgtgctgaagctggtggcatttggtctgaggcgcttcttcaaggaccgatggaaccagctggacctggccattgtgctactgtcagtcatgggcatcaccctggaggagatcgagatcaatgcggccctgcccatcaatcccaccatcatccgcatcatgagggttctgcgcattgcccgagtgctgaagctgttgaagatggccacaggaatgcgggccctgctggacacggtggtgcaagctttgccccaggtgggcaacctgggcctcctcttcatgctgctcttcttcatctatgctgctctcggggtggagctctttgggaagctggtctgcaacgacgagaacccgtgcgagggcatgagccggcatgccaccttcgagaacttcggcatggccttcctcacactcttccaggtctccacgggtgacaactggaacgggatcatgaaggacacgctgcgggactgcacccacgacgagcgcagctgcctgagcagcctgcagtttgtgtcgccgctgtacttcgtgagcttcgtgctcaccgcgcagttcgtgctcatcaacgtggtggtggctgtgctcatgaagcacctggacgacagcaacaaggaggcgcaggaggacgccgagatggatgccgagctcgagctggagatggcccatggcctgggccctggcccgaggctgcctaccggctccccgggcgcccctggccgagggccgggaggggcgggcggcgggggcgacaccgagggcggcttgtgccggcgctgctactcgcctgcccaggagaacctgtggctggacagcgtctctttaatcatcaaggactccttggagggggagctgaccatcatcgacaacctgtcgggctccatcttccaccactactcctcgcctgccggctgcaagaagtgtcaccacgacaagcaagaggtgcagctggctgagacggaggccttctccctgaactcagacaggtcctcgtccatcctgctgggtgacgacctgagtctcgaggaccccacagcctgcccacctggccgcaaagacagcaagggtgagctggacccacctgagcccatgcgtgtgggagacctgggcgaatgcttcttccccttgtcctctacggccgtctcgccggatccagagaacttcctgtgtgagatggaggagatcccattcaaccctgtccggtcctggctgaaacatgacagcagtcaagcacccccaagtcccttctccccggatgcctccagccctctcctgcccatgccagccgagttcttccaccctgcagtgtctgccagccagaaaggcccagaaaagggcactggcactggaaccctccccaagattgcgctgcagggctcctgggcatctctgcggtcaccaagggtcaactgtaccctcctccggcaggtaccgacacctcccaggccctagagcact

SEQ ID NO: 4231 - DNA, 3053 bp, Homo sapiens
ctctgctctgagctctgttggtcccagccaggagagcccgagtcatgaggtgggcacccagtgggcagggtgggcagcaggggccctcttggaggcagcagtgagttgggaagaggaggccgggccccacagcgggcatgatggacaagttccggatgatcttccagttcctgcagtccaaccaggagtccttcatgaatggcatctgtggcatcatggccctggccagtgcccagatgtactcggccttcgacttcaactgcccctgcctgccgggctacaatgcagcctacagcgcgggcatcctgctggcgccacccctggtgctctttctgcttggcctggtcatgaacaacaacgtgtccatgctggccgaagagtggaagcggccgctgggccgccgggccaaggaccccgctgtgttgcgctacatgttctgctccatggcccagcgcgccctcatcgcgcctgtcgtctgggtggccgtcacgctactcgacggcaaatgcttcctctgtgccttctgcactgccgtgcccgtgagcgcactgggcaacggcagcctggcacccggccttcctgcccccgagctcgcccgcctgctggcccgggtgccctgccctgagatctacgatggcgactggctgttggcccgagaggtggccgtgcgttacctccgctgcatctcccaggcgctgggctggtccttcgtgctgctgaccactctgctggcattcgtggtgcgctctgtgcggccctgcttcacgcaggccgccttcctcaagagcaagtactggtcccactatatcgacatcgagcgcaagctcttcgacgagacgtgcacggagcacgccaaagcctttgccaaggtctgcatccagcagttcttcgaggccatgaaccatgacctggagctgggtcacacccacgggacactggccacggcccctgcttccgcagctgcccccacgacccccgatggtgcggaggaggaaagggagaagctgcgtggcatcacggatcaaggcaccatgaacaggctgctcacgagctggcacaaatgcaaaccgcctctgcggctgggccaggaggagccaccgctgatgggcaacggctgggctgggggtgggccccggcctccgcgtaaggaggtggccacctacttcagcaaagtgtgaggtgtggccagctgaagaggcaggaacggggatctgagcccacagcccctccaacccccaaaccaggtggaaaaaggaagggtttcagtgctgggcagtactcccctaggcagatccacactccctagcactcgcctgcccattggaggcaggaaatttggagctggaaggggatctgatgccttcaggtgtgacactgccctggatggccctagggcagtgggcccatgagcagtattagtctaaaggggtcggaactgtcatggcaggtacagggaccaatggctcccctctgcccagcccttcccaggctgatgttcactgtctcctcccaggttcaacagacatccctgccccagggtccaccctcgtctgtggctgttcagtacctctcttcctttatgctccgggctcggggagtgggaatcatcaggcgtctcatgaagtgggagccctctgatttgggcaagcgtgtcgtaggtgagactgggtgtgccggggcaggtccataaggacatgacacacagcctacctggtgtgacacacctggggtgacaggcgatgagacaagatgtcagaagctaggttcacatggaagaggtcagagtgtgtggtcaccatgggggtcatgtgacaattgtccaggtggactgcatgtttatttagcacaaaccaagcacaaaagtcctcctgtagaggggtctttgaaaaaccaccttaatacccccgtcacatccaggtctccaggggaaatcagaccatccccaaggcttgagaagttagacacagaagctgaagtctctccatttttctcaaagaccccacctcttggggatggagttctaagaggctaagaggagctccaaggctctagcccaggtgggatgagggtggaggagagcagtgtaaagagaaagcagctcagattccagagtgagacagaactgggtcaaatggtgtctctaccactcacaaaccctgtccctgggccagctgcatcactgcctgtgccttcgtttcttcatctatacaatgaggatgaggcccccccggcccgccatcatggggttgctgtgtgtaaaagcacatggcacatagtaggcacccagcacagggtggctaatgtatttgttgatttctgaacctaaggacttccttcctcctcccctgggcagggatgagacagcaacacaaacactcgagcttccatcttgttgaggaggaaacagaggtacagataggtttctcagcaccgccctcagctctgagacataagtcccaagcatctaaggattcattttgatcttggcatgattccatccttttttatccatccttccctctattcccacttctggggtccagtttccctcctcttaattatttgggaggagttgctcagatctttgtgggccaaggtgggctgggagggctcttccaggaggtaggagttggtatgggccctgaagtcagggaggattaggatgagcaaaaaacaaggtgtatgttggtgggtggcagcacttccagtgggaagagaaggcccggaggtatcaggaggtacaaatgtgatgaagagcaaagctttgggtcaggcacacctgagttcaaataccagcactgcaggacttgtggccagtcacccagccactctaagcctcagtgtgtctgtctataaaatggatattagaagacctgcttggccaggcggagtggctcatgcctgtaatcccagcacttgggaggccaaggagggaggatcacttgagcctgggagttggagaccagcctgggcaacatagcaagactctgtctctgtaaagtaataataataataagaagaagaagaagaataaagagaagatttataatttt

SEQ ID NO: 4232 - DNA, 1859 bp, Homo sapiens
gttagattagtctgaagccgccaccagccccaggcccccgtgcagaagaaaagcgggagggaacggcggaggccgccgctgccctgcaccgccctcctggaggccacttggagagtccggccccgaggaggccatggccacaagtgcccacagctggccccaggttgccagcgtcgctacagcccagaccaaggcagaataatctccggatgagctggtggcaccgctgagcctttggtctcaccagggcttcctgttgctggcaggcggggtggagcggagctgctgggaggctgctggataggagaggggtcacggctgcggaagaggaggttcttcgggacacccgtggatggacacggcaaggaaacaccaggccaaccacagctggggataaaatagcacaaccacaccctgccgtccagcgcctcccagcctgtgccccttcctagtaccaccagcaaccatcaatcccgtctcctcctgcctcctctcctgcaatccaccccgccacgactatcgccatggcagccctgatcgcagagaacttccgcttcctgtcacttttcttcaagagcaaggatgtgatgattttcaacggcctggtggcactgggcacggtgggcagccaggagctgttctctgtggtggccttccactgcccctgctcgccggcccggaactacctgtacgggctggcggccatcggcgtgcccgccctggtgctcttcatcattggcatcatcctcaacaaccacacctggaacctcgtggccgagtgccagcaccggaggaccaagaactgctccgccgcccccaccttcctccttctaagctccatcctgggacgtgcggctgtggcccctgtcacctggtctgtcatctccctgctgcgtggtgaggcttatgtctgtgctctcagtgagttcgtggacccttcctcactcacggccagggaagagcacttcccatcagcccacgccactgaaatcctggccaggttcccctgcaaggagaaccctgacaacctgtcagacttccgggaggaggtcagccgcaggctcaggtatgagtcccagctctttggatggctgctcatcggcgtggtggccatcctggtgttcctgaccaagtgcctcaagcattactgctcaccactcagctaccgccaggaggcctactgggcgcagtaccgcgccaatgaggaccagctgttccagcgcacggccgaggtgcactctcgggtgctcgctgccaacaatgtgcgccgcttctttggctttgtggcgctcaacaaggatgatgaggaactgattgccaacttcccagtggaaggcacgcagccacggccacagtggaatgccatcaccggcgtctacttgtaccgtgagaaccagggcctcccactctacagccgcctgcacaagtgggcccagggtctggcaggcaacggcgcggcccctgacaacgtggagatggccctgctcccctcctaaggaggtgcttcccatgctctttgtaaatggcactacttggtcccaaactgaaccccactgcttgctcacatccatatcagaaggggatttttaaaaaactgttatcttcttggccaggggaaaggaccacaaggcaatctggggtgtggacagacccagtagacaatggaagccccagccagcagggccaggtgacagtgaagctcaccagtgggctcctttatggtactctatgcagttaacatgtatctagctgcatagggacacccagcgcagcagtgcaccactgggaagtggcctccagtgcagcctctggccttattttatatatttaaatttttgataaagtttttcttactaaaa

SEQ ID NO: 4233 - DNA, 1843 bp, Homo sapiens
ctctgcctggtggcgccgggaggctgtttttccactcactggcgcgcagactccatcccactgttttcttctctcttttctggagttagattagtctgaagccgccaccagccccaggcccccgtgcagaagaaaagcgggagggaacggcggaggccgccgctgccctgcaccgccctcctggaggccacttggagagtccggccccgaggaggccatggccacaagtgcccacagctggccccaggcggggtggagcggagctgctgggaggctgctggataggagaggggtcacggctgcggaagaggaggttcttcgggacacccgtggatggacacggcaaggaaacaccaggccaaccacagctggggataaaatagcacaaccacaccctgccgtccagcgcctcccagcctgtgccccttcctagtaccaccagcaaccatcaatcccgtctcctcctgcctcctctcctgcaatccaccccgccacgactatcgccatggcagccctgatcgcagagaacttccgcttcctgtcacttttcttcaagagcaaggatgtgatgattttcaacggcctggtggcactgggcacggtgggcagccaggagctgttctctgtggtggccttccactgcccctgctcgccggcccggaactacctgtacgggctggcggccatcggcgtgcccgccctggtgctcttcatcattggcatcatcctcaacaaccacacctggaacctcgtggccgagtgccagcaccggaggaccaagaactgctccgccgcccccaccttcctccttctaagctccatcctgggacgtgcggctgtggcccctgtcacctggtctgtcatctccctgctgcgtggtgaggcttatgtctgtgctctcagtgagttcgtggacccttcctcactcacggccagggaagagcacttcccatcagcccacgccactgaaatcctggccaggttcccctgcaaggagaaccctgacaacctgtcagacttccgggaggaggtcagccgcaggctcaggtatgagtcccagctctttggatggctgctcatcggcgtggtggccatcctggtgttcctgaccaagtgcctcaagcattactgctcaccactcagctaccgccaggaggcctactgggcgcagtaccgcgccaatgaggaccagctgttccagcgcacggccgaggtgcactctcgggtgctcgctgccaacaatgtgcgccgcttctttggctttgtggcgctcaacaaggatgatgaggaactgattgccaacttcccagtggaaggcacgcagccacggccacagtggaatgccatcaccggcgtctacttgtaccgtgagaaccagggcctcccactctacagccgcctgcacaagtgggcccagggtctggcaggcaacggcgcggcccctgacaacgtggagatggccctgctcccctcctaaggaggtgcttcccatgctctttgtaaatggcactacttggtcccaaactgaaccccactgcttgctcacatccatatcagaaggggatttttaaaaaactgttatcttcttggccaggggaaaggaccacaaggcaatctggggtgtggacagacccagtagacaatggaagccccagccagcagggccaggtgacagtgaagctcaccagtgggctcctttatggtactctatgcagttaacatgtatctagctgcatagggacacccagcgcagcagtgcaccactgggaagtggcctccagtgcagcctctggccttattttatatatttaaatttttgataaagtttttcttactaaaagga

SEQ ID NO: 4234 - DNA, 2026 bp, Homo sapiens
aattcaatcctcagccctccagggatccgaagcaggtcccggggagttagctgactataggtcaaagagtcagcattggggatggtttgtccagtcaatggacaactctgagggagaagggccagtagagggtggggccctggccctgagcatcctgcagggctcagcgcgggcctgacgacaccctcccttgaccctcgcggggtctcctttggtagcttctgcccagcgggggtcaagcggggtggagcggagctgctgggaggctgctggataggagaggggtcacggctgcggaagaggaggttcttcgggacacccgtggatggacacggcaaggaaagagcaaggctcaggatgatttatcctcttttcactgatgaggaatctgaggcccagagaacagtcatgaagtgtgatcagaccctgaggtctccaaaaagataatgtccttgcgaactccagggattctggcatcttgctgtacccaccccagcccacacggcaggatcctatccaagtcccttatccacccggacactcactttagcttttacaccctcaaggctgagaccctaaggacacgccctggatccaaggagtccctggcccctctgctaatatgcgccacctggactcccagagggaaagccggtcagcaccccacatgcattagcaccatgggccacccccaagccctaccccaggagaagctcgtggtggcaaaaagaacctaagcatttgaggcaggtcacccaagcttgaatctcagtctgcctctcatctgtgaccctggcgagccactcgtcctcaggaagccttcactttccctagtgcacggcgggcacacagctcaacgtgggactgtgaggatgggaaatgaggggtgccatgcaccctggaggaactcagtgaacagtggcaactgtcacttccctggggccctatggtccttcctttctccccagcctgtccacactagcatcttcctcaactcctggttttcagagggaaacacttatcggtcatctgctccacaggaaacaccaggccaaccacagctggggataaaatagcacaaccacaccctgccgtccagcgcctcccagcctgtgccccttcctagtaccaccagcaaccatcaatcccgtctcctcctgcctcctctcctgcaatccaccccgccacgactatcgccatggcagccctgatcgcagagaacttccgcttcctgtcacttttcttcaagagcaaggatgtgatgattttcaacggcctggtggcactgggcacggtgggcagccaggagctgttctctgtggtggccttccactgcccctgctcgccggcccggaactacctgtacgggctggcggccatcggcgtgcccgccctggtgctcttcatcattggcatcatcctcaacaaccacacctggaacctcgtggccgagtgccagcaccggaggaccaagaactgctccgccgcccccaccttcctccttctaagctccatcctgggacgtgcggctgtggcccctgtcacctggtctgtcatctccctgctgcgtggtgaggcttatgtctgtgctctcagtgagttcgtggacccttcctcactcacggccagggaagagcacttcccatcagcccacgccactgaaatcctggccaggttcccctgcaaggagaaccctgacaacctgtcagacttccgggaggaggtcagccgcaggctcaggtatgagtcccaggtaaggagctgtgcaaagggaagctcctcttccctagtggtggctggtgagaggtccggggatggcctagtgctaaagctggggttggtcctcaggggctgaggtctgtgggaaagcactagcgttaggtatcagggctggttaactggtgcatggtggggcaagggccagttccagacacaaataagacagttttatcaatttttttttttactgtaaatctcagttgtatatgaccaaattagttttaaacattaaaggaacattcttctg

SEQ ID NO: 4235 - DNA, 2218 bp, Homo sapiens
gggggcgggtctatagtgggaaggggacgcgcgccctgcggcccggcctctagtcatcgccctcgcagcggcggccaacatcaccgccactgccacccctcccagactgtggacgggaggatggagtcgatggccgtcgctaccgacggcggggagaggccgggggtcccagcgggctcaggtctgtcggcttcccagcgtcgggcggagctgcgtcggagaaagctgctcatgaactcggaacagcgcatcaaccggatcatgggctttcacaggcccgggagcggcgcggaagaagaaagtcaaacaaaatcaaagcagcaggacagtgataaactgaactccctcagcgttccttccgtttcaaagcgagtagtgctgggtgattcagtcagtacaggaacaactgaccagcagggtggtgtggccgaggtaaaggggacccaactgggagacaaattggactcgttcattaaaccacctgagtgcagtagtgatgtcaaccttgagctccggcagcggaacagaggggacctgacagcggactcggtccagaggggttcccgccatggcctagagcagtacctttccagattcgaagaagcaatgaagctaaggaaacagctgattagtgaaaaacccagtcaagaggatggaaatacaacagaagaatttgactcttttcgaatatttagattggtgggatgtgctcttcttgctcttggagtcagagcttttgtttgcaaatacttgtccatatttgctccatttcttactttacaacttgcgtacatgggattatacaaatattttcccaagagtgaaaagaagataaagacaacagtactaacagctgcacttctattgtcgggaattcctgccgaagtgataaatcgatcaatggatacctatagcaaaatgggcgaagtcttcacagatctctgtgtctactttttcacttttatcttttgtcatgaactgcttgattattggggctctgaagtaccatgaagcctgtagaactgagaaggagaagcttacaaaaaaaaaaaaatcctcttctatattgcagtgtctctaaaggaggcaaattggtttacaccttcatgtaattcttttactttaggggttgtaaagctactttattagatatagaatggcagattctctgatttaaaagggctgagtttgtattattactgatatgaagaatagagtaccaatgtcattaattgatttttcttgttaatcagaattcctattctgtacctttcctctaacttctcagatttgtaattcttcttttgggagctgagctagtgcttttaggagaacagataaatgtggtctcagccagccctagagactgcttcttgtgtttgtgtcattctgtcctgagaaatgaagtcatctgaaaaataaaatgaaagaaactgaattgtctaatgttaactctgcacattgtaacttttcttgttgagttagtatcttaatttttactccagcacaagtatttaatcaaagaaaagattcatacatgtgaaattggaaggtatttataaaatttttattgctgtataccaaactcagaattggaactttttacatttgagtttcactttttagaagtatgttttaagcaagcaaaaacaaaatgggatgtgaagaattgaggcatgcaacccaatagcataaatgtcctttttccccccaaatatggtctagatgagttattataaacattgtttttatttttttgagacagagtttcgctcttgttgcccaggctagagtgcaatggcgccatctcggctcaccgcaacctccaccttcctggttcaagggattctcctgcctcagcctcccaagtagctgggattacaggcatgcaccaccacgcccagctaatttttatattctttagtaaagacagggtttctccatgttggtcaggctggtctcgaacttctgacctcaggtgatctgcccacctcggcctcccaaagtgctgggattacaggcgtgagccactgcacctggccttataaatatccttttaactaactcagtaactgccatattttgttgggttgtcttcttaaaagaatataagactaaagtgttaatgtcacttggtgttacatttccttacagatttttgtatagtctaatttggttaatccttgtgacattaaaaacacatacactttttaaaaaa

SEQ ID NO: 4236 - DNA, 1488 bp, Homo sapiens
ggagagagccgccgagccgagccgagccccagctccagcaagagcgcgggcgggtggcccaggcacgcagcggtgaggaccgcggccacagctcggcgccaaccaccgcgggcctcccagccagccccgcggcggggcagccgcaggagccctggctgtggtcggggggcagtgggccatgctgggggcagtggaaggccccaggtggaagcaggcggaggacattagagacatctacgacttccgagatgttctgggcacgggggccttctcggaggtgatcctggcagaagataagaggacgcagaagctggtggccatcaaatgcattgccaaggaggccctggagggcaaggaaggcagcatggagaatgagattgctgtcctgcacaagatcaagcaccccaacattgtagccctggatgacatctatgagagtgggggccacctctacctcatcatgcagctggtgtcgggtggggagctctttgaccgtattgtggaaaaaggcttctacacggagcgggacgccagccgcctcatcttccaggtgctggatgctgtgaaatacctgcatgacctgggcattgtacaccgggatctcaagccagagaatctgctgtactacagcctggatgaagactccaaaatcatgatctccgactttggcctctccaagatggaggacccgggcagtgtgctctccaccgcctgtggaactccgggatacgtggcccctgaagtcctggcccagaagccctacagcaaggctgtggattgctggtccataggtgtcatcgcctacatcttgctctgcggttaccctcccttctatgacgagaatgatgccaaactctttgaacagattttgaaggccgagtacgagtttgactctccttactgggacgacatctctgactctgccaaagatttcatccggcacttgatggagaaggacccagagaaaagattcacctgtgagcaggccttgcagcacccatggattgcaggagatacagctctagataagaatatccaccagtcggtgagtgagcagatcaagaagaactttgccaagagcaagtggaagcaagccttcaatgccacggctgtggtgcggcacatgaggaaactgcagctgggcaccagccaggaggggcaggggcagacggcgagccatggggagctgctgacaccagtggctggggggccggcagctggctgttgctgtcgagactgctgcgtggagccgggcacagaactgtcccccacactgccccaccagctctagggccctggacctcgggtcatgatcctctgcgtgggagggcttgggggcagcctgctccccttccctccctgaaccgggagtttctctgccctgtcccctcctcacctgcttccctaccactcctcactgcattttccatacaaatgtttctattttattgttccttcttgtaataaagggaagataaaaccatcctt

SEQ ID NO: 4237 - DNA, 5322 bp, Homo sapiens
tttccctgtaaaccttagaacccagctgttgccagggcaacggggcaatacctgtctctctagagatgaagttgccagggtaactgcatcctgtcattcgttcctggggaccatccggaatgcggcacccactggctgttaccatggcaactgcctttttgccccacttaatcccatcccgtctgctacaagggccccacagttggaggtgggggaggtgggaagagaaaagatcacttgtggacaaagtttgctctattccacctcctccaggccctccttgggtccatcaccccaggggtgctgggtccatcccacccccaggcccacacaggcttgcagtattgtgtgcggtatggtcagggcgtccgagagcaggtttcgcagtggaaggcaggcaggtgttggggaggcagttaccggggcaacgggaacagggcgttttggaggtggttgccatggggacctggatgctgacgaaggctcgcgaggctgtgagcagccacagtgccctgctcagaagccccgggctcgtcagtcaaaccggttctctgtttgcactcggcagcacgggcaggcaagtggtccctaggttcgggagcagagcagcagcgcctcagtcctggtcccccagtcccaagcctcacctgcctgcccagcgccaggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtgaagctggcagactttggcctggccatagaggtggagggggagcagcaggcatggtttgggtttgcagggactcctggatatctctccccagaagtgctgcggaaggacccgtacgggaagcctgtggacctgtgggcttgtggggtcatcctgtacatcctgctggttgggtaccccccgttctgggatgaggaccagcaccgcctgtaccagcagatcaaagccggcgcctatgatttcccatcgccggaatgggacactgtcaccccggaagccaaggatctgatcaataagatgctgaccattaacccatccaaacgcatcacagctgccgaagcccttaagcacccctggatctcgcaccgctccaccgtggcatcctgcatgcacagacaggagaccgtggactgcctgaagaagttcaatgccaggaggaaactgaagggagccattctcaccacgatgctggccaccaggaacttctccggagggaagagtgggggaaacaagaagagcgatggtgtgaaggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggatggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggtggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccagcaccccccacccacctctggggggcccgtgagcgtgtgtcttcattgcctctctccccttggcgtctgatgaccacagcaaagcactgggaatttctactcttcatgcctcatcctgcagcctcgggttcgcattctctctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtaccctcgaccctcctgggtgttggttggagcagaactggtgaggatgtttgatccgagattttctgagctctccccaatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccaggggcaggctcttggcctgccccaggcccagagggcttcccagtaaggcccagtgatcccattatcccaggggcaaaaccacctgtccccttttgagctgccagttccctacagccatccccagtcaagggtgagggtgtggccttcaccaggggctgctgtaattaccgagcaaggtctgagctcttcttcagcctcagttccctcattggttaaaagggttctttgttcccatccagccgatgaaggagcaaacgtctggctatgtgaagcctaatttacctgcaggaactggcagggatagtcactggctggactcctgtttacttctagacctggtcaggctccatcccctcccccacctgcccctgattcccctcgtcggtgcctgtcaactgcttttcagcagtggactgcaggggaaagagcagtgatttggggtgagtaggcttcaattcccagctctgaccagacttgctgtgtgaccttgggcaagttcctttccctctttggagcttggtttccctgccagaggaaactgagctggaggagcctgaggtcctgcctttcattggctgacacacctcctgtccactgtgtcactctccaagtgccagagaagtggaggcagatcgctaccccaggctgagatggcccccactgtgaaggccacgcctgtgggtgggcagccacctggtgccaccacagggcaccagggatgatcctgatgtggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttctttttttttttcttttcttttttaaaaatatgtggctgtgaacttgaatgaacactgctcaaactttctgctattggggggggcgggtgggatgggaagaaggggcgtttgttttattcttggtgttttcagtgcaataaatagctacaaacttctgtgca

SEQ ID NO: 4238 - DNA, 1493 bp, Homo sapiens
caggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtgaagctggcagactttggcctggccatagaggtggagggggagcagcaggcatggtttgggtttgcagggactcctggatatctctccccagaagtgctgcggaaggacccgtacgggaagcctgtggacctgtgggcttgtggggtcatcctgtacatcctgctggttgggtaccccccgttctgggatgaggaccagcaccgcctgtaccagcagatcaaagccggcgcctatgatttcccatcgccggaatgggacactgtcaccccggaagccaaggatctgatcaataagatgctgaccattaacccatccaaacgcatcacagctgccgaagcccttaagcacccctggatctcgcaccgctccaccgtggcatcctgcatgcacagacaggagaccgtggactgcctgaagaagttcaatgccaggaggaaactgaagggagccattctcaccacgatgctggccaccaggaacttctccggagggaagagtgggggaaacaagaagagcgatggtgtgaagaaaagaaagtccagttccagcgttcagttaatggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggatggcaaatggcagatcgtccacttccacagatctggggcgccctccgtcctgccccactgagggaccaggctggggtcgc

SEQ ID NO: 4239 - DNA, 540 bp, Homo sapiens
aaaagatcacttgtggacaaagtttgctctattccacctcctccaggccctccttgggtccatcaccccaggggtgctgggtccatcccacccccaggcccacacaggcttgcagtattgtgtgcggtatggtcagggcgtccgagagcaggtttcgcagtggaaggcagcacgggcaggcaagtggtccctaggttcgggagcagagcagcagcgcctcagtcctggtcccccagtcccaagcctcacctgcctgcccagcgccaggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacct

SEQ ID NO: 4240 - DNA, 1652 bp, Homo sapiens
gccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagccaagagtttactcaacaagaaagcagatggagtcaagccccagacgaatagcaccaaaaacagtgcagccgccaccagccccaaagggacgcttcctcctgccgccctggagcctcaaaccaccgtcatccataacccagtggacgggattaaggagtcttctgacagtgccaataccaccatagaggatgaagacgctaaagcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctc

SEQ ID NO: 4241 - DNA, 1448 bp, Homo sapiens
gccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctc

SEQ ID NO: 4242 - DNA, 1577 bp, Homo sapiens
gccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagtgggcagacagaccaccgctccggccacaatgtccaccgcggcctccggcaccaccatggggctggtggaacaagccaagagtttactcaacaagaaagcagatggagtcaaggagcctcaaaccaccgtcatccataacccagtggacgggattaaggagtcttctgacagtgccaataccaccatagaggatgaagacgctaaagcccggaagcaggagatcattaagaccacggagcagctcatcgaggccgtcaacaacggtgactttgaggcctacgcattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctc

SEQ ID NO: 4243 - DNA, 2292 bp, Homo sapiens
gtgcccgcgagcgggagccggagtcgccgccgcccgagcgcagccgagcgcacgccgagcccgtccgccgccgccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagtgggcagacagaccaccgctccggccacaatgtccaccgcggcctccggcaccaccatggggctggtggaacaagccaagagtttactcaacaagaaagcagatggagtcaagccccagacgaatagcaccaaaaacagtgcagccgccaccagccccaaagggacgcttcctcctgccgccctggagcctcaaaccaccgtcatccataacccagtggacgggattaaggagtcttctgacagtgccaataccaccatagaggatgaagacgctaaagcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagccaagggaggggcacagaatggggaacaggacacaggatcctaaactccaaggggactgtccaccgatgaacactcagagtggacaccatcttccgtccacgctgtgcccaggacagctgtccccatccatgaacacagggtaaacatctgccgggctccgcaccagtggctccctgggccatgggacagcggcagggctcaccacggacagcacgtggcccagcagccggccaccctggcgtcctggggcctcctcccctcctctccctctcaccttgtcacctccacggagctgcctgtctgggataatttggggattttttttctgggggataattcttttgcatgacccctaaagagcaagccacaccggtctgctagctaggtgtccgcggtgtggtggtggcggccgctggccagcgctgcaaggggtcggctgcccacggtgctggctggcctcccctcctctctctttttgctgagtttcattgtcttttctttctgagccttgtaagtgtacaaaaattattcttattttgttctgtctcgggaaactgcaaataaaagaaaaacaggacaaactgc

SEQ ID NO: 4244 - DNA, 1624 bp, Homo sapiens
cgccgccgccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagcagccaagagtttactcaacaagaaagcagatggagtcaaggagtcttctgacagtgccaataccaccatagaggatgaagacgctaaagcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgatttgttaaaaaaaaacaaaaaaaaaaaaaa

SEQ ID NO: 4245 - DNA, 1895 bp, Homo sapiens
gcggcgcgctcctggcgaggacggagcgagcagatctcgcgtgcgctcgccgcccggcgcagcccagcccggcccccgcctggcgccgcgagccgaggtgtctcccgcgcccgcgcccgtgtcgccgccgtgcccgcgagcgggagccggagtcgccgccgcccgagcgcagccgagcgcacgccgagcccgtccgccgccgccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagcagccaagagtttactcaacaagaaagcagatggagtcaagccccagacgaatagcaccaaaaacagtgcagccgccaccagccccaaagggacgcttcctcctgccgccctggagtcttctgacagtgccaataccaccatagaggatgaagacgctaaagcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgatttgttaaaaaaaaacaaaaaaaaaaaaaaaaaaa

SEQ ID NO: 4246 - DNA, 1557 bp, Homo sapiens
atggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagcagccaagagtttactcaacaagaaagcagatggagtcaagccccagacgaatagcaccaaaaacagtgcagccgccaccagccccaaagggacgcttcctcctgccgccctggagcctcaaaccaccgtcatccataacccagtggacgggattaaggagtcttctgacagtgccaataccaccatagaggatgaagacgctaaagcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtga

SEQ ID NO: 4247 - DNA, 4447 bp, Homo sapiens
ccgtgcccgcgagcgggagccggagtcgccgccgcccgagcgcagccgagcgcacgccgagcccgtccgccgccgccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagtgggcagacagaccaccgctccggccacaatgtccaccgcggcctccggcaccaccatggggctggtggaacaagccaagagtttactcaacaagaaagcagatggagtcaagccccagacgaatagcaccaaaaacagtgcagccgccaccagccccaaagggacgcttcctcctgccgccctggagcctcaaaccaccgtcatccataacccagtggacgggattaaggagtcttctgacagtgccaataccaccatagaggatgaagacgctaaagcccccagggtccccgacatcctgagctcagtgaggaggggctcgggagccccagaagccgaggggcccctgccctgcccatctccggctccctttagccccctgccagccccatcccccaggatctctgacatcctgaactctgtgagaaggggttcaggaaccccagaagccgagggccccctctcagcggggcccccgccctgcctgtctccggctctcctaggccccctgtcctccccgtcccccaggatctctgacatcctgaactctgtgaggaggggctcagggaccccagaagccgagggcccctcgccagtggggcccccgccctgcccatctccgactatccctggccccctgcccaccccatcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgatttgttaaaaaaaaacaaaaaaaaaaaaaaaaaaaacaagatgacgacgacaaccacaaaaaaaattgacatcagatgaaatgaaaaaaaaaaaaaacaaaaaaaactaaaggaaggaaaaagctgtaaaaatcactggcattcgtggggccactccccacccaagctccacgtgtgtccgtctgtgctcctggcctctgggggaccagctgggacatgaacttgtctgccaggcccccgtcgcgtgctgaacggtgttagtttgtaggtaacgcacacaccccacacctaaggtgtctgcatcctcctgccaacgcatgggctccacgtggtgtgctcgctggctgtcgtgactgtcagctgtctcttgggaggggctgtgggggcccgctgggctgcctcctttcccgctagttgtgcctgagagttgctgttgttcctgctttcccttcccttcctttcatcccctgaagggctaggtgtgggttttccgtgcccggtatccccacacacccagcacggacaacccttcggcagagcccaggccggcccctcaccccctggagtattgaaactggagtcccgtccccaaggccttcagagatgcccctacacacccagggctccagctctggtccttctgggggagtaaagtgcaaagaggggcacagcttagttttgggcctctcgccgagcaagagacagcactgctggctacagctccaacacagccagctgtggcaagaggactctgcctgggctggcccccctcctgtgtgaggtgtctgtcccttctctgctggccagcagcagatgcactggcagctcccaaccctgtttccgcccctcggccctcccccagcctgttcggcttctctgcagcccgcaagggggagcagacttttgacaaaggactgcgggcctcgctcaagtccctgagcccccagctgaagctgggaggggaggccaggctttgtgtctgggcatattcgtctgctgatggggtttggggaagcctggggcttggggtttggtcgggtggtgcagctagtggcagagcgggatcagaggtggtggctgcccagcttctgggctgagacaagggtctgtgcaggggtttactgaagtgggagtgcctttggaatctgggccgggagcagaagggagcaaaagctacagtgggagccagcctagggcacatgggaggcgtgagggcagtgctgcccgtgcagtgtcaggtgtgccagtgccttggcgggctgcagtgcgtgtgagggcaccttctaggtgggccagggatgcagctatggagataaggcgggctggggacagaaacaggtgggcacagggcccaggacaccagcggatggagggcagggtctagccctgtgctcctgagcgtcggctgcctgggttcgaggcggtgggtccccggccccttgtgatggtgtgtaccatgggggagctcggggacagggcaagcccgagcatggtggggctgcagggtgggtctgaagccaggttgggtgggggtggtcacaagccctgactgcagagggtcaggggctcctgccccagtgcctgcccactttcaattcacattgttttcaacaaggattttctttatcttcccctacaaatcaagccaagggaggggcacagaatggggaacaggacacaggatcctaaactccaaggggactgtccaccgatgaacactcagagtggacaccatcttccgtccacgctgtgcccaggacagctgtccccatccatgaacacagggtaaacatctgccgggctccgcaccagtggctccctgggccatgggacagcggcagggctcaccacggacagcacgtggcccagcagccggccaccctggcgtcctggggcctcctcccctcctctccctctcaccttgtcacctccacggagctgcctgtctgggataatttggggattttttttctgggggataattcttttgcatgacccctaaagagcaagccacaccggtctgctagctaggtgtccgcggtgtggtggtggcggccgctggccagcgctgcaaggggtcggctgcccacggtgctggctggcctcccctcctctctctttttgctgagtttcattgtcttttctttctgagccttgtaagtgtacaaaaattattcttattttgttctgtctcgggaaactgcaaataaaagaaaaacaggaca

SEQ ID NO: 4248 - DNA, 2097 bp, Homo sapiens
gcggcgcccgcgcctccccgcgcgtaggtgtgcggcgcgctcctggcgaggacggagcgagcagatctcgcgtgcgctcgccgcccggcgcagcccagcccggcccccgcctggcgccgcgagccgaggtgtctcccgcgcccgcgcccgtgtcgccgccgtgcccgcgagcgggagccggagtcgccgccgcccgagcgcagccgagcgcacgccgagcccgtccgccgccgccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagtgggcagacagaccaccgctccggccacaatgtccaccgcggcctccggcaccaccatggggctggtggaacaagccaagagtttactcaacaagaaagcagatggagtcaagccccagacgaatagcaccaaaaacagtgcagccgccaccagccccaaagggacgcttcctcctgccgccctggagcctcaaaccaccgtcatccataacccagtggacgggattaaggagtcttctgacagtgccaataccaccatagaggatgaagacgctaaagcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgatttgttaaaaaaaaacaaaaaaaaaaaaaaaaaaaacaagatgacgacgacaaccacaaaaaaaattgacatcagatgaaatgaaaaaa

SEQ ID NO: 4249 - DNA, 4142 bp, Homo sapiens
aggtgtgcggcgcgctcctggcgaggacggagcgagcagatctcgcgtgcgctcgccgcccggcgcagcccagcccggcccccgcctggcgccgcgagccgaggtgtctcccgcgcccgcgcccgtgtcgccgccgtgcccgcgagcgggagccggagtcgccgccgcccgagcgcagccgagcgcacgccgagcccgtccgccgccgccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagcagccaagagtttactcaacaagaaagcagatggagtcaagccccagacgaatagcaccaaaaacagtgcagccgccaccagccccaaagggacgcttcctcctgccgccctggagcctcaaaccaccgtcatccataacccagtggacgggattaaggagtcttctgacagtgccaataccaccatagaggatgaagacgctaaagcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgatttgttaaaaaaaaacaaaaaaaaaaaaaaaaaaaacaagatgacgacgacaaccacaaaaaaaattgacatcagatgaaatgaaaaaaaaaaaaaacaaaaaaaactaaaggaaggaaaaagctgtaaaaatcactggcattcgtggggccactccccacccaagctccacgtgtgtccgtctgtgctcctggcctctgggggaccagctgggacatgaacttgtctgccaggcccccgtcgcgtgctgaacggtgttagtttgtaggtaacgcacacaccccacacctaaggtgtctgcatcctcctgccaacgcatgggctccacgtggtgtgctcgctggctgtcgtgactgtcagctgtctcttgggaggggctgtgggggcccgctgggctgcctcctttcccgctagttgtgcctgagagttgctgttgttcctgctttcccttcccttcctttcatcccctgaagggctaggtgtgggttttccgtgcccggtatccccacacacccagcacggacaacccttcggcagagcccaggccggcccctcaccccctggagtattgaaactggagtcccgtccccaaggccttcagagatgcccctacacacccagggctccagctctggtccttctgggggagtaaagtgcaaagaggggcacagcttagttttgggcctctcgccgagcaagagacagcactgctggctacagctccaacacagccagctgtggcaagaggactctgcctgggctggcccccctcctgtgtgaggtgtctgtcccttctctgctggccagcagcagatgcactggcagctcccaaccctgtttccgcccctcggccctcccccagcctgttcggcttctctgcagcccgcaagggggagcagacttttgacaaaggactgcgggcctcgctcaagtccctgagcccccagctgaagctgggaggggaggccaggctttgtgtctgggcatattcgtctgctgatggggtttggggaagcctggggcttggggtttggtcgggtggtgcagctagtggcagagcgggatcagaggtggtggctgcccagcttctgggctgagacaagggtctgtgcaggggtttactgaagtgggagtgcctttggaatctgggccgggagcagaagggagcaaaagctacagtgggagccagcctagggcacatgggaggcgtgagggcagtgctgcccgtgcagtgtcaggtgtgccagtgccttggcgggctgcagtgcgtgtgagggcaccttctaggtgggccagggatgcagctatggagataaggcgggctggggacagaaacaggtgggcacagggcccaggacaccagcggatggagggcagggtctagccctgtgctcctgagcgtcggctgcctgggttcgaggcggtgggtccccggccccttgtgatggtgtgtaccatgggggagctcggggacagggcaagcccgagcatggtggggctgcagggtgggtctgaagccaggttgggtgggggtggtcacaagccctgactgcagagggtcaggggctcctgccccagtgcctgcccactttcaattcacattgttttcaacaaggattttctttatcttcccctacaaatcaagccaagggaggggcacagaatggggaacaggacacaggatcctaaactccaaggggactgtccaccgatgaacactcagagtggacaccatcttccgtccacgctgtgcccaggacagctgtccccatccatgaacacagggtaaacatctgccgggctccgcaccagtggctccctgggccatgggacagcggcagggctcaccacggacagcacgtggcccagcagccggccaccctggcgtcctggggcctcctcccctcctctccctctcaccttgtcacctccacggagctgcctgtctgggataatttggggattttttttctgggggataattcttttgcatgacccctaaagagcaagccacaccggtctgctagctaggtgtccgcggtgtggtggtggcggccgctggccagcgctgcaaggggtcggctgcccacggtgctggctggcctcccctcctctctctttttgctgagtttcattgtcttttctttctgagccttgtaagtgtacaaaaattattcttattttgttctgtctcgggaaactgcaaataaaagaaaaacaggacaaactgc

SEQ ID NO: 4250 - DNA, 1856 bp, Homo sapiens
agtcgccgccgcccgagcgcagccgagcgcacgccgagcccgtccgccgccgccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagtgggcagacagaccaccgctccggccacaatgtccaccgcggcctccggcaccaccatggggctggtggaacaagccaagagtttactcaacaagaaagcagatggagtcaagccccagacgaatagcaccaaaaacagtgcagccgccaccagccccaaagggacgcttcctcctgccgccctggagcctcaaaccaccgtcatccataacccagtggacgggattaaggagtcttctgacagtgccaataccaccatagaggatgaagacgctaaagcccggaagcaggagatcattaagaccacggagcagctcatcgaggccgtcaacaacggtgactttgaggcctacgcgtgagtccctggggctgggggggggctgtgcaggacaaggatgtgggacccttgggggggcctgctcagagtcaggggtccacggggcccctcctcacttggatttggcccccaggaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagccaagggaggggcacagaatggggaacaggacacaggatcctaaactccaaggggactgtccaccgatgaacactcagagtggacaccatcttccgtccacgctgtgcccaggacagctgtccccatccatgaacacagggtaaacatctgccgggctccgcaccagtggctccctg

SEQ ID NO: 4251 - DNA, 5820 bp, Homo sapiens
aaaggagggagtgcgagagatccacgaagggacaggcttggagtcgctagagggaggtgtgggaccagcgaggagggggcttcgccagggagggggtgctggcaggcggagggagcggcgggaggaggcgccggaggaggagacggaggcctggggacggcagaagaggcttcgcctgagccgagcgctctttctctcgccgcgccgtcttgaagccgcgcgggctcgtgagcagcgcgaggccgccaaggtgcctcgcttcgccggagccgctgccgcccgccggagggaagccggcctcgggcgcgcacgctcgtcggagccccggcgcgccccgcgcctgagcctgctgacagcggccgctgggctcaggctgtccgctctgggctccgcggcctcggccccgctgcactccacctccgccccctcggactccctcccctctgcttctactcctcctgctccagtgcggatcgtttcgcaactgcttgccactcgtcccgtgcctggctgtttttccatttcccggccccctcttcttgagtactttaccccctgcatttggggacagggactggaaaaggggcgggtggagcgtccagtggagaagaaggaagcgaggcccgcaggaggaggaggatcggcggactgtggggaggagaccccacgccaccctttctggtcatctcccctcccgccccgcccctgcgcacactccctcgcgggcgagctactttcggaccaggaaagtaagagcggccctgggtgacagcgccgcggggccagtcccggggttagccgcgcgtctgctcgcttctggtccgtcgcgctcccagccagggcacagcccggaccgaggatggcttcgaccacaacctgcaccaggttcacggacgagtatcagcttttcgaggagcttggaaagggggcattctcagtggtgagaagatgtatgaaaattcctactggacaagaatatgctgccaaaattatcaacaccaaaaagctttctgctagggatcatcagaaactagaaagagaagctagaatctgccgtcttttgaagcaccctaatattgtgcgacttcatgatagcatatcagaagagggctttcactacttggtgtttgatttagttactggaggtgaactgtttgaagacatagtggcaagagaatactacagtgaagctgatgccagtcattgtatacagcagattctagaaagtgttaatcattgtcacctaaatggcatagttcacagggacctgaagcctgagaatttgcttttagctagcaaatccaagggagcagctgtgaaattggcagactttggcttagccatagaagttcaaggggaccagcaggcgtggtttggttttgctggcacacctggatatctttctccagaagttttacgtaaagatccttatggaaagccagtggatatgtgggcatgtggtgtcattctctatattctacttgtggggtatccacccttctgggatgaagaccaacacagactctatcagcagatcaaggctggagcttatgattttccatcaccagaatgggacacggtgactcctgaagccaaagacctcatcaataaaatgcttactatcaaccctgccaaacgcatcacagcctcagaggcactgaagcacccatggatctgtcaacgttctactgttgcttccatgatgcacagacaggagactgtagactgcttgaagaaatttaatgctagaagaaaactaaagggtgccatcttgacaactatgctggctacaaggaatttctcagcagccaagagtttgttgaagaaaccagatggagtaaaggagtcaactgagagttcaaatacaacaattgaggatgaagatgtgaaagcacgaaagcaagagattatcaaagtcactgaacaactgatcgaagctatcaacaatggggactttgaagcctacacaaaaatctgtgacccaggccttactgcttttgaacctgaagctttgggtaatttagtggaagggatggattttcaccgattctactttgaaaatgctttgtccaaaagcaataaaccaatccacactattattctaaaccctcatgtacatctggtaggggatgatgccgcctgcatagcatatattaggctcacacagtacatggatggcagtggaatgccaaagacaatgcagtcagaagagactcgtgtgtggcaccgccgggatggaaagtggcagaatgttcattttcatcgctcggggtcaccaacagtacccatcaagtaaatatttccaggctgtcagcttctttgttaatacacccatgctaaatttcaacagtgccacttctgcattctctgttctcaaggcacctggatggtgaccctgggccgtcctctcctcctcttcatgcatgtttctgagtgcatgaagttgtgaaggtcctacatgtaatgcatatgtgatgcatcatcttatcatatattccttcctatacattgtttacacttcaactacggggatgttccacacaaacttaaattactgttggcaaaacaatagggggagattagacaaaaaaaaaaatccacaatattccaagtacaactcttcatcaagtttctctgttaatgccaagatttaacagacttaagaactattgttctctgaatgacagttgtaagagaaatgtaaattttttagaactctttgctgttaatctgttttggtttgtttggtttttttttttttttttaaggtaaaaaaaaaatacaccttcagtttcctggtgtgatcctggttaaaatggatgatttttcattgaaagttttgctgattaacaattaaagtgggatgatatgtgggcaaaatcacttatgaaagtagaagcaagaatcagttggtttgctaccacataaagccatgctgtttttggtcaaactgtgtaaactggaaaaattcacatcatttctgagtttaatcactttaggatatattcacattgttttggtgaatttgctgaattgaattgtttttctttctcaaatctgtgatctcttttctttatcctgtttctttgttcctttcgtttgctttcttatttttcttttgttccattcttttcttacttttttcccttttccttttttggggaggctggctagtagtgtgtgagaaaagaatagaagtgaaatttgcataatgaatgtaaaagggaaataaaagtcttttgaaggtagctatactagcacttttgatcatcttcagggcccacaaaaatgttgtcaagattttaaaggtttataattctgcttaagctctagtttggacttaggtatcctaactatgttggaggtatttgcattgtttaaagttaggataaaagcaagttcctcctgtgactgcaacgtcttactgattgggacagttgccaggaggataccaacttgatagcagagggggttttatgcaaacgcactcacctccgccttggggaatgaaagggtcacttctgcatcatcactagctagttttctagtgttagagaggcttacaaatgtttgccattctcataagtgttttgaacttgatctttgtgacttgtgcttttttagcttctctcttgaatcagagtatcattgtcttcctccaaggagttagaatttcccagtttaaaacaaaaagggaaatgtcctaggttttctttgtgcttctcatttttcctttgttgattcaattcctgtgatttttgttctcttccctgaagtgctttacagtgcatggaatctccatcattgttattttaacgatagtaattcacagtcctcagaagcctatttttaaagcagaagcaaaaaagaaaaacaaaataacaaaaacaacccttcctcttttctctcatctcacctctctgtgttgattactaatcatcttagatattattgctagtggatgtatggtagatgggttgaagcttttctgataattattacacaatttaaaacaacatatatatttaaaataaatatatacagtaaatatattgagccatgttaacctgccaatgagatctgtgaaaaaataatggcctcatttttctctttttaatttcttttacccttttgtgaagcagctatacgtggcatacatgtatttaaagaaaaaaaaatagatgtagagtgttttttttacacttttaacttagcatgtggtgttgaagtattactgtagatcaagtttgtcttccgcactaagatgtgaggaaattgtgatttgttctctccaccacaaatgaattacacatttattatcttctatcattttgaaacactgcagtttaccatgggacactgtatatatttcttgccataatggtaaaggactgattgatatatttaagagttaataaatttgtgatttctgctgacagtgcgtccatctttatttcttcagaagaggtactgtatgtatgcctgcatagtgctggccagtgtcaagggcagtgtgtcctactctggtctcatttagtacataacaatttgcacttggtgagaatggcaagttaattgttctctgtgagcaaaacaatggtctcttctgggaaaatgttgctgagaacaatatagttaacaactaagactcctaaaagcttctctaaactgtaccctccaatccagccttcacatggctgctttttttttttttttttaatacgaacctgtccttgtaacactttgatgttatcatttctgggatacaggcaagcaccccagctcctgctactccccagcttgaacttgagcatacatggatgctcagcttcttttgatttgctaaaaacatcacacttgctcacatgcctgtttatgctgttcatgttgtttatgtttcttacctagaataaatagtctcttcccctacttcttttcccgacttcttactttttcctaagattcagtgtacagcatcatgctccacagcaaaccttcctaggccctattctgggcttgccttccctctcaaaacctacataatagattgtatttacctctcctgtcaaccacattgttttgaaaatatatttctatttgtgtctcctctactgcagtataatgtctccatgggcaagaactgtgtattcatcattgcattcctaaacccaaaccaaggccaggaatggagatatcattgataaatagttgttgaattgaggccaagcccttttgataacagaagcctcaaggggtacccagatagtccttgttttaatgatgggttctctcaccactgtcttgatgctctgagcaagttacctcttccctctgaccctcagtttccatatttgtaaaatgagaataaacataccaacttaataaagatattgtgaggattaatgggtacagagtgactagaatgatatttgatagaaattaaatggtagcagtataactattctgatcactgacattaatattcctattgttattattctttgctcacgagggtatacaactcttgttttgctgttgggctgccctctttatgtaggtttactgttaatgctgaggatatactcggactcaaatgtctcagcagaaggctgagagacaccaaatgaagtggtcatctagctgaatgtaggaaaaatgaaatgtagtagcaaatcagtatattctaaggaaattttcaaggaatattaatcttcacccaaattttgaatttttatgtaaaaaattataatttaagggtaaacatagatgacacagctttcgagtgatttcattgaataaaattctactgacttctatgaa

SEQ ID NO: 4252 - DNA, 1940 bp, Homo sapiens
atggcttcgaccacaacctgcaccaggttcacggacgagtatcagcttttcgaggagcttggaaagggggcattctcagtggtgagaagatgtatgaaaattcctactggacaagaatatgctgccaaaattatcaacaccaaaaagctttctgctagggatcatcagaaactagaaagagaagctagaatctgccgtcttttgaagcaccctaatattgtgcgacttcatgatagcatatcagaagagggctttcactacttggtgtttgatttagttactggaggtgaactgtttgaagacatagtggcaagagaatactacagtgaagctgatgccagtcattgtatacagcagattctagaaagtgttaatcattgtcacctaaatggcatagttcacagggacctgaagcctgagaatttgcttttagctagcaaatccaagggagcagctgtgaaattggcagactttggcttagccatagaagttcaaggggaccagcaggcgtggtttggttttgctggcacacctggatatctttctccagaagttttacgtaaagatccttatggaaagccagtggatatgtgggcatgtggtgtcattctctatattctacttgtggggtatccacccttctgggatgaagaccaacacagactctatcagcagatcaaggctggagcttatgattttccatcaccagaatgggacacggtgactcctgaagccaaagacctcatcaataaaatgcttactatcaaccctgccaaacgcatcacagcctcagaggcactgaagcacccatggatctgtcaacgttctactgttgcttccatgatgcacagacaggagactgtagactgcttgaagaaatttaatgctagaagaaaactaaagggtgccatcttgacaactatgctggctacaaggaatttctcagcagccaagagtttgttgaagaaaccagatggagtaaaggagtcaactgagagttcaaatacaacaattgaggatgaagatgtgaaagcacgaaagcaagagattatcaaagtcactgaacaactgatcgaagctatcaacaatggggactttgaagcctacacaaaaatctgtgacccaggccttactgcttttgaacctgaagctttgggtaatttagtggaagggatggattttcaccgattctactttgaaaatgctttgtccaaaagcaataaaccaatccacactattattctaaaccctcatgtacatctggtaggggatgatgccgcctgcatagcatatattaggctcacacagtacatggatggcagtggaatgccaaagacaatgcagtcagaagagactcgtgtgtggcaccgccgggatggaaagtggcagaatgttcattttcatcgctcggggtcaccaacagtacccatcaagccaccctgtattccaaatgggaaagaaaacttctcaggaggcacctctttgtggcaaaacatctaaggcctgaaaaccattcacatatgggtcttctaaatttcaacagtgccacttctgcattctctgttctcaaggcacctggatggtgaccctgggccgtcctctcctcctcttcatgcatgtttctgagtgcatgaagttgtgaaggtcctacatgtaatgcatatgtgatgcatcatcttatcatatattccttcctatacattgtttacacttcaactacggggatgttccacacaaacttaaattactgttggcaaaacaatagggggagattagacaaaaaaaaaaatccacaatattccaagtacaactcttcatcaagtttctctgttaatgccaagatttaacagacttaagaactattgttctctgaatgacagttgtaagagaaatgtaaattttttagaactctttgctgttaatctgttttggtttgtttg

SEQ ID NO: 4253 - DNA, 1642 bp, Homo sapiens
gccgcgcgtctgctcgcttctggtccgtcgcgctcccagccagggcacagcccggaccgaggatggcttcgaccacaacctgcaccaggttcacggacgagtatcagcttttcgaggagcttggaaagggggcattctcagtggtgagaagatgtatgaaaattcctactggacaagaatatgctgccaaaattatcaacaccaaaaagctttctgctagggatcatcagaaactagaaagagaagctagaatctgccgtcttttgaagcaccctaatattgtgcgacttcatgatagcatatcagaagagggctttcactacttggtgtttgatttagttactggaggtgaactgtttgaagacatagtggcaagagaatactacagtgaagctgatgccagtcattgtatacagcagattctagaaagtgttaatcattgtcacctaaatggcatagttcacagggacctgaagcctgagaatttgcttttagctagcaaatccaagggagcagctgtgaaattggcagactttggcttagccatagaagttcaaggggaccagcaggcgtggtttggttttgctggcacacctggatatctttctccagaagttttacgtaaagatccttatggaaagccagtggatatgtgggcatgtggtgtcattctctatattctacttgtggggtatccacccttctgggatgaagaccaacacagactctatcagcagatcaaggctggagcttatgattttccatcaccagaatgggacacggtgactcctgaagccaaagacctcatcaataaaatgcttactatcaaccctgccaaacgcatcacagcctcagaggcactgaagcacccatggatctgtcaacgttctactgttgcttccatgatgcacagacaggagactgtagactgcttgaagaaatttaatgctagaagaaaactaaagggtgccatcttgacaactatgctggctacaaggaatttctcagcagccaagagtttgttgaagaaaccagatggagtaaaggagtcaactgagagttcaaatacaacaattgaggatgaagatgtgaaagcacgaaagcaagagattatcaaagtcactgaacaactgatcgaagctatcaacaatggggactttgaagcctacacaaaaatctgtgacccaggccttactgcttttgaacctgaagctttgggtaatttagtggaagggatggattttcaccgattctactttgaaaatgctttgtccaaaagcaataaaccaatccacactattattctaaaccctcatgtacatctggtaggggatgatgccgcctgcatagcatatattaggctcacacagtacatggatggcagtggaatgccaaagacaatgcagtcagaagagactcgtgtgtggcaccgccgggatggaaagtggcagaatgttcattttcatcgctcggggtcaccaacagtacccatcaagtaaatatttccaggctgtcagcttctttgttaatacacccatggtcagctccttctacttattccattgttaatagcatggtatatgttatttaacgctagtagttggttacactgatgaaaataaatgccttcacgggaaaggtt

SEQ ID NO: 4254 - DNA, 2696 bp, Homo sapiens
gggctcaggctgtccgctctgggctccgcggcctcggccccgctgcactccacctccgccccctcggactccctcccctctgcttctactcctcctgctccagtgcggatcgtttcgcaactgcttgccactcgtcccgtgcctggctgtttttccatttcccggccccctcttcttgagtactttaccccctgcatttggggacagggactggaaaaggggcgggtggagcgtccagtggagaagaaggaagcgaggcccgcaggaggaggaggatcggcggactgtggggaggagaccccacgccaccctttctggtcatctcccctcccgccccgcccctgcgcacactccctcgcgggcgagctactttcggaccaggaaagtaagagcggccctgggtgacagcgccgcggggccagtcccggggttagccgcgcgtctgctcgcttctggtccgtcgcgctcccagccagggcacagcccggaccgaggatggcttcgaccacaacctgcaccaggttcacggacgagtatcagcttttcgaggagcttggaaagggggcattctcagtggtgagaagatgtatgaaaattcctactggacaagaatatgctgccaaaattatcaacaccaaaaagctttctgctagggatcatcagaaactagaaagagaagctagaatctgccgtcttttgaagcaccctaatattgtgcgacttcatgatagcatatcagaagagggctttcactacttggtgtttgatttagttactggaggtgaactgtttgaagacatagtggcaagagaatactacagtgaagctgatgccagtcattgtatacagcagattctagaaagtgttaatcattgtcacctaaatggcatagttcacagggacctgaagcctgagaatttgcttttagctagcaaatccaagggagcagctgtgaaattggcagactttggcttagccatagaagttcaaggggaccagcaggcgtggtttggttttgctggcacacctggatatctttctccagaagttttacgtaaagatccttatggaaagccagtggatatgtgggcatgtggtgtcattctctatattctacttgtggggtatccacccttctgggatgaagaccaacacagactctatcagcagatcaaggctggagcttatgattttccatcaccagaatgggacacggtgactcctgaagccaaagacctcatcaataaaatgcttactatcaaccctgccaaacgcatcacagcctcagaggcactgaagcacccatggatctgtcaacgttctactgttgcttccatgatgcacagacaggagactgtagactgcttgaagaaatttaatgctagaagaaaactaaagggtgccatcttgacaactatgctggctacaaggaatttctcagcagccaagagtttgttgaagaaaccagatggagtaaaggagccccaaactactgtaatccacaaccctgatggaaacaaggagtcaactgagagttcaaatacaacaattgaggatgaagatgtgaaagcacgaaagcaagagattatcaaagtcactgaacaactgatcgaagctatcaacaatggggactttgaagcctacacaaaaatctgtgacccaggccttactgcttttgaacctgaagctttgggtaatttagtggaagggatggattttcaccgattctactttgaaaatgctttgtccaaaagcaataaaccaatccacactattattctaaaccctcatgtacatctggtaggggatgatgccgcctgcatagcatatattaggctcacacagtacatggatggcagtggaatgccaaagacaatgcagtcagaagagactcgtgtgtggcaccgccgggatggaaagtggcagaatgttcattttcatcgctcggggtcaccaacagtacccatcaagtaaatatttccaggctgtcagcttctttgttaatacacccatggtcagctccttctacttattccattgttaatagcatggtatatgttatttaacgctagtagttggttacactgatgaaaataaatgccttcacgggaaaggtttatgattctctggaaagatcaatcagatcagccatttgtgggttgaaacttgctatagagcagtatatgataggtttagacaggacgagagactacgtgatcaaaatctcacagggttaaatctagaggacttgtataataaggcaaaatatttgtgacttcatcttctcaattgacagaagaaggggatatcagaggaaaacatagggaggagtttctaaaatggccaatatattatcaggagtttcatttcatagatgatcccctaaagctcagttagagagacagcatttaaaaggccattgtcaggtagtgcaatgtcattctcacctcaccactctacctcagatatcatttgcttttccagtcagcgattaggcacatatttattgtgaatcacctaggtgcttaatctgtgccagattcaacacaaagtacaagatattgctttcaagaaacatgtattctcatttagccaatcattgattctaaagaaaaaaatgatataataaagtttatcatcaacttcagaatacagtagagttaatgaacagtgtagtaaactgtttataacagttt

SEQ ID NO: 4255 - DNA, 5905 bp, Homo sapiens
aaaggagggagtgcgagagatccacgaagggacaggcttggagtcgctagagggaggtgtgggaccagcgaggagggggcttcgccagggagggggtgctggcaggcggagggagcggcgggaggaggcgccggaggaggagacggaggcctggggacggcagaagaggcttcgcctgagccgagcgctctttctctcgccgcgccgtcttgaagccgcgcgggctcgtgagcagcgcgaggccgccaaggtgcctcgcttcgccggagccgctgccgcccgccggagggaagccggcctcgggcgcgcacgctcgtcggagccccggcgcgccccgcgcctgagcctgctgacagcggccgctgggctcaggctgtccgctctgggctccgcggcctcggccccgctgcactccacctccgccccctcggactccctcccctctgcttctactcctcctgctccagtgcggatcgtttcgcaactgcttgccactcgtcccgtgcctggctgtttttccatttcccggccccctcttcttgagtactttaccccctgcatttggggacagggactggaaaaggggcgggtggagcgtccagtggagaagaaggaagcgaggcccgcaggaggaggaggatcggcggactgtggggaggagaccccacgccaccctttctggtcatctcccctcccgccccgcccctgcgcacactccctcgcgggcgagctactttcggaccaggaaagtaagagcggccctgggtgacagcgccgcggggccagtcccggggttagccgcgcgtctgctcgcttctggtccgtcgcgctcccagccagggcacagcccggaccgaggatggcttcgaccacaacctgcaccaggttcacggacgagtatcagcttttcgaggagcttggaaagggggcattctcagtggtgagaagatgtatgaaaattcctactggacaagaatatgctgccaaaattatcaacaccaaaaagctttctgctagggatcatcagaaactagaaagagaagctagaatctgccgtcttttgaagcaccctaatattgtgcgacttcatgatagcatatcagaagagggctttcactacttggtgtttgatttagttactggaggtgaactgtttgaagacatagtggcaagagaatactacagtgaagctgatgccagtcattgtatacagcagattctagaaagtgttaatcattgtcacctaaatggcatagttcacagggacctgaagcctgagaatttgcttttagctagcaaatccaagggagcagctgtgaaattggcagactttggcttagccatagaagttcaaggggaccagcaggcgtggtttggttttgctggcacacctggatatctttctccagaagttttacgtaaagatccttatggaaagccagtggatatgtgggcatgtggtgtcattctctatattctacttgtggggtatccacccttctgggatgaagaccaacacagactctatcagcagatcaaggctggagcttatgattttccatcaccagaatgggacacggtgactcctgaagccaaagacctcatcaataaaatgcttactatcaaccctgccaaacgcatcacagcctcagaggcactgaagcacccatggatctgtcaacgttctactgttgcttccatgatgcacagacaggagactgtagactgcttgaagaaatttaatgctagaagaaaactaaagggtgccatcttgacaactatgctggctacaaggaatttctcagcagccaagagtttgttgaagaaaccagatggagtaaagaaaaggaagtccagttcgagtgttcagatgatggagtcaactgagagttcaaatacaacaattgaggatgaagatgtgaaagcacgaaagcaagagattatcaaagtcactgaacaactgatcgaagctatcaacaatggggactttgaagcctacacaaaaatctgtgacccaggccttactgcttttgaacctgaagctttgggtaatttagtggaagggatggattttcaccgattctactttgaaaatgctttgtccaaaagcaataaaccaatccacactattattctaaaccctcatgtacatctggtaggggatgatgccgcctgcatagcatatattaggctcacacagtacatggatggcagtggaatgccaaagacaatgcagtcagaagagactcgtgtgtggcaccgccgggatggaaagtggcagaatgttcattttcatcgctcggggtcaccaacagtacccatcaagccaccctgtattccaaatgggaaagaaaacttctcaggaggcacctctttgtggcaaaacatctaaggcctgaaaaccattcacatatgggtcttctaaatttcaacagtgccacttctgcattctctgttctcaaggcacctggatggtgaccctgggccgtcctctcctcctcttcatgcatgtttctgagtgcatgaagttgtgaaggtcctacatgtaatgcatatgtgatgcatcatcttatcatatattccttcctatacattgtttacacttcaactacggggatgttccacacaaacttaaattactgttggcaaaacaatagggggagattagacaaaaaaaaaaatccacaatattccaagtacaactcttcatcaagtttctctgttaatgccaagatttaacagacttaagaactattgttctctgaatgacagttgtaagagaaatgtaaattttttagaactctttgctgttaatctgttttggtttgtttggtttttttttttttttttaaggtaaaaaaaaaatacaccttcagtttcctggtgtgatcctggttaaaatggatgatttttcattgaaagttttgctgattaacaattaaagtgggatgatatgtgggcaaaatcacttatgaaagtagaagcaagaatcagttggtttgctaccacataaagccatgctgtttttggtcaaactgtgtaaactggaaaaattcacatcatttctgagtttaatcactttaggatatattcacattgttttggtgaatttgctgaattgaattgtttttctttctcaaatctgtgatctcttttctttatcctgtttctttgttcctttcgtttgctttcttatttttcttttgttccattcttttcttacttttttcccttttccttttttggggaggctggctagtagtgtgtgagaaaagaatagaagtgaaatttgcataatgaatgtaaaagggaaataaaagtcttttgaaggtagctatactagcacttttgatcatcttcagggcccacaaaaatgttgtcaagattttaaaggtttataattctgcttaagctctagtttggacttaggtatcctaactatgttggaggtatttgcattgtttaaagttaggataaaagcaagttcctcctgtgactgcaacgtcttactgattgggacagttgccaggaggataccaacttgatagcagagggggttttatgcaaacgcactcacctccgccttggggaatgaaagggtcacttctgcatcatcactagctagttttctagtgttagagaggcttacaaatgtttgccattctcataagtgttttgaacttgatctttgtgacttgtgcttttttagcttctctcttgaatcagagtatcattgtcttcctccaaggagttagaatttcccagtttaaaacaaaaagggaaatgtcctaggttttctttgtgcttctcatttttcctttgttgattcaattcctgtgatttttgttctcttccctgaagtgctttacagtgcatggaatctccatcattgttattttaacgatagtaattcacagtcctcagaagcctatttttaaagcagaagcaaaaaagaaaaacaaaataacaaaaacaacccttcctcttttctctcatctcacctctctgtgttgattactaatcatcttagatattattgctagtggatgtatggtagatgggttgaagcttttctgataattattacacaatttaaaacaacatatatatttaaaataaatatatacagtaaatatattgagccatgttaacctgccaatgagatctgtgaaaaaataatggcctcatttttctctttttaatttcttttacccttttgtgaagcagctatacgtggcatacatgtatttaaagaaaaaaaaatagatgtagagtgttttttttacacttttaacttagcatgtggtgttgaagtattactgtagatcaagtttgtcttccgcactaagatgtgaggaaattgtgatttgttctctccaccacaaatgaattacacatttattatcttctatcattttgaaacactgcagtttaccatgggacactgtatatatttcttgccataatggtaaaggactgattgatatatttaagagttaataaatttgtgatttctgctgacagtgcgtccatctttatttcttcagaagaggtactgtatgtatgcctgcatagtgctggccagtgtcaagggcagtgtgtcctactctggtctcatttagtacataacaatttgcacttggtgagaatggcaagttaattgttctctgtgagcaaaacaatggtctcttctgggaaaatgttgctgagaacaatatagttaacaactaagactcctaaaagcttctctaaactgtaccctccaatccagccttcacatggctgctttttttttttttttttaatacgaacctgtccttgtaacactttgatgttatcatttctgggatacaggcaagcaccccagctcctgctactccccagcttgaacttgagcatacatggatgctcagcttcttttgatttgctaaaaacatcacacttgctcacatgcctgtttatgctgttcatgttgtttatgtttcttacctagaataaatagtctcttcccctacttcttttcccgacttcttactttttcctaagattcagtgtacagcatcatgctccacagcaaaccttcctaggccctattctgggcttgccttccctctcaaaacctacataatagattgtatttacctctcctgtcaaccacattgttttgaaaatatatttctatttgtgtctcctctactgcagtataatgtctccatgggcaagaactgtgtattcatcattgcattcctaaacccaaaccaaggccaggaatggagatatcattgataaatagttgttgaattgaggccaagcccttttgataacagaagcctcaaggggtacccagatagtccttgttttaatgatgggttctctcaccactgtcttgatgctctgagcaagttacctcttccctctgaccctcagtttccatatttgtaaaatgagaataaacataccaacttaataaagatattgtgaggattaatgggtacagagtgactagaatgatatttgatagaaattaaatggtagcagtataactattctgatcactgacattaatattcctattgttattattctttgctcacgagggtatacaactcttgttttgctgttgggctgccctctttatgtaggtttactgttaatgctgaggatatactcggactcaaatgtctcagcagaaggctgagagacaccaaatgaagtggtcatctagctgaatgtaggaaaaatgaaatgtagtagcaaatcagtatattctaaggaaattttcaaggaatattaatcttcacccaaattttgaatttttatgtaaaaaattataatttaagggtaaacatagatgacacagctttcgagtgatttcattgaataaaattctactgacttctatgaa

SEQ ID NO: 4256 - DNA, 5914 bp, Homo sapiens
aaaggagggagtgcgagagatccacgaagggacaggcttggagtcgctagagggaggtgtgggaccagcgaggagggggcttcgccagggagggggtgctggcaggcggagggagcggcgggaggaggcgccggaggaggagacggaggcctggggacggcagaagaggcttcgcctgagccgagcgctctttctctcgccgcgccgtcttgaagccgcgcgggctcgtgagcagcgcgaggccgccaaggtgcctcgcttcgccggagccgctgccgcccgccggagggaagccggcctcgggcgcgcacgctcgtcggagccccggcgcgccccgcgcctgagcctgctgacagcggccgctgggctcaggctgtccgctctgggctccgcggcctcggccccgctgcactccacctccgccccctcggactccctcccctctgcttctactcctcctgctccagtgcggatcgtttcgcaactgcttgccactcgtcccgtgcctggctgtttttccatttcccggccccctcttcttgagtactttaccccctgcatttggggacagggactggaaaaggggcgggtggagcgtccagtggagaagaaggaagcgaggcccgcaggaggaggaggatcggcggactgtggggaggagaccccacgccaccctttctggtcatctcccctcccgccccgcccctgcgcacactccctcgcgggcgagctactttcggaccaggaaagtaagagcggccctgggtgacagcgccgcggggccagtcccggggttagccgcgcgtctgctcgcttctggtccgtcgcgctcccagccagggcacagcccggaccgaggatggcttcgaccacaacctgcaccaggttcacggacgagtatcagcttttcgaggagcttggaaagggggcattctcagtggtgagaagatgtatgaaaattcctactggacaagaatatgctgccaaaattatcaacaccaaaaagctttctgctagggatcatcagaaactagaaagagaagctagaatctgccgtcttttgaagcaccctaatattgtgcgacttcatgatagcatatcagaagagggctttcactacttggtgtttgatttagttactggaggtgaactgtttgaagacatagtggcaagagaatactacagtgaagctgatgccagtcattgtatacagcagattctagaaagtgttaatcattgtcacctaaatggcatagttcacagggacctgaagcctgagaatttgcttttagctagcaaatccaagggagcagctgtgaaattggcagactttggcttagccatagaagttcaaggggaccagcaggcgtggtttggttttgctggcacacctggatatctttctccagaagttttacgtaaagatccttatggaaagccagtggatatgtgggcatgtggtgtcattctctatattctacttgtggggtatccacccttctgggatgaagaccaacacagactctatcagcagatcaaggctggagcttatgattttccatcaccagaatgggacacggtgactcctgaagccaaagacctcatcaataaaatgcttactatcaaccctgccaaacgcatcacagcctcagaggcactgaagcacccatggatctgtcaacgttctactgttgcttccatgatgcacagacaggagactgtagactgcttgaagaaatttaatgctagaagaaaactaaagggtgccatcttgacaactatgctggctacaaggaatttctcagcagccaagagtttgttgaagaaaccagatggagtaaaggagccccaaactactgtaatccacaaccctgatggaaacaaggagtcaactgagagttcaaatacaacaattgaggatgaagatgtgaaagcacgaaagcaagagattatcaaagtcactgaacaactgatcgaagctatcaacaatggggactttgaagcctacacaaaaatctgtgacccaggccttactgcttttgaacctgaagctttgggtaatttagtggaagggatggattttcaccgattctactttgaaaatgctttgtccaaaagcaataaaccaatccacactattattctaaaccctcatgtacatctggtaggggatgatgccgcctgcatagcatatattaggctcacacagtacatggatggcagtggaatgccaaagacaatgcagtcagaagagactcgtgtgtggcaccgccgggatggaaagtggcagaatgttcattttcatcgctcggggtcaccaacagtacccatcaagccaccctgtattccaaatgggaaagaaaacttctcaggaggcacctctttgtggcaaaacatctaaggcctgaaaaccattcacatatgggtcttctaaatttcaacagtgccacttctgcattctctgttctcaaggcacctggatggtgaccctgggccgtcctctcctcctcttcatgcatgtttctgagtgcatgaagttgtgaaggtcctacatgtaatgcatatgtgatgcatcatcttatcatatattccttcctatacattgtttacacttcaactacggggatgttccacacaaacttaaattactgttggcaaaacaatagggggagattagacaaaaaaaaaaatccacaatattccaagtacaactcttcatcaagtttctctgttaatgccaagatttaacagacttaagaactattgttctctgaatgacagttgtaagagaaatgtaaattttttagaactctttgctgttaatctgttttggtttgtttggtttttttttttttttttaaggtaaaaaaaaaatacaccttcagtttcctggtgtgatcctggttaaaatggatgatttttcattgaaagttttgctgattaacaattaaagtgggatgatatgtgggcaaaatcacttatgaaagtagaagcaagaatcagttggtttgctaccacataaagccatgctgtttttggtcaaactgtgtaaactggaaaaattcacatcatttctgagtttaatcactttaggatatattcacattgttttggtgaatttgctgaattgaattgtttttctttctcaaatctgtgatctcttttctttatcctgtttctttgttcctttcgtttgctttcttatttttcttttgttccattcttttcttacttttttcccttttccttttttggggaggctggctagtagtgtgtgagaaaagaatagaagtgaaatttgcataatgaatgtaaaagggaaataaaagtcttttgaaggtagctatactagcacttttgatcatcttcagggcccacaaaaatgttgtcaagattttaaaggtttataattctgcttaagctctagtttggacttaggtatcctaactatgttggaggtatttgcattgtttaaagttaggataaaagcaagttcctcctgtgactgcaacgtcttactgattgggacagttgccaggaggataccaacttgatagcagagggggttttatgcaaacgcactcacctccgccttggggaatgaaagggtcacttctgcatcatcactagctagttttctagtgttagagaggcttacaaatgtttgccattctcataagtgttttgaacttgatctttgtgacttgtgcttttttagcttctctcttgaatcagagtatcattgtcttcctccaaggagttagaatttcccagtttaaaacaaaaagggaaatgtcctaggttttctttgtgcttctcatttttcctttgttgattcaattcctgtgatttttgttctcttccctgaagtgctttacagtgcatggaatctccatcattgttattttaacgatagtaattcacagtcctcagaagcctatttttaaagcagaagcaaaaaagaaaaacaaaataacaaaaacaacccttcctcttttctctcatctcacctctctgtgttgattactaatcatcttagatattattgctagtggatgtatggtagatgggttgaagcttttctgataattattacacaatttaaaacaacatatatatttaaaataaatatatacagtaaatatattgagccatgttaacctgccaatgagatctgtgaaaaaataatggcctcatttttctctttttaatttcttttacccttttgtgaagcagctatacgtggcatacatgtatttaaagaaaaaaaaatagatgtagagtgttttttttacacttttaacttagcatgtggtgttgaagtattactgtagatcaagtttgtcttccgcactaagatgtgaggaaattgtgatttgttctctccaccacaaatgaattacacatttattatcttctatcattttgaaacactgcagtttaccatgggacactgtatatatttcttgccataatggtaaaggactgattgatatatttaagagttaataaatttgtgatttctgctgacagtgcgtccatctttatttcttcagaagaggtactgtatgtatgcctgcatagtgctggccagtgtcaagggcagtgtgtcctactctggtctcatttagtacataacaatttgcacttggtgagaatggcaagttaattgttctctgtgagcaaaacaatggtctcttctgggaaaatgttgctgagaacaatatagttaacaactaagactcctaaaagcttctctaaactgtaccctccaatccagccttcacatggctgctttttttttttttttttaatacgaacctgtccttgtaacactttgatgttatcatttctgggatacaggcaagcaccccagctcctgctactccccagcttgaacttgagcatacatggatgctcagcttcttttgatttgctaaaaacatcacacttgctcacatgcctgtttatgctgttcatgttgtttatgtttcttacctagaataaatagtctcttcccctacttcttttcccgacttcttactttttcctaagattcagtgtacagcatcatgctccacagcaaaccttcctaggccctattctgggcttgccttccctctcaaaacctacataatagattgtatttacctctcctgtcaaccacattgttttgaaaatatatttctatttgtgtctcctctactgcagtataatgtctccatgggcaagaactgtgtattcatcattgcattcctaaacccaaaccaaggccaggaatggagatatcattgataaatagttgttgaattgaggccaagcccttttgataacagaagcctcaaggggtacccagatagtccttgttttaatgatgggttctctcaccactgtcttgatgctctgagcaagttacctcttccctctgaccctcagtttccatatttgtaaaatgagaataaacataccaacttaataaagatattgtgaggattaatgggtacagagtgactagaatgatatttgatagaaattaaatggtagcagtataactattctgatcactgacattaatattcctattgttattattctttgctcacgagggtatacaactcttgttttgctgttgggctgccctctttatgtaggtttactgttaatgctgaggatatactcggactcaaatgtctcagcagaaggctgagagacaccaaatgaagtggtcatctagctgaatgtaggaaaaatgaaatgtagtagcaaatcagtatattctaaggaaattttcaaggaatattaatcttcacccaaattttgaatttttatgtaaaaaattataatttaagggtaaacatagatgacacagctttcgagtgatttcattgaataaaattctactgacttctatgaa

SEQ ID NO: 4257 - DNA, 5932 bp, Homo sapiens
aaaggagggagtgcgagagatccacgaagggacaggcttggagtcgctagagggaggtgtgggaccagcgaggagggggcttcgccagggagggggtgctggcaggcggagggagcggcgggaggaggcgccggaggaggagacggaggcctggggacggcagaagaggcttcgcctgagccgagcgctctttctctcgccgcgccgtcttgaagccgcgcgggctcgtgagcagcgcgaggccgccaaggtgcctcgcttcgccggagccgctgccgcccgccggagggaagccggcctcgggcgcgcacgctcgtcggagccccggcgcgccccgcgcctgagcctgctgacagcggccgctgggctcaggctgtccgctctgggctccgcggcctcggccccgctgcactccacctccgccccctcggactccctcccctctgcttctactcctcctgctccagtgcggatcgtttcgcaactgcttgccactcgtcccgtgcctggctgtttttccatttcccggccccctcttcttgagtactttaccccctgcatttggggacagggactggaaaaggggcgggtggagcgtccagtggagaagaaggaagcgaggcccgcaggaggaggaggatcggcggactgtggggaggagaccccacgccaccctttctggtcatctcccctcccgccccgcccctgcgcacactccctcgcgggcgagctactttcggaccaggaaagtaagagcggccctgggtgacagcgccgcggggccagtcccggggttagccgcgcgtctgctcgcttctggtccgtcgcgctcccagccagggcacagcccggaccgaggatggcttcgaccacaacctgcaccaggttcacggacgagtatcagcttttcgaggagcttggaaagggggcattctcagtggtgagaagatgtatgaaaattcctactggacaagaatatgctgccaaaattatcaacaccaaaaagctttctgctagggatcatcagaaactagaaagagaagctagaatctgccgtcttttgaagcaccctaatattgtgcgacttcatgatagcatatcagaagagggctttcactacttggtgtttgatttagttactggaggtgaactgtttgaagacatagtggcaagagaatactacagtgaagctgatgccagtcattgtatacagcagattctagaaagtgttaatcattgtcacctaaatggcatagttcacagggacctgaagcctgagaatttgcttttagctagcaaatccaagggagcagctgtgaaattggcagactttggcttagccatagaagttcaaggggaccagcaggcgtggtttggttttgctggcacacctggatatctttctccagaagttttacgtaaagatccttatggaaagccagtggatatgtgggcatgtggtgtcattctctatattctacttgtggggtatccacccttctgggatgaagaccaacacagactctatcagcagatcaaggctggagcttatgattttccatcaccagaatgggacacggtgactcctgaagccaaagacctcatcaataaaatgcttactatcaaccctgccaaacgcatcacagcctcagaggcactgaagcacccatggatctgtcaacgttctactgttgcttccatgatgcacagacaggagactgtagactgcttgaagaaatttaatgctagaagaaaactaaagggtgccatcttgacaactatgctggctacaaggaatttctcagcagccaagagtttgttgaagaaaccagatggagtaaagataaacaacaaagccaacgtggtaaccagccccaaagaaaatattcctaccccagcgctggagtcaactgagagttcaaatacaacaattgaggatgaagatgtgaaagcacgaaagcaagagattatcaaagtcactgaacaactgatcgaagctatcaacaatggggactttgaagcctacacaaaaatctgtgacccaggccttactgcttttgaacctgaagctttgggtaatttagtggaagggatggattttcaccgattctactttgaaaatgctttgtccaaaagcaataaaccaatccacactattattctaaaccctcatgtacatctggtaggggatgatgccgcctgcatagcatatattaggctcacacagtacatggatggcagtggaatgccaaagacaatgcagtcagaagagactcgtgtgtggcaccgccgggatggaaagtggcagaatgttcattttcatcgctcggggtcaccaacagtacccatcaagccaccctgtattccaaatgggaaagaaaacttctcaggaggcacctctttgtggcaaaacatctaaggcctgaaaaccattcacatatgggtcttctaaatttcaacagtgccacttctgcattctctgttctcaaggcacctggatggtgaccctgggccgtcctctcctcctcttcatgcatgtttctgagtgcatgaagttgtgaaggtcctacatgtaatgcatatgtgatgcatcatcttatcatatattccttcctatacattgtttacacttcaactacggggatgttccacacaaacttaaattactgttggcaaaacaatagggggagattagacaaaaaaaaaaatccacaatattccaagtacaactcttcatcaagtttctctgttaatgccaagatttaacagacttaagaactattgttctctgaatgacagttgtaagagaaatgtaaattttttagaactctttgctgttaatctgttttggtttgtttggtttttttttttttttttaaggtaaaaaaaaaatacaccttcagtttcctggtgtgatcctggttaaaatggatgatttttcattgaaagttttgctgattaacaattaaagtgggatgatatgtgggcaaaatcacttatgaaagtagaagcaagaatcagttggtttgctaccacataaagccatgctgtttttggtcaaactgtgtaaactggaaaaattcacatcatttctgagtttaatcactttaggatatattcacattgttttggtgaatttgctgaattgaattgtttttctttctcaaatctgtgatctcttttctttatcctgtttctttgttcctttcgtttgctttcttatttttcttttgttccattcttttcttacttttttcccttttccttttttggggaggctggctagtagtgtgtgagaaaagaatagaagtgaaatttgcataatgaatgtaaaagggaaataaaagtcttttgaaggtagctatactagcacttttgatcatcttcagggcccacaaaaatgttgtcaagattttaaaggtttataattctgcttaagctctagtttggacttaggtatcctaactatgttggaggtatttgcattgtttaaagttaggataaaagcaagttcctcctgtgactgcaacgtcttactgattgggacagttgccaggaggataccaacttgatagcagagggggttttatgcaaacgcactcacctccgccttggggaatgaaagggtcacttctgcatcatcactagctagttttctagtgttagagaggcttacaaatgtttgccattctcataagtgttttgaacttgatctttgtgacttgtgcttttttagcttctctcttgaatcagagtatcattgtcttcctccaaggagttagaatttcccagtttaaaacaaaaagggaaatgtcctaggttttctttgtgcttctcatttttcctttgttgattcaattcctgtgatttttgttctcttccctgaagtgctttacagtgcatggaatctccatcattgttattttaacgatagtaattcacagtcctcagaagcctatttttaaagcagaagcaaaaaagaaaaacaaaataacaaaaacaacccttcctcttttctctcatctcacctctctgtgttgattactaatcatcttagatattattgctagtggatgtatggtagatgggttgaagcttttctgataattattacacaatttaaaacaacatatatatttaaaataaatatatacagtaaatatattgagccatgttaacctgccaatgagatctgtgaaaaaataatggcctcatttttctctttttaatttcttttacccttttgtgaagcagctatacgtggcatacatgtatttaaagaaaaaaaaatagatgtagagtgttttttttacacttttaacttagcatgtggtgttgaagtattactgtagatcaagtttgtcttccgcactaagatgtgaggaaattgtgatttgttctctccaccacaaatgaattacacatttattatcttctatcattttgaaacactgcagtttaccatgggacactgtatatatttcttgccataatggtaaaggactgattgatatatttaagagttaataaatttgtgatttctgctgacagtgcgtccatctttatttcttcagaagaggtactgtatgtatgcctgcatagtgctggccagtgtcaagggcagtgtgtcctactctggtctcatttagtacataacaatttgcacttggtgagaatggcaagttaattgttctctgtgagcaaaacaatggtctcttctgggaaaatgttgctgagaacaatatagttaacaactaagactcctaaaagcttctctaaactgtaccctccaatccagccttcacatggctgctttttttttttttttttaatacgaacctgtccttgtaacactttgatgttatcatttctgggatacaggcaagcaccccagctcctgctactccccagcttgaacttgagcatacatggatgctcagcttcttttgatttgctaaaaacatcacacttgctcacatgcctgtttatgctgttcatgttgtttatgtttcttacctagaataaatagtctcttcccctacttcttttcccgacttcttactttttcctaagattcagtgtacagcatcatgctccacagcaaaccttcctaggccctattctgggcttgccttccctctcaaaacctacataatagattgtatttacctctcctgtcaaccacattgttttgaaaatatatttctatttgtgtctcctctactgcagtataatgtctccatgggcaagaactgtgtattcatcattgcattcctaaacccaaaccaaggccaggaatggagatatcattgataaatagttgttgaattgaggccaagcccttttgataacagaagcctcaaggggtacccagatagtccttgttttaatgatgggttctctcaccactgtcttgatgctctgagcaagttacctcttccctctgaccctcagtttccatatttgtaaaatgagaataaacataccaacttaataaagatattgtgaggattaatgggtacagagtgactagaatgatatttgatagaaattaaatggtagcagtataactattctgatcactgacattaatattcctattgttattattctttgctcacgagggtatacaactcttgttttgctgttgggctgccctctttatgtaggtttactgttaatgctgaggatatactcggactcaaatgtctcagcagaaggctgagagacaccaaatgaagtggtcatctagctgaatgtaggaaaaatgaaatgtagtagcaaatcagtatattctaaggaaattttcaaggaatattaatcttcacccaaattttgaatttttatgtaaaaaattataatttaagggtaaacatagatgacacagctttcgagtgatttcattgaataaaattctactgacttctatgaa

SEQ ID NO: 4258 - DNA, 5947 bp, Homo sapiens
aaaggagggagtgcgagagatccacgaagggacaggcttggagtcgctagagggaggtgtgggaccagcgaggagggggcttcgccagggagggggtgctggcaggcggagggagcggcgggaggaggcgccggaggaggagacggaggcctggggacggcagaagaggcttcgcctgagccgagcgctctttctctcgccgcgccgtcttgaagccgcgcgggctcgtgagcagcgcgaggccgccaaggtgcctcgcttcgccggagccgctgccgcccgccggagggaagccggcctcgggcgcgcacgctcgtcggagccccggcgcgccccgcgcctgagcctgctgacagcggccgctgggctcaggctgtccgctctgggctccgcggcctcggccccgctgcactccacctccgccccctcggactccctcccctctgcttctactcctcctgctccagtgcggatcgtttcgcaactgcttgccactcgtcccgtgcctggctgtttttccatttcccggccccctcttcttgagtactttaccccctgcatttggggacagggactggaaaaggggcgggtggagcgtccagtggagaagaaggaagcgaggcccgcaggaggaggaggatcggcggactgtggggaggagaccccacgccaccctttctggtcatctcccctcccgccccgcccctgcgcacactccctcgcgggcgagctactttcggaccaggaaagtaagagcggccctgggtgacagcgccgcggggccagtcccggggttagccgcgcgtctgctcgcttctggtccgtcgcgctcccagccagggcacagcccggaccgaggatggcttcgaccacaacctgcaccaggttcacggacgagtatcagcttttcgaggagcttggaaagggggcattctcagtggtgagaagatgtatgaaaattcctactggacaagaatatgctgccaaaattatcaacaccaaaaagctttctgctagggatcatcagaaactagaaagagaagctagaatctgccgtcttttgaagcaccctaatattgtgcgacttcatgatagcatatcagaagagggctttcactacttggtgtttgatttagttactggaggtgaactgtttgaagacatagtggcaagagaatactacagtgaagctgatgccagtcattgtatacagcagattctagaaagtgttaatcattgtcacctaaatggcatagttcacagggacctgaagcctgagaatttgcttttagctagcaaatccaagggagcagctgtgaaattggcagactttggcttagccatagaagttcaaggggaccagcaggcgtggtttggttttgctggcacacctggatatctttctccagaagttttacgtaaagatccttatggaaagccagtggatatgtgggcatgtggtgtcattctctatattctacttgtggggtatccacccttctgggatgaagaccaacacagactctatcagcagatcaaggctggagcttatgattttccatcaccagaatgggacacggtgactcctgaagccaaagacctcatcaataaaatgcttactatcaaccctgccaaacgcatcacagcctcagaggcactgaagcacccatggatctgtcaacgttctactgttgcttccatgatgcacagacaggagactgtagactgcttgaagaaatttaatgctagaagaaaactaaagggtgccatcttgacaactatgctggctacaaggaatttctcagcagccaagagtttgttgaagaaaccagatggagtaaagaaaaggaagtccagttcgagtgttcagatgatggagccccaaactactgtaatccacaaccctgatggaaacaaggagtcaactgagagttcaaatacaacaattgaggatgaagatgtgaaagcacgaaagcaagagattatcaaagtcactgaacaactgatcgaagctatcaacaatggggactttgaagcctacacaaaaatctgtgacccaggccttactgcttttgaacctgaagctttgggtaatttagtggaagggatggattttcaccgattctactttgaaaatgctttgtccaaaagcaataaaccaatccacactattattctaaaccctcatgtacatctggtaggggatgatgccgcctgcatagcatatattaggctcacacagtacatggatggcagtggaatgccaaagacaatgcagtcagaagagactcgtgtgtggcaccgccgggatggaaagtggcagaatgttcattttcatcgctcggggtcaccaacagtacccatcaagccaccctgtattccaaatgggaaagaaaacttctcaggaggcacctctttgtggcaaaacatctaaggcctgaaaaccattcacatatgggtcttctaaatttcaacagtgccacttctgcattctctgttctcaaggcacctggatggtgaccctgggccgtcctctcctcctcttcatgcatgtttctgagtgcatgaagttgtgaaggtcctacatgtaatgcatatgtgatgcatcatcttatcatatattccttcctatacattgtttacacttcaactacggggatgttccacacaaacttaaattactgttggcaaaacaatagggggagattagacaaaaaaaaaaatccacaatattccaagtacaactcttcatcaagtttctctgttaatgccaagatttaacagacttaagaactattgttctctgaatgacagttgtaagagaaatgtaaattttttagaactctttgctgttaatctgttttggtttgtttggtttttttttttttttttaaggtaaaaaaaaaatacaccttcagtttcctggtgtgatcctggttaaaatggatgatttttcattgaaagttttgctgattaacaattaaagtgggatgatatgtgggcaaaatcacttatgaaagtagaagcaagaatcagttggtttgctaccacataaagccatgctgtttttggtcaaactgtgtaaactggaaaaattcacatcatttctgagtttaatcactttaggatatattcacattgttttggtgaatttgctgaattgaattgtttttctttctcaaatctgtgatctcttttctttatcctgtttctttgttcctttcgtttgctttcttatttttcttttgttccattcttttcttacttttttcccttttccttttttggggaggctggctagtagtgtgtgagaaaagaatagaagtgaaatttgcataatgaatgtaaaagggaaataaaagtcttttgaaggtagctatactagcacttttgatcatcttcagggcccacaaaaatgttgtcaagattttaaaggtttataattctgcttaagctctagtttggacttaggtatcctaactatgttggaggtatttgcattgtttaaagttaggataaaagcaagttcctcctgtgactgcaacgtcttactgattgggacagttgccaggaggataccaacttgatagcagagggggttttatgcaaacgcactcacctccgccttggggaatgaaagggtcacttctgcatcatcactagctagttttctagtgttagagaggcttacaaatgtttgccattctcataagtgttttgaacttgatctttgtgacttgtgcttttttagcttctctcttgaatcagagtatcattgtcttcctccaaggagttagaatttcccagtttaaaacaaaaagggaaatgtcctaggttttctttgtgcttctcatttttcctttgttgattcaattcctgtgatttttgttctcttccctgaagtgctttacagtgcatggaatctccatcattgttattttaacgatagtaattcacagtcctcagaagcctatttttaaagcagaagcaaaaaagaaaaacaaaataacaaaaacaacccttcctcttttctctcatctcacctctctgtgttgattactaatcatcttagatattattgctagtggatgtatggtagatgggttgaagcttttctgataattattacacaatttaaaacaacatatatatttaaaataaatatatacagtaaatatattgagccatgttaacctgccaatgagatctgtgaaaaaataatggcctcatttttctctttttaatttcttttacccttttgtgaagcagctatacgtggcatacatgtatttaaagaaaaaaaaatagatgtagagtgttttttttacacttttaacttagcatgtggtgttgaagtattactgtagatcaagtttgtcttccgcactaagatgtgaggaaattgtgatttgttctctccaccacaaatgaattacacatttattatcttctatcattttgaaacactgcagtttaccatgggacactgtatatatttcttgccataatggtaaaggactgattgatatatttaagagttaataaatttgtgatttctgctgacagtgcgtccatctttatttcttcagaagaggtactgtatgtatgcctgcatagtgctggccagtgtcaagggcagtgtgtcctactctggtctcatttagtacataacaatttgcacttggtgagaatggcaagttaattgttctctgtgagcaaaacaatggtctcttctgggaaaatgttgctgagaacaatatagttaacaactaagactcctaaaagcttctctaaactgtaccctccaatccagccttcacatggctgctttttttttttttttttaatacgaacctgtccttgtaacactttgatgttatcatttctgggatacaggcaagcaccccagctcctgctactccccagcttgaacttgagcatacatggatgctcagcttcttttgatttgctaaaaacatcacacttgctcacatgcctgtttatgctgttcatgttgtttatgtttcttacctagaataaatagtctcttcccctacttcttttcccgacttcttactttttcctaagattcagtgtacagcatcatgctccacagcaaaccttcctaggccctattctgggcttgccttccctctcaaaacctacataatagattgtatttacctctcctgtcaaccacattgttttgaaaatatatttctatttgtgtctcctctactgcagtataatgtctccatgggcaagaactgtgtattcatcattgcattcctaaacccaaaccaaggccaggaatggagatatcattgataaatagttgttgaattgaggccaagcccttttgataacagaagcctcaaggggtacccagatagtccttgttttaatgatgggttctctcaccactgtcttgatgctctgagcaagttacctcttccctctgaccctcagtttccatatttgtaaaatgagaataaacataccaacttaataaagatattgtgaggattaatgggtacagagtgactagaatgatatttgatagaaattaaatggtagcagtataactattctgatcactgacattaatattcctattgttattattctttgctcacgagggtatacaactcttgttttgctgttgggctgccctctttatgtaggtttactgttaatgctgaggatatactcggactcaaatgtctcagcagaaggctgagagacaccaaatgaagtggtcatctagctgaatgtaggaaaaatgaaatgtagtagcaaatcagtatattctaaggaaattttcaaggaatattaatcttcacccaaattttgaatttttatgtaaaaaattataatttaagggtaaacatagatgacacagctttcgagtgatttcattgaataaaattctactgacttctatgaa

SEQ ID NO: 4259 - DNA, 1470 bp, Homo sapiens
atggcttcgaccacaacctgcaccaggttcacggacgagtatcagcttttcgaggagcttggaaagggggcattctcagtggtgagaagatgtatgaaaattcctactggacaagaatatgctgccaaaattatcaacaccaaaaagctttctgctagggatcatcagaaactagaaagagaagctagaatctgccgtcttttgaagcaccctaatattgtgcgacttcatgatagcatatcagaagagggctttcactacttggtgtttgatttagttactggaggtgaactgtttgaagacatagtggcaagagaatactacagtgaagctgatgccagtcattgtatacagcagattctagaaagtgttaatcattgtcacctaaatggcatagttcacagggacctgaagcctgagaatttgcttttagctagcaaatccaagggagcagctgtgaaattggcagactttggcttagccatagaagttcaaggggaccagcaggcgtggtttggttttgctggcacacctggatatctttctccagaagttttacgtaaagatccttatggaaagccagtggatatgtgggcatgtggtgtcattctctatattctacttgtggggtatccacccttctgggatgaagaccaacacagactctatcagcagatcaaggctggagcttatgattttccatcaccagaatgggacacggtgactcctgaagccaaagacctcatcaataaaatgcttactatcaaccctgccaaacgcatcacagcctcagaggcactgaagcacccatggatctgtcaacgttctactgttgcttccatgatgcacagacaggagactgtagactgcttgaagaaatttaatgctagaagaaaactaaagggtgccatcttgacaactatgctggctacaaggaatttctcagcagccaagagtttgttgaagaaaccagatggagtaaagaaaaggaagtccagttcgagtgttcagatgatggagtcaactgagagttcaaatacaacaattgaggatgaagatgtgaaagcacgaaagcaagagattatcaaagtcactgaacaactgatcgaagctatcaacaatggggactttgaagcctacacaaaaatctgtgacccaggccttactgcttttgaacctgaagctttgggtaatttagtggaagggatggattttcaccgattctactttgaaaatgctttgtccaaaagcaataaaccaatccacactattattctaaaccctcatgtacatctggtaggggatgatgccgcctgcatagcatatattaggctcacacagtacatggatggcagtggaatgccaaagacaatgcagtcagaagagactcgtgtgtggcaccgccgggatggaaagtggcagaatgttcattttcatcgctcggggtcaccaacagtacccatcaagtaa

SEQ ID NO: 4260 - DNA, 2142 bp, Homo sapiens
aagaaaactaaagggtgccatcttgacaactatgctggctacaaggaatttctcagcagccaagagtttgttgaagaaaccagatggagtaaaggagtcaactgagagttcaaatacaacaattgaggatgaagatgtgaaagcacgaaagcaagagattatcaaagtcactgaacaactgatcgaagctatcaacaatggggactttgaagcctacacaaaaatctgtgacccaggccttactgcttttgaacctgaagctttgggtaatttagtggaagggatggattttcaccgattctactttgaaaatgctttgtccaaaagcaataaaccaatccacactattattctaaaccctcatgtacatctggtaggggatgatgccgcctgcatagcatatattaggctcacacagtacatggatggcagtggaatgccaaagacaatgcagtcagaagagactcgtgtgtggcaccgccgggatggaaagtggcagaatgttcattttcatcgctcggggtcaccaacagtacccatcaagtaaatatttccaggctgtcagcttctttgttaatacacccatgctaaatttcaacagtgccacttctgcattctctgttctcaaggcacctggatggtgaccctgggccgtcctctcctcctcttcatgcatgtttctgagtgcatgaagttgtgaaggtcctacatgtaatgcatatgtgatgcatcatcttatcatatattccttcctatacattgtttacacttcaactacggggatgttccacacaaacttaaattactgttggcaaaacaatagggggagattagacaaaaaaaaaaatccacaatattccaagtacaactcttcatcaagtttctctgttaatgccaagatttaacagacttaagaactattgttctctgaatgacagttgtaagagaaatgtaaattttttagaactctttgctgttaatctgttttggtttgtttggtttttttttttttttttaaggtaaaaaaaaaatacaccttcagtttcctggtgtgatcctggttaaaatggatgatttttcattgaaagttttgctgattaacaattaaagtgggatgatatgtgggcaaaatcacttatgaaagtagaagcaagaatcagttggtttgctaccacataaagccatgctgtttttggtcaaactgtgtaaactggaaaaattcacatcatttctgagtttaatcactttaggatatattcacattgttttggtgaatttgctgaattgaattgtttttctttctcaaatctgtgatctcttttctttatcctgtttctttgttcctttcgtttgctttcttatttttcttttgttccattcttttcttacttttttcccttttccttttttggggaggctggctagtagtgtgtgagaaaagaatagaagtgaaatttgcataatgaatgtaaaagggaaataaaagtcttttgaaggtagctatactagcacttttgatcatcttcagggcccacaaaaatgttgtcaagattttaaaggtttataattctgcttaagctctagtttggacttaggtatcctaactatgttggaggtatttgcattgtttaaagttaggataaaagcaagttcctcctgtgactgcaacgtcttactgattgggacagttgccaggaggataccaacttgatagcagagggggttttatgcaaacgcactcacctccgccttggggaatgaaagggtcacttctgcatcatcactagctagttttctagtgttagagaggcttacaaatgtttgccattctcataagtgttttgaacttgatctttgtgacttgtgcttttttagcttctctcttgaatcagagtatcattgtcttcctccaaggagttagaatttcccagtttaaaacaaaaagggaaatgtcctaggttttctttgtgcttctcatttttcctttgttgattcaattcctgtgatttttgttctcttccctgaagtgctttacagtgcatggaatctccatcattgttattttaacgatagtaattcacagtcctcagaagcctatttttaaagcagaagcaaaaaagaaaaacaaaataacaaaaacaa

SEQ ID NO: 4261 - DNA, 5294 bp, Homo sapiens
aactgcttgccactcgtcccgtgcctggctgtttttccatttcccggccccctcttcttgagtactttaccccctgcatttggggacagggactggaaaaggggcgggtggagcgtccagtggagaagaaggaagcgaggcccgcaggaggaggaggatcggcggactgtggggaggagaccccacgccaccctttctggtcatctcccctcccgccccgcccctgcgcacactccctcgcgggcgagctactttcggaccaggaaagtaagagcggccctgggtgacagcgccgcggggccagtcccggggttagccgcgcgtctgctcgcttctggtccgtcgcgctcccagccagggcacagcccggaccgaggatggcttcgaccacaacctgcaccaggttcacggacgagtatcagcttttcgaggagcttggaaagggggcattctcagtggtgagaagatgtatgaaaattcctactggacaagaatatgctgccaaaattatcaacaccaaaaagctttctgctagggatcatcagaaactagaaagagaagctagaatctgccgtcttttgaagcaccctaatattgtgcgacttcatgatagcatatcagaagagggctttcactacttggtgtttgatttagttactggaggtgaactgtttgaagacatagtggcaagagaatactacagtgaagctgatgccagtcattgtatacagcagattctagaaagtgttaatcattgtcacctaaatggcatagttcacagggacctgaagcctgagaatttgcttttagctagcaaatccaagggagcagctgtgaaattggcagactttggcttagccatagaagttcaaggggaccagcaggcgtggtttggttttgctggcacacctggatatctttctccagaagttttacgtaaagatccttatggaaagccagtggatatgtgggcatgtggtgtcattctctatattctacttgtggggtatccacccttctgggatgaagaccaacacagactctatcagcagatcaaggctggagcttatgattttccatcaccagaatgggacacggtgactcctgaagccaaagacctcatcaataaaatgcttactatcaaccctgccaaacgcatcacagcctcagaggcactgaagcacccatggatctgtcaacgttctactgttgcttccatgatgcacagacaggagactgtagactgcttgaagaaatttaatgctagaagaaaactaaagggtgccatcttgacaactatgctggctacaaggaatttctcagcagccaagagtttgttgaagaaaccagatggagtaaaggagtcaactgagagttcaaatacaacaattgaggatgaagatgtgaaagcacgaaagcaagagattatcaaagtcactgaacaactgatcgaagctatcaacaatggggactttgaagcctacacaaaaatctgtgacccaggccttactgcttttgaacctgaagctttgggtaatttagtggaagggatggattttcaccgattctactttgaaaatgctttgtccaaaagcaataaaccaatccacactattattctaaaccctcatgtacatctggtaggggatgatgccgcctgcatagcatatattaggctcacacagtacatggatggcagtggaatgccaaagacaatgcagtcagaagagactcgtgtgtggcaccgccgggatggaaagtggcagaatgttcattttcatcgctcggggtcaccaacagtacccatcaactaaatttcaacagtgccacttctgcattctctgttctcaaggcacctggatggtgaccctgggccgtcctctcctcctcttcatgcatgtttctgagtgcatgaagttgtgaaggtcctacatgtaatgcatatgtgatgcatcatcttatcatatattccttcctatacattgtttacacttcaactacggggatgttccacacaaacttaaattactgttggcaaaacaatagggggagattagacaaaaaaaaaaatccacaatattccaagtacaactcttcatcaagtttctctgttaatgccaagatttaacagacttaagaactattgttctctgaatgacagttgtaagagaaatgtaaattttttagaactctttgctgttaatctgttttggtttgtttggtttttttttttttttttaaggtaaaaaaaaaatacaccttcagtttcctggtgtgatcctggttaaaatggatgatttttcattgaaagttttgctgattaacaattaaagtgggatgatatgtgggcaaaatcacttatgaaagtagaagcaagaatcagttggtttgctaccacataaagccatgctgtttttggtcaaactgtgtaaactggaaaaattcacatcatttctgagtttaatcactttaggatatattcacattgttttggtgaatttgctgaattgaattgtttttctttctcaaatctgtgatctcttttctttatcctgtttctttgttcctttcgtttgctttcttatttttcttttgttccattcttttcttacttttttcccttttccttttttggggaggctggctagtagtgtgtgagaaaagaatagaagtgaaatttgcataatgaatgtaaaagggaaataaaagtcttttgaaggtagctatactagcacttttgatcatcttcagggcccacaaaaatgttgtcaagattttaaaggtttataattctgcttaagctctagtttggacttaggtatcctaactatgttggaggtatttgcattgtttaaagttaggataaaagcaagttcctcctgtgactgcaacgtcttactgattgggacagttgccaggaggataccaacttgatagcagagggggttttatgcaaacgcactcacctccgccttggggaatgaaagggtcacttctgcatcatcactagctagttttctagtgttagagaggcttacaaatgtttgccattctcataagtgttttgaacttgatctttgtgacttgtgcttttttagcttctctcttgaatcagagtatcattgtcttcctccaaggagttagaatttcccagtttaaaacaaaaagggaaatgtcctaggttttctttgtgcttctcatttttcctttgttgattcaattcctgtgatttttgttctcttccctgaagtgctttacagtgcatggaatctccatcattgttattttaacgatagtaattcacagtcctcagaagcctatttttaaagcagaagcaaaaaagaaaaacaaaataacaaaaacaacccttcctcttttctctcatctcacctctctgtgttgattactaatcatcttagatattattgctagtggatgtatggtagatgggttgaagcttttctgataattattacacaatttaaaacaacatatatatttaaaataaatatatacagtaaatatattgagccatgttaacctgccaatgagatctgtgaaaaaataatggcctcatttttctctttttaatttcttttacccttttgtgaagcagctatacgtggcatacatgtatttaaagaaaaaaaaatagatgtagagtgttttttttacacttttaacttagcatgtggtgttgaagtattactgtagatcaagtttgtcttccgcactaagatgtgaggaaattgtgatttgttctctccaccacaaatgaattacacatttattatcttctatcattttgaaacactgcagtttaccatgggacactgtatatatttcttgccataatggtaaaggactgattgatatatttaagagttaataaatttgtgatttctgctgacagtgcgtccatctttatttcttcagaagaggtactgtatgtatgcctgcatagtgctggccagtgtcaagggcagtgtgtcctactctggtctcatttagtacataacaatttgcacttggtgagaatggcaagttaattgttctctgtgagcaaaacaatggtctcttctgggaaaatgttgctgagaacaatatagttaacaactaagactcctaaaagcttctctaaactgtaccctccaatccagccttcacatggctgctttttttttttttttttaatacgaacctgtccttgtaacactttgatgttatcatttctgggatacaggcaagcaccccagctcctgctactccccagcttgaacttgagcatacatggatgctcagcttcttttgatttgctaaaaacatcacacttgctcacatgcctgtttatgctgttcatgttgtttatgtttcttacctagaataaatagtctcttcccctacttcttttcccgacttcttactttttcctaagattcagtgtacagcatcatgctccacagcaaaccttcctaggccctattctgggcttgccttccctctcaaaacctacataatagattgtatttacctctcctgtcaaccacattgttttgaaaatatatttctatttgtgtctcctctactgcagtataatgtctccatgggcaagaactgtgtattcatcattgcattcctaaacccaaaccaaggccaggaatggagatatcattgataaatagttgttgaattgaggccaagcccttttgataacagaagcctcaaggggtacccagatagtccttgttttaatgatgggttctctcaccactgtcttgatgctctgagcaagttacctcttccctctgaccctcagtttccatatttgtaaaatgagaataaacataccaacttaataaagatattgtgaggattaatgggtacagagtgactagaatgatatttgatagaaattaaatggtagcagtataactattctgatcactgacattaatattcctattgttattattctttgctcacgagggtatacaactcttgttttgctgttgggctgccctctttatgtaggtttactgttaatgctgaggatatactcggactcaaatgtctcagcagaaggctgagagacaccaaatgaagtggtcatctagctgaatgtaggaaaaatgaaatgtagtagcaaatcagtatattctaaggaaattttcaaggaatattaatcttcacccaaattttgaatttttatgtaaaaaattataatttaagggtaaacatagatgacacagctttcgagtgatttcattgaataaaattctactgacttctatgaa

SEQ ID NO: 4262 - DNA, 1820 bp, Homo sapiens
atggccaccaccgccacctgcacccgtttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagctgccaaaagcctattgaacaagaagtcggatggcggtgtcaagaaaaggaagtcgagttccagcgtgcacctaatgccacagagcaacaacaaaaacagtctcgtaagcccagcccaagagcccgcgcccttgcagacggccatggagccacaaaccactgtggtacacaacgctacagatgggatcaagggctccacagagagctgcaacaccaccacagaagatgaggacctcaaagtgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaa

SEQ ID NO: 4263 - DNA, 3720 bp, Homo sapiens
agtctcgcggtgctgccgggctcagccccgtctcctcctcttgctccctcggccgggcggcggtgactgtgcaccgacgtcggcgcgggctgcaccgccgcgtccgcccgcccgccagcatggccaccaccgccacctgcacccgtttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagttggcaggcagagctccgcccccgcctcgcctgccgcgagcgccgccggcctggccgggcaagctgccaaaagcctattgaacaagaagtcggatggcggtgtcaagaaaaggaagtcgagttccagcgtgcacctaatggagccacaaaccactgtggtacacaacgctacagatgggatcaagggctccacagagagctgcaacaccaccacagaagatgaggacctcaaagtgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtc

SEQ ID NO: 4264 - DNA, 3812 bp, Homo sapiens
ggtaaagtctcgcggtgctgccgggctcagccccgtctcctcctcttgctccctcggccgggcggcggtgactgtgcaccgacgtcggcgcgggctgcaccgccgcgtccgcccgcccgccagcatggccaccaccgccacctgcacccgtttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagctgccaaaagcctattgaacaagaagtcggatggcggtgtcaagccacagagcaacaacaaaaacagtctcgtaagcccagcccaagagcccgcgcccttgcagacggccatggagccacaaaccactgtggtacacaacgctacagatgggatcaagggctccacagagagctgcaacaccaccacagaagatgaggacctcaaagctgccccgctccgcactgggaatggcagctcggtgcctgaaggacggagctcccgggacagaacagccccctctgcaggcatgcagccccagccttctctctgctcctcagccatgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtc

SEQ ID NO: 4265 - DNA, 3563 bp, Homo sapiens
ggtgactgtgcaccgacgtcggcgcgggctgcaccgccgcgtccgcccgcccgccagcatggccaccaccgccacctgcacccgtttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagctgccaaaagcctattgaacaagaagtcggatggcggtgtcaaggagccacaaaccactgtggtacacaacgctacagatgggatcaagggctccacagagagctgcaacaccaccacagaagatgaggacctcaaagtgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtc

SEQ ID NO: 4266 - DNA, 1822 bp, Homo sapiens
gtcggcgcgggctgcaccgccgcgtccgcccgcccgccagcatggccaccaccgccacctgcacccgtttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagttggcaggcagagctccgcccccgcctcgcctgccgcgagcgccgccggcctggccgggcaagctgccaaaagcctattgaacaagaagtcggatggcggtgtcaaggagccacaaaccactgtggtacacaacgctacagatgggatcaagggctccacagagagctgcaacaccaccacagaagatgaggacctcaaagtgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaa

SEQ ID NO: 4267 - DNA, 3743 bp, Homo sapiens
ggtaaagtctcgcggtgctgccgggctcagccccgtctcctcctcttgctccctcggccgggcggcggtgactgtgcaccgacgtcggcgcgggctgcaccgccgcgtccgcccgcccgccagcatggccaccaccgccacctgcacccgtttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagctgccaaaagcctattgaacaagaagtcggatggcggtgtcaaggagccacaaaccactgtggtacacaacgctacagatgggatcaagggctccacagagagctgcaacaccaccacagaagatgaggacctcaaagctgccccgctccgcactgggaatggcagctcggtgcctgaaggacggagctcccgggacagaacagccccctctgcaggcatgcagccccagccttctctctgctcctcagccatgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtc

SEQ ID NO: 4268 - DNA, 3818 bp, Homo sapiens
ggtaaagtctcgcggtgctgccgggctcagccccgtctcctcctcttgctccctcggccgggcggcggtgactgtgcaccgacgtcggcgcgggctgcaccgccgcgtccgcccgcccgccagcatggccaccaccgccacctgcacccgtttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagctgccaaaagcctattgaacaagaagtcggatggcggtgtcaagaaaaggaagtcgagttccagcgtgcacctaatgccacagagcaacaacaaaaacagtctcgtaagcccagcccaagagcccgcgcccttgcagacggccatggagccacaaaccactgtggtacacaacgctacagatgggatcaagggctccacagagagctgcaacaccaccacagaagatgaggacctcaaaggctcggtgcctgaaggacggagctcccgggacagaacagccccctctgcaggcatgcagccccagccttctctctgctcctcagccatgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtc

SEQ ID NO: 4269 - DNA, 3908 bp, Homo sapiens
ggtaaagtctcgcggtgctgccgggctcagccccgtctcctcctcttgctccctcggccgggcggcggtgactgtgcaccgacgtcggcgcgggctgcaccgccgcgtccgcccgcccgccagcatggccaccaccgccacctgcacccgtttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagttggcaggcagagctccgcccccgcctcgcctgccgcgagcgccgccggcctggccgggcaagctgccaaaagcctattgaacaagaagtcggatggcggtgtcaagaaaaggaagtcgagttccagcgtgcacctaatgccacagagcaacaacaaaaacagtctcgtaagcccagcccaagagcccgcgcccttgcagacggccatggagccacaaaccactgtggtacacaacgctacagatgggatcaagggctccacagagagctgcaacaccaccacagaagatgaggacctcaaagctgccccgctccgcactgggaatggcagctcggtgcctgaaggacggagctcccgggacagaacagccccctctgcaggcatgcagccccagccttctctctgctcctcagccatgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtc

SEQ ID NO: 4270 - DNA, 1618 bp, Homo sapiens
cgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagctgccaaaagcctattgaacaagaagtcggatggcggtgtcaagccacagagcaacaacaaaaacagtctcgtaagcccagcccaagagcccgcgcccttgcagacggccatggagccacaaaccactgtggtacacaacgctacagatgggatcaagggctccacagagagctgcaacaccaccacagaagatgaggacctcaaagtgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaagaaaaaaagattgtttaaaaaaaaaa

SEQ ID NO: 4271 - DNA, 1224 bp, Homo sapiens
gtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagctgccaaaagcctattgaacaagaagtcggatggcggtgtcaagccacagagcaacaacaaaaacagtctcgtaagcccagcccaagagcccgcgcccttgcagacggccatggagccacaaaccactgtggtacacaacgctacagatgggatcaagggctccacagagagctgcaacaccaccacagaagatgaggacctcaaagctgccccgctccgcactgggaatggcagctcggtgcctgaaggacggagctcccgggacagaacagccccctctgcaggcatgcagccccagccttctctctgctcctcagccatgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaag

SEQ ID NO: 4272 - DNA, 1092 bp, Homo sapiens
aaagtctcgcggtgctgccgggctcagccccgtctcctcctcttgctccctcggccgggcggcggtgactgtgcaccgacgtcggcgcgggctgcaccgccgcgtccgcccgcccgccagcatggccaccaccgccacctgcacccgtttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgcaacgatccacggtggcatccatgatgcatcgtcaggagactgtggagtgtttgcgcaagttcaatgcccggagaaaactgaagggtgccatcctcacgaccatgcttgtctccaggaacttctcagctgccaaaagcctattgaacaagaagtcggatggcggtgtcaagccacagagcaacaacaaaaacagtctcgtaagcccagcccaagagcccgcgcccttgcagacggccatggagccacaaaccactgtggtacacaacgctacagatgggatcaagggctccacagagagctgcaacaccaccacagaagatgaggacctcaaagctcggtgcctgaaggacggagctcccgggacagaacagccccctctgcaggcatgcagccccagccttctctctgctcctcagccattacgtctgtgctggaggatgcctttgtctgctgcttttcctcccaccatctatccttgcagagtttctaagcacaaccctcttcgcccgtggggccccagtcaggtcatccagatgggtctggtggggttggagagggtgtgtgtgttgtgggtgcacacctgcctgctgcttttggaagccgatcgaactccttgcttcccttaacctgctgcttgctcacctggagctgtggcctagcggggctgacggctgtggggccccctcctggatgtgcctttggctgcgctgccctgtcccaactgtgctgcttggctgtgctggcccggct

SEQ ID NO: 4273 - DNA, 1362 bp, Homo sapiens
cggcccgggaggcggaggcgcgggggaggaggccccgcttggctcctcagccccggatgctgcatgacttcatccttccgccggctcccctgctgaggtagggccggtccggcagcaagcccgccgcccgcgccccgccgcagtcccgctcccgccccgcgcccaccccgcgcccgccatgtccgagatcctgccctacagcgaagacaagatgggccgcttcggcgcagaccccgagggctccgacctctccttcagctgccgcctgcaggacaccaactccttcttcgcgggcaaccaggccaagcgaccccccaagctgggccagatcggccgagccaagcgagtggtgatcgaggatgaccggatagacgacgtgctgaaggggatgggggagaagccgccgtccggagtgtagacgcgccggctcgggcggcgggctccgggcccagcctcgcagcggccaggagcgcgggccggcgatgcggctgccggcgcccccccgccccggcccaggcgcccgcgggcgggggctgcagggccgtgccgccgccgccgccaggcactccggagctgtccgcttcagcaccacggcggccgcggtagcggcggcgcggacccgcccggaacccgccgccgcgctcatgcactttaaaacctcgggccgcagccccaccccgcacaccggaacggacacggagacccgcggcccccagcccccggcccgccccctcccgcacggctcccctgccccgcccccctccggccagtctggtctgcagaccgggcggccgccggtgtcggaccgcgcgcggccagggatgtttggctgcgtacttgcatgagctttccacccacttgagcccagtcctccgggccgttcctcgcccccacccctgtctggcgtgaccccagcctcagcctctttctaagggacttcctcagcacatttgtatttttatatccgactctttgtttactggctctgctcatggttcctgccctcccctcagtctcggccacgctcttctgcgcctggcagataggatgggtgttgaggctgggatgagacaagcccccgacacggttaccaaccacatggccagtctgcccaggcctgaccccaggaggctttctggcagaccccttctccccaaggtatcatcaccttccaagggcccagatccgattttaccttggacccctgcgtcttgcccctgggaacccaaatggggactgctctgaacctttggatgacatctgtggccccggagatgttctcaacccaggggtgcccttcgtaaatgttcctccatcctcactgtaccaggagtgtgtgaataaacacagaccccctctgtg

SEQ ID NO: 4274 - DNA, 12240 bp, Homo sapiens
aagctccagcatccggagccgccctagccggcaccgcggcagccacagcctgggagagagaaaggaaagagggagggcggcgggaaaggctcggcgcgggaggagggcgggtgaggagggaaggagcgagggggagggagcctctctcctcagcggtgcagctagtctccctccagcgggcggcgactccgggttccccctcgcgccctctcgcagaggctcgcccccttccccgcccaccgtccctgcgagcgcgggcggcggcggtgggcgtgtgcgcgcgtgaaggacgccgcctctctctcgctcctgcgttcgcaggcggcggctggcggccggcttctcgctcgggcagcggcggcggcggcggcggcggcttccggagtcccgctgcgaagatgctcaaagtcacggtgccctcctgctccgcctcgtcctgctcttcggtcaccgccagtgcggccccggggaccgcgagcctcgtcccggattactggatcgacggctccaacagggatgcgctgagcgatttcttcgaggtggagtcggagctgggacggggtgctacatccattgtgtacagatgcaaacagaaggggacccagaagccttatgctctcaaagtgttaaagaaaacagtggacaaaaaaatcgtaagaactgagataggagttcttcttcgcctctcacatccaaacattataaaacttaaagagatatttgaaacccctacagaaatcagtctggtcctagaactcgtcacaggaggagaactgtttgataggattgtggaaaagggatattacagtgagcgagatgctgcagatgccgttaaacaaatcctggaggcagttgcttatctacatgaaaatgggattgtccatcgtgatctcaaaccagagaatcttctttatgcaactccagccccagatgcaccactcaaaatcgctgattttggactctctaaaattgtggaacatcaagtgctcatgaagacagtatgtggaaccccagggtactgcgcacctgaaattcttagaggttgtgcctatggacctgaggtggacatgtggtctgtaggaataatcacctacatcttactttgtggatttgaaccattctatgatgaaagaggcgatcagttcatgttcaggagaattctgaattgtgaatattactttatctccccctggtgggatgaagtatctctaaatgccaaggacttggtcagaaaattaattgttttggatccaaagaaacggctgactacatttcaagctctccagcatccgtgggtcacaggtaaagcagccaattttgtacacatggataccgctcaaaagaagctccaagaattcaatgcccggcgtaagcttaaggcagcggtgaaggctgtggtggcctcttcgcgcctgggaagtgccagcagcagccatggcagcatccaggagagccacaaggctagccgagacccttctccaatccaagatggcaacgaggacatgaaagctattccagaaggagagaaaattcaaggcgatggggcccaagccgcagttaagggggcacaggctgagctgatgaaggtgcaagccttagagaaagttaaaggtgcagatataaatgctgaagaggcccccaaaatggtgcccaaggcagtggaggatgggataaaggtggctgacctggaactagaggagggcctagcagaggagaagctgaagactgtggaggaggcagcagctcccagagaagggcaaggaagctctgctgtgggttttgaagttccacagcaagatgtgatcctgccagagtactaaacagcttccttcagatctggaagccaaacaccggcattttatgtactttgtccttcagcaagaaaggtgtggaagcatgatatgtactatagtgattctgtttttgaggtgcaaaaaacatacatatataccagttggtaattctaacttcaatgcatgtgactgctttatgaaaataatagtgtcttctatggcatgtaatggatacctaataccgatgagttaaatcttgcaagttaacacaacgtaacacttaaaagcatacattttcagcaaccagtggcacatatttgaagtgaatagtagcaaattgtttttgctttgaaaatctagccatcctacatcctttggatttcttcacaaggcagtaattcctttgaactactgcttagctaatactaggtagtgctaaaagacatgttcccataacttttacaacattttactttttatcattgatgtgttcaaactgtttacaaggagatgcttatagatgatagttgtacatatgtgcaaaaaaaaatccacttgcaatggtaagaaattgaagtatccttaaaggccatgaagccatatgtccctaaagcctgtgtggagaatgctttattttattcttatttatatacactatattaataataaccaaaatgttctaagattctgccattttacaaccctggaggaagtaatttacaaactcacgctgagttccattctttccttcacctgctctccaataagatgactttctgatagacaaagcttagggtgtaataaacagggaagaaaagaaggtaagactgtacttaaactgatgaagataagattgattccttttcattttccagataaaattgtatttactcatgaatttatacaactttacagataagaacattttaatggataaactctataattaccaagttgcaaatatttagaaaattctatttcacaggttagtgccaaaatgtcttcatagagtaggaataatattccattttaagattattcattattgactttaatagagtaagaaaacattattgtttatcaaagctctttttttatccaattgatggttatctacacatatcacttataaactaaagttatttatgaaaagctagtatgtctttttctcgtatttggaatgaaagtacccacattttacaatgtagtgttgagaatgtggctgccaataaatttagcacaatgcaatttatttaccttaaaaaacaaacaaaaacaaaaataaagaaaaatactgatttcaaatcagactcttaaaaagctggaacattagacctgatattttattatgatttttcccagaataagtttaatttctctttgactttcatagaaacactttccccttatagaaattgcactatctccaatttatttctagtttgagttgaaatgaatattttatcagattaattatgtgtcacatttttggtgggttttctcaattttaaaaaagaattcattttaaaaaataattattttcagagaccaaataaagacaataaaaatgactatcacataaaaatccttgttaaaaaagagatcttaaattatgttggctctccctcaaaactattaaattagaaaacgaaactaaagctccagtttgtagaggctgttggacctcagtagacattcttcttttcaatcacaaatctctctctactactgttctcatgggaagaaaacaaggtaggacttcttatctttcatagtttaagaatctgacaggtcactgatatggagcccctgaagaagcacatcatctgggctcagaagattattttttgttttgttttatttgtactatctagtagagagcacttttcttattccctctttccttccttcctcatttaattattccctctcagaattcccatgttgtccattataaggggctcgctatttttaacctttaagaatgtcttctttgttaagcattaagatttccatttaagaggatcaatttcctgttgtactttttaccatgagactgaaacacacacacacacacacacacacacacacacacacacacacgtgttggaagagcaaagagagggaagggggtctttttagaaagtggcacttggcgcttagctgaaagatcagaacacatcattcctccctgcccacccccatattgttccaagggcagttgttacattatttcaacactagagtagggcggactgcattgtttggccctgagaactatagaaacaacgttgcaaataccatgcccaatgtgtattttagaatttactcatttaaatgagtgcatattaccattcctccatgtgagtactcgagttgataattccctctatctttttaaacccataaactacatttttaaaaaaatcaatgggagttttaaattttgactcatgttaaagataagattctgataatgactatatagtgactaatttcattgtttcagtaggaaacaaatcaaactttcaaaaatgttggtcatttcagtcaaattattcaaagatttcatatacatacatcctaagttaggataattatgttaacatttttgaaagaacagccaatgtttatattgcttgttaaaatggaatgtattgtctatctcaaagattacttagctaaataatagtagacaaatggagatttaatttcacaaaatacttcataacatcactcctaattggcaatatagtcacaaagcaaaagaattcaaatttcagcaaacaataaattacattttacattttagagctaacacttatcacattacattatgggtttttattttgagataagttcagctacatagcataaactaggtttttttttataaccatgaaggacagtcttgaattatttcccccattaacaaagtctaattggaatccagtattttttctcaaactgtaatttcacttgtcccaggacacataaataggtaaaaattagaataatatcgtggtagaagttaattgtccagaacaagtgcattatataaatataatgcaagcacatgtcatttaagattttctattagtcacattttaagaaaaatagatgaaagtatagtatttttaatccaattcatccaaattattctatcgatatatagtcaatattaaaatttaatgtgatattttgaattctttatttttatactgttttcaaaatcaagagtgtatgttaggcctttgggacatcaagtgctcaatagtcacatgtggctagtggctaccatattagacagcactagtctagagtactttttattttaagcaaagtgacacttgaagttctatgcttagatttaagtggcctcagttttcacattgaggagctggtgggaggccacaaagaaagtgtttcagaaatgttacacactgagtaaaagcttattgaccactcctgcccattcatttacttcagaggagaaatgattcctaacatgacttcaaagaacgggcattactaaattatctactgaccaatccctctgattcctgatgggccctggagtcttgactacagcctagagtctcctgagtactgccatgatgccaatagcattcttgcttaccaaaatctactctcagccaactatgtgtcttcattcaggaagaactgcacatagaatctgattttgaggcctggattaagcttcatgccatccttgtatcacaggcaatatgtctttctggaaatctaatgaaccataccaaatctgcatgatgaagattgtgtaatgatggtgatatcatgccagttatcctcaaagtgggaatatgaccattagctggcattttttaagatttccttagaagggtttaatcaacactgccattacacatggatttaacaaaagacttttgaaaattttttacatactgattttagaataatcctcaaggttctatagtcatttttagtggaagacttaaaaagaaaggaacaatttttactgtgacttcaatttcatagtattttaaacatattttgtaattcagaatgtttagcaatccctatgtcctgtttcacatgcatggtaactgatggtgggttgcctacaggctgaagatttggagagagccattttgtttcataaatcagtttttattgcacagaagcagctggttgtatttcaagttggaaaaagaaaagtaaatgccagaaaaggcaaaggataaacttagtaagccatttattttgttttagaattgtttttgcaaagcaaatttttttaaaaaaaggtcaacaaagtgaatcagcactagcattttcttgatggttgactcaatgtataattaacaaatatacatagcagagtcaattaatcatagtgccattatgtcacttatttgtcattgcaaagtattcagtcatgttgtctagatttactttagatggtgcaaaatttccagatagtaacctatgtaaaaggatttgtaatttccttgtaattcctgcctattagtccatattctgatttccttatgttcatcactgatatgttcctgatcagggtcattgctagtagttgagcatttactggttgaacattgtttaatggttagatgttatgtgtgtctgcatttaaaaaaattgtgtacatgttatttcactattggtattacaatattcataaccacatgataaacagaaatgtacccaataatttcctataaaatttttcaaagtccttttattcccctgacacactcagggtgaatttttgtctccttggcaaataagaaaaaaaaggagagagaccactggagagatatcagcaaaccacccacagtaaccaagttcagtatttcctctttctatattttgaccaatatattaagagcaaattttgtcattattactccttgtggctattacctgagatcagataatataatctcagctcataaagcttggccatgtctatacttatcttggagagcaataacaaacttgattaatttgtttggttatttaaaattccaactttcataaatgctctgtgatgtactcaagacgattgggttgtgtgatactaacttccttcaagaactcagtctgttccctgttgtctggttcagaggtccaccagggcaaaatagaagccttgccgagaaagtgaactgtcttactccttcaaaggaatcagatgttgctctagagaagactccaggcatctacctggttgagctcaaatgaggcaagtgggagaaaacctcttctcatcctctgattgaaagtgatacaatttgaatattggtatattgtcattggtcagtaatggaaaaatgagattccaccagtgggttactcttttcttgtcttggtttgctatgccttatcccagatcagtgttttgttccatccctatggtcatctctaaagccctgacaggagcatcccagactggagaaatgcagcgtatctgtggcccagaattttgtttgatactctaaacagcaatgcaaagactgcaaaatcacactattctaaacagttgttttcagctcattttgaagattgacctggaaaacatatagatacagaatatatacatttaatcgttgcttgtgattcattgtgtcaaaataacatttaattttcactctgattaatctttattttccatttaaaagattatttcaggctacttaaatacaagaccttgcattctaatttttgaaagcggttgttttccctgagctctctctcaactttgacagtttgtgaatgataaaaagttactaggtttgtcctttccttgatagatgtagagcagttcatctgttttgtaaaggtacagttaagcataactataggctgggcgtgatagttcatgcctgtaatcccaacactttgggaggccgaggttggcagatcacctgaggtcaggagtttgagaccagcctggccaacgtggtgaaacccctaatacaaaaattagctgggcatggtggcacgctcctgtaatctcagctactcaggaggctgaggcaggagaatctcttgaacccgggaggcagaggttgcagtgagccaagatcatgccactgcactccagcctggacaacaagagcgaaactccgtcaaaaaaaaatatatatatatgaccataaattgaaaactatcatctcatactgcctccttttaacctgacctattttatatacctacaatacagttaatatgcagcagcgtagagaacaaatagcatattcataatttgtaattttgtttttctttttacggcacccttaagtctcagtaatattttaaaagtcctctataagccaaaagaacgttgtaacatatccatttattaaggagttaggcctaaacatagtaatagtagtccattccatgtccaacagatgttgctgtgtttctttcaacatttttcaatgtcttgtgagtttagtgagtgggtacagctgagttggggtttaggtgatttcttatgcccaatgaactaaaggtatcagtaaaagattattagtaaacaaattagttatttatgctcttacttgaatgtcagtcattcattttatctctcgtctttgagatacacacattaaaacttatgtgcatatttttttaaagagtaatttccacataattccccaagaactgaactcaaatctccaaaaatttttcagaactcaagcaaccaatgattcacagagcaaatctaccaaagccccatttttattggaacacaggcatgctcatttatgtacatattgtttgtggctgcttttatgttgtcaaggcagagttgagtactttcaacagagaccatatggactgcaaagcctaaaatgtgtatctggacccttacagtaaaacaatgaccctgggttttcatggcaccccaatgcctttttggtgacttgcaggaatacagattcctatattccagtttgtttttttttttttctccttagcttaaggttcgtattcccatttgcttctgagaaagttaggaaaattttgttttatgttgcagatgctctcacaacaataattgtgctggagatagatacaacttagtgaaattttcctacagaactaaaaacgcaaaattgcatcactcctgaagaaaagaaatttagagtatgaattgagttggttgagagtagaattaaaaagatttctagcactttgagcatgttttagaaatttgatccttacatttaaaattatgtaaatgacatctttcactggcatttgctcacatttaagtcaatctacagctgttacttactaagctaagaaataagaagatccctatggttctgaatctctcataatattctgaagtaatttatatcaattgaattttcattaatcattttaggaaatattatgttttattttgtggcattatatgacaatgactttctcaacaatagctcagggaatacgcaaacagccagctcttttatgtaagaaagccattttctaatccccacgctttcctgagtgttacgtattttatttctttgaaaagagagggccttgagtaaatgctttcgtttgctttccttacatatttagaaatccaagaagggcccttgtcttagtctatttctgtcacagagaaattgttcattccaaaatatccaccttaagggaagctagtgaccgagatatggagaaaaacataggcattcatgacctttgtgtttccgtttgactttcaacatctgtaaccaaaaggtcacaaatgaaatatttagtagaaagtgcaatatcaatttattaggagtacctaaaattataactctaaataatatacagcaatattattgctctattattacagcaatcaataatataatatagccactaggatacactcgctgtagaactcagaacaaaagatatcaatcttctgccagtccgcatcattatgtgtagcagagactttactggaatgagtgaggggaaagataacaaaatgtagattaggattccacattctcccctgcccatcttcttgattgctcagtttgaagacgatcattgatggacaaatactttagaaatgaatgaagtcaatagctaatgtttctcccagaaactaaacaacatagtttaggggatattaggcctacattctaatcacattgtaaggaagtgattttctaattttgaagcttcccaggagcagccccctccaggaacaattttccctgtgaactttcactgagaaactattatatgccatggaggagtcaaagatgaattaaatccaatgctatcctccaggagtgagctttgtagttggagagaaaagccaaccttatagatacaacctgtacatatataacctatgctgcatttaggcagatgataagccctaggaatggaaagagggaaaagctcccttttgccaggaatgatgaaggaaagctttatggaaacacaggctgtatgtgaaagatgggtgaatctttgcaggtagggaagaagtagggggcatgtctggctgagaaccggcctgatcatagagtggaaaaatgaaaggcagaggtgaaggaagaatactaaatgtgaaaggctgaaatacacagggaagtgttgccagtgtgcaacagaatctcatctcgtgcaaaattgaattagacttccttactccttccttactctgggtaggtccatgtgcagcctttcctcagagcatctagcctgacatacttggctcatctgctgtgcttctaagccaaataaaaatcatcaaacacatcgaagatatttttgggagtcaccaggttaaagcaaagcctcagtcactgaaagcaaaaactgaattggccaggtctccactgacaaaacagagtaaatgatagtatgacagataatttcaagttttccaagactccaatttctgaaaaatgtctcatgactccaaaaaatcacgtacttcctaaaatgttgccagtggaggaccgaatcaaggttattgctgacctcattttttcaaccttttcagttatttgacctgaataggcaatcccccaggatttctgattgaattctacctgaaagtttagattttaaaagacaacctgtaggaagctaagtctcaggcaacaaaatttaaaaccatcagaacttgtttctccaaacatcaacctgctcctgtcaagtcctttttcatctctcccttttgtccctttacatactgttttgtaagttccttttgatatcatttattgcaggcagtatttttacatccatcttcaagaaacttgggagacatttagacatttagtatgtgtacttttagttgtcttgcctctttatttcagataatgcctgtgattagtgaatggcggcattattcctgaagacaaatgaaggaagatagggagcaagattgactgtcatttgaatgatggaagagaagtagaattactgtgaggttacaaaaatcgtaagttagcagacattgagaaaggaaaacttcctacttgggcttttcaggcttatgtgacattatctggatgtgttttctagtctttcctaaaggagaaatttttattcctgggttgctgaaagctttctggactaaaaggatataagcagctcaatagcagcatagaggattagattaatggaacagcactgcatacaggaaagctacatctccaatagtttaggctgcaagtcagtagccaaacacaagagcatgtaagatttggaggacaaagtataaatattttaagtttacacaaccaagattataggctaccttcccaacttctaatttgaagagcactgaaaatggagctgtgaacacttcatttttaaaacctgacaatatggtgctattgactacttaatacaaagatatattacaatatttttaggtaaatgtattaagtctggcctgggcataaatgtacatacagaaaatgtttgtagagaattcatcaaaatcatgcccatttgctgttgtagagctacagtattcttcaatggtggtgactgaccagtgagtttctacttcttacagatgggacacaacagtcatgggctgtctcagctgcccaaagcctgaggcagaccacatgagagctgtggcttcttcttggattcaggttggataacccaattcagtaattaaatatgtaaattttggggggggttggggggtgttttctaggaacttgaagagtacgtgacattataaaaaatgggtgttggaagactaattgtagaaatttgacctgagggccaatgttacttggtgtaagttcactcagacagacatgtcagaacatgcccaaagaagcctatatcttgctgctgggaaatgtaaagcagttggcatgtagaatacgataataaatcatttaagaaaccaccaaaa

SEQ ID NO: 4275 - DNA, 557 bp, Homo sapiens
agtgccaccagcagcgacgacagcatttattccaactgaagacttcactcaaaggcggcggctggcggccggcttctcgctcgggcagcggcggcggcggcggcggcggcttccggagtcccgctgcgaagatgctcaaagtcacggtgccctcctgctccgcctcgtcctgctcttcggtcaccgccagtgcggccccggggaccgcgagcctcgtcccggattactggatcgacggctccaacagggatgcgctgagcgatttcttcgaggtggagtcggagctgggacggggtgctacatccattgtgtacagatgcaaacagaaggggacccagaagccttatgctctcaaagtgttaaagaaaacagtggacaaaaaaatcgtaagaactgagataggagttcttcttcgcctctcacatccaaacattataaaacttaaagagatatttgaaacccctacagaaatcagtctggtcctagaactcgtcacaggaggagaactgtttgataggattgtggaaaagggatattacagtgagcgagatgctgca

SEQ ID NO: 4276 - DNA, 1640 bp, Homo sapiens
cccggacccaggtgctgccagggcggcggctggcggccggcttctcgctcgggcagcggcggcggcggcggcggcggcttccggagtcccgctgcgaagatgctcaaagtcacggtgccctcctgctccgcctcgtcctgctcttcggtcaccgccagtgcggccccggggaccgcgagcctcgtcccggattactggatcgacggctccaacagggatgcgctgagcgatttcttcgaggtggagtcggagctgggacggggtgctacatccattgtgtacagatgcaaacagaaggggacccagaagccttatgctctcaaagtgttaaagaaaacagtggacaaaaaaatcgtaagaactgagataggagttcttcttcgcctctcacatccaaacattataaaacttaaagagatatttgaaacccctacagaaatcagtctggtcctagaactcgtcacaggaggagaactgtttgataggattgtggaaaagggatattacagtgagcgagatgctgcagatgccgttaaacaaatcctggaggcagttgcttatctacatgaaaatgggattgtccatcgtgatctcaaaccagagaatcttctttatgcaactccagccccagatgcaccactcaaaatcgctgattttggactctctaaaattgtggaacatcaagtgctcatgaagacagtatgtggaaccccagggtactgcgcacctgaaattcttagaggttgtgcctatggacctgaggtggacatgtggtctgtaggaataatcacctacatcttactttgtggatttgaaccattctatgatgaaagaggcgatcagttcatgttcaggagaattctgaattgtgaatattactttatctccccctggtgggatgaagtatctctaaatgccaaggacttggtcagaaaattaattgttttggatccaaagaaacggctgactacatttcaagctctccagcatccgtgggtcacaggtaaagcagccaattttgtacacatggataccgctcaaaagaagctccaagaattcaatgcccggcgtaagcttaaggcagcggtgaaggctgtggtggcctcttcgcgcctgggaagtgccagcagcagccatggcagcatccaggagagccacaaggctagccgagacccttctccaatccaagatggcaacgaggacatgaaagctattccagaaggagagaaaattcaaggcgatggggcccaagccgcagttaagggggcacaggctgagctgatgaaggtgcaagccttagagaaagttaaaggtgcagatataaatgctgaagaggcccccaaaatggtgcccaaggcagtggaggatgggataaaggtggctgacctggaactagaggagggcctagcagaggagaagctgaagactgtggaggaggcagcagctcccagagaagggcaaggaagctctgctgtgggttttgaagttccacagcaagatgtgatcctgccagagtactaaacagcttccttcagatctggaagccaaacaccggcattttatgtactttgtccttcagcaagaaaggtgtggaagcatgatatgtactatagtgattctgtttttgaggtgcaaaaaac

SEQ ID NO: 4277 - DNA, 8298 bp, Homo sapiens
ccgttttcgaagccctccacgctgcggccgctatcccctccggaccatggccgacgacgacgtgctgttcgaggatgtgtacgagctgtgcgaggtgatcggaaagggtcccttcagtgttgtacgacgatgtatcaacagagaaactgggcaacaatttgctgtaaaaattgttgatgtagccaagttcacatcaagtccagggttaagtacagaagatctaaagcgggaagccagtatctgtcatatgctgaaacatccacacattgtagagttattggagacatatagctcagatggaatgctttacatggttttcgaatttatggatggagcagatctgtgttttgaaatcgtaaagcgagctgacgctggttttgtgtacagtgaagctgtagccagccattatatgagacagatactggaagctctacgctactgccatgataataacataattcacagggatgtgaagccccactgtgttctccttgcctcaaaagaaaactcggcacctgttaaacttggaggctttggggtagctattcaattaggggagtctggacttgtagctggaggacgtgttggaacacctcattttatggcaccagaagtggtcaaaagagagccttacggaaagcctgtagacgtctgggggtgcggtgtgatcctttttatcctgctcagtggttgtttgcctttttacggaaccaaggaaagattgtttgaaggcattattaaaggaaaatataagatgaatccaaggcagtggagccatatctctgaaagtgccaaagacctagtacgtcgcatgctgatgctggatccagctgaaaggatcactgtttatgaagcactgaatcacccatggcttaaggagcgggatcgttacgcctacaagattcatcttccagaaacagtagagcagctgaggaaattcaatgcaaggaggaaactaaagggtgcagtactagccgctgtgtcaagtcacaaattcaactcattctatggggatccccctgaagagttaccagatttctccgaagaccctacctcctcagtgcttcttattgtttcacgagcagtctcacaggtgctggacagcctggaagagattcatgcgcttacagactgcagtgaaaaggacctagattttctacacagtgttttccaggatcagcatcttcacacactactagatctgtatgacaaaattaacacaaagtcttcaccacaaatcaggaatcctccaagcgatgcagtacagagagccaaagaggtattggaagaaatttcatgttaccctgagaataacgacgcaaaggaactaaagcgtattttaacacaacctcatttcatggccttacttcagactcacgacgtagtggcacatgaagtttacagtgatgaagcattgagggtcacacctcctcccacctctccctatttaaacggcgattctccagaaagtgctaacggagacatggatatggagaatgtgaccagagttcggctggtacagtttcaaaagaacacagatgaaccaatgggaatcactttaaaaatgaatgaactaaatcattgtattgttgcaagaattatgcatgggggcatgattcacaggcaaggtacacttcatgttggtgatgaaattcgagaaatcaatggcatcagtgtggctaaccaaacagtggaacaactgcaaaaaatgcttagggaaatgcgggggagtattaccttcaagattgtgccaagttaccgcactcagtcttcgtcctgtgagagagattccccttccacttccagacagtccccagctaatggtcatagcagcactaacaattctgtttcggacttgccatcaactacccaaccaaaaggacgacagatctatgtaagagcacaatttgaatatgatccagccaaggatgacctcatcccctgtaaagaagctggcattcgattcagagttggtgacatcatccagattattagtaaggatgatcataattggtggcagggtaaactggaaaactccaaaaatggaactgcaggtctcattccttctcctgaacttcaggaatggcgagtagcttgcattgccatggagaagaccaaacaggagcagcaggccagctgtacttggtttggcaagaaaaagaagcagtacaaagataaatatttggcaaagcacaatgcagatcttgtcacatatgaagaagtagtaaaactgccagcattcaagaggaaaacactagtcttattaggcgcacatggtgttgggagaagacacataaaaaacactctcatcacaaagcacccagaccggtttgcgtaccctattccacatacaaccagacctccaaagaaagacgaagaaaatggaaagaattattactttgtatctcatgaccaaatgatgcaagacatctctaataacgagtacttggagtacggcagccacgaggatgcgatgtatgggacaaaactggagaccatccggaagatccacgagcaggggctgattgcaatactggacgtggagcctcaggcactgaaggtcctgagaactgcagagtttgctccttttgttgttttcattgctgcaccaactattactccaggtttaaatgaggatgaatctcttcagcgtctgcagaaggagtctgacatcttacagagaacatatgcacactacttcgatctcacaattatcaacaatgaaattgatgagacaatcagacatctggaggaagctgttgagctcgtgtgcacagccccacagtgggtccctgtctcctgggtctattaggcctctccccagatatctgagcataactgggagcacctcatttgtggaaaagcctctttgttatcggccttgtgtcagcaggtcatggtccctagagactacctagttgtagtgtgacctacatttataattattgtcatgtccgaatagataggaggagaaaaacaattacacactaatttaaagagacagtatcttttttaatcagttctcctaaactttaataaaatgtatctttaaatgtatgtattattcaatcctttggaatgttatatttttggaaatcatagctttttatttccaaggcccctaaaaactgcacaaaatagatgctgctttctataatctattttaataataataaacaatgattctgttaccttgactgggggtggaacactacattctttttagagtctgattttatggattggaatattgggatatctttctttcctttatttatttgaaataattagtgtagtgattacaaaacagtcataaatttttaaaggccttttttctctctttttttttttttagaatagtatttttttttaagtcctttatgtaacatccagataatgtgatactgtctctttgaagcaccctgtaaaccttttagagatttgaagttgggtcttgactcttaatgcatgtggacagtcgcgagcgtttatgctgtcggtgtgtctgtgttggacaaaacaatctgtaatctacagcaaagtacattctacattccgttcatggggcacacccaggggaataagaataaaatgctattatgactaagttgtaaacctatgcacatcccttgcattttgggcaactttataaaaaaaaagaaactgatttttattaataataatcatgtagtgaaatgtgtttgtaattttgtctcaatttaatttgttgtaaggtggggtggggggaattgctggtttcaccatttcagatctgtgttgtctaagagtattaacgttttaattaagcaaagaaatgatttttaatctgtatgtaattgttttaaagcacccattttaagagaaaatactgtgcaatgaagaaaccagtttaggcatttgctataaactgaaatattccaaaagaatcatctataacagccctgtaaattcctttaaaatgataactaacaggacagtttgaccaattttttttaaatatacttccttttatgtgttcaataattaaatgcctttgggtccttcatttcattatagatttgttcaggcttccaagctgataatctttacaattgtataatttgttagatgctcattgaacctttgaaggcccaggagtgagtatcagttggcagggtgacaaagtagcctgccagagcacagctggaccacgtctgactcgcacagagccatgcgcccaagggccacgggtgtactggaggccacctgtggtctctccttcctcttgctgtatcccttggcacaggggaatcatctgtccttgttgctttagagacattaaccatctcataactcttccatgaagtcacattcttccaatacaggagattcgggctggggttctcagactctttgccagaggtcagtagaatgtttttcattagcatgtgagggtgtgaagtgcttatattaacctgtgatccttgaaaacataccatcattttttgcttcttgtaggttagatggccttgtcactttgtgccttggcaggatgtgcagggtgtgttctgagctgaacagctcctcttaaaggaccaaacagagaaggcattagtatacttcttttacattgtcaacaccatacccgcctccgccccccaccgcctattattaaatggtggcgatttttttttttctgatgttgttctttgccagtgaccagatgagtctgcaacttactaacaaggtattgagtgaactacttctgtatgggccccacagtggggtgaccaagccaccaaaccagagataagctcaacagtggtctcacactagatagagagagaaaccttcaaagagttgggtagggctgtgttagaactgattcgaatctgatagatgccaaggccagacagtcgttcctggtatggtactgaccacaatttcgggctcttagtgtgaaggtgcgcactctacctcttttctggtgaagcacaaagacaactacaactaacacatgggaaacagaaacttccctccctctagtggaaacccccacgcccccacttgccctttgagcccacatctccagagatgctgatgatgcctgtcttaagccatctgccatatttataaaggtggattaagcagaggaggagaaaagcaatgccaacttaaatgtctgtggccccacaattcacaagcactgtagcactcatcctcagtggctttatacgtcctctgagaagcacacaggcaggcatcattcttgccatcattccgatggtgaaatccctgcatgcagaactcattgacttctcaaagatgttacctgttccattccactaatacatgtcttctctaaagcagtgtctttatgacctagctgcatatacttacatttctgaattcagagtaatttcagtacattgctgctgctgctgctgctgctgctgctgctgctgctgctgctgctgctgctactgctacattacaattgtccactaagcaatcagagaaaattgctaaaagcttctttactgcttccattccatcagcagaacctttttttttctttctttcttttaaagaccagaatgaatgtttagagtactaaatcttattagtggtcaattgaagtattggagagccacattttgaaggttctctcccccacccaactccattccccacagcaagaaagggagtgtttttatatgttgaattctttgttaaaaagatgaaatgtcctgattttccagtcacaagacagtaattactttgcacatacagcatatcccattttaatgctaaaaagggaaatgtcactcaatttaattcatctggaagtttcccagtgtcaagataacattgtagcctttttaaatgcaattaaatgtatctcttgtcaggtgagatgatttaaaatctttgctcagagaggaaaacaaatggttgacctacttcttgctatttgcattcagaaggcatcgtcccagcccatcctattggtggcagaatatctaaagatgtcgcaaagtcccccactgcagtagaaatgcaggaggtgttcctgttccccgtccaattccttcttaggctgctagagacagccagtgggccaagccttcccctgtgctccaggcaggcctgggctgcagctactgttacctttttacagcctttgatctgatcgctgcagagttcttttgtttttaaatcacttgtatttgtctcttcattaaggcttcaagtttatttcttgaaaaagtttagtcaattgaaccaccctccaggaagattcccagcgtggaaactgcccctgaaaaacaaggcagcccaaagccagctctcttttgtcccccactgatgtcatgtcctttttttttttcatttcaggccagtttcttaacttggggcaaagagaatgtgttgctaaagctaccaagaaaactgcttgattaacaaattcttaatagaaatgcctcccacactgtctctttgaaaagagaaggcaccttggaatcggcattccaaaaccaagctccttgtcatcctcatccctcctccttcttgcttcctattatcaaactcgtgtgtgtttcttgttttctcagaactgaacacagcctcctaattccatcctcttgactagggcttacaatactgagagcgattacaggctgtaataagttaaaggtccctgagcgtggctttcttgttctgcgcctctaattaattcttctattaaaagatgctttccttctcactgcagcttacagaaaggctacaagctttaatcacagatcatttcatttgccagagcctttccttttctaactcctttagaaataagatttccctctctgtttggaatctctggatacaggactctcctccaagctcatggcttgattggctttgcctgtgcacacacacatcagtttgccttaaacttggagctatggggagtcccagattttccagcttagtgggtgaagtttagctgtcacctacatccaggaagtgggggaaaagggaaaaaaagaggatattcaccaccatgttcccatccggtctttcccctgccttgctttgtgcagcaggtgggcagacagagcccacagaaacagaagtagaaagagggccgcaccatctctggggccagcactcctaagtcttagctctttgtgggaatagaaaatcctgagctcccaccacctctcgtctgaccctccatcaactccctcgaacctgtgcaaatggactgagcaaaagaaaatggaaagagatgtttgtcaccacacaggagacctcctttctggccccaagcacaactccatctctgcgtatgctcagaaactcagaatttagctgctacttatgtgttagctccattctctctggtgtgtgactgagagaacacgccagtgttcttactgacagaggcttaggggtgaccctctctggacccagaggaagtacaacctctgtagcgagaattgtccttgggaacagaaacaggcattcctccacagtgagtggctccccctattttttttttatttggaagagaccaagaattgggggaattgatttccagtcttagctgtttcccggaatgtcatctgtgcaggcaggtaggcggctgccgggtgcagcaggcagcgtgactgatgtgaaggccgcccaatcctcacgtgctaagacccgagtatcgtgtttaattgcagtgtaggcacgtcgccattcaaactcagttctggggtggttttgcataaagttttgccaacgtgttcttttttctgtatgtattattgcctttttataaaaggtgttgaagtattgtctcagtgataaaaagagagagatgttaatggttgttgtatatttcaccgtatccaattgtaagtatttgcagggtacagcagagccttagcttgcaagagcgtttgtgcaggaggtgtccctcaacacccaggagctgaagggattggaaaggtttggattctttgtaaatgtcctgcttttctttctctctgtgtgtatctatttacatgccttagcacacgccctcccatcctgatccctttgccctgtcgccggaacaaccagaatgctggtgcgctgccggcacagtacaagttgatgaaaccctaatcagttatcttgtgtgacaggggaagaagagaaactccatagtattccttgtagaatatacatacctgtaggatgctgtgtaatgggaaaccatagaattgggcttttgtcatttcaaagttggagaaatgtatgaataaaatgtataaaacatgaaaa

SEQ ID NO: 4278 - DNA, 8262 bp, Homo sapiens
ccgttttcgaagccctccacgctgcggccgctatcccctccggaccatggccgacgacgacgtgctgttcgaggatgtgtacgagctgtgcgaggtgatcggaaagggtcccttcagtgttgtacgacgatgtatcaacagagaaactgggcaacaatttgctgtaaaaattgttgatgtagccaagttcacatcaagtccagggttaagtacagaagatctaaagcgggaagccagtatctgtcatatgctgaaacatccacacattgtagagttattggagacatatagctcagatggaatgctttacatggttttcgaatttatggatggagcagatctgtgttttgaaatcgtaaagcgagctgacgctggttttgtgtacagtgaagctgtagccagccattatatgagacagatactggaagctctacgctactgccatgataataacataattcacagggatgtgaagccccactgtgttctccttgcctcaaaagaaaactcggcacctgttaaacttggaggctttggggtagctattcaattaggggagtctggacttgtagctggaggacgtgttggaacacctcattttatggcaccagaagtggtcaaaagagagccttacggaaagcctgtagacgtctgggggtgcggtgtgatcctttttatcctgctcagtggttgtttgcctttttacggaaccaaggaaagattgtttgaaggcattattaaaggaaaatataagatgaatccaaggcagtggagccatatctctgaaagtgccaaagacctagtacgtcgcatgctgatgctggatccagctgaaaggatcactgtttatgaagcactgaatcacccatggcttaaggagcgggatcgttacgcctacaagattcatcttccagaaacagtagagcagctgaggaaattcaatgcaaggaggaaactaaagggtgcagtactagccgctgtgtcaagtcacaaattcaactcattctatggggatccccctgaagagttaccagatttctccgaagaccctacctcctcagtgcttcttattgtttcacgagcagtctcacaggtgctggacagcctggaagagattcatgcgcttacagactgcagtgaaaaggacctagattttctacacagtgttttccaggatcagcatcttcacacactactagatctgtatgacaaaattaacacaaagtcttcaccacaaatcaggaatcctccaagcgatgcagtacagagagccaaagaggtattggaagaaatttcatgttaccctgagaataacgacgcaaaggaactaaagcgtattttaacacaacctcatttcatggccttacttcagactcacgacgtagtggcacatgaagtttacagtgatgaagcattgagggtcacacctcctcccacctctccctatttaaacggcgattctccagaaagtgctaacggagacatggatatggagaatgtgaccagagttcggctggtacagtttcaaaagaacacagatgaaccaatgggaatcactttaaaaatgaatgaactaaatcattgtattgttgcaagaattatgcatgggggcatgattcacaggcaaggtacacttcatgttggtgatgaaattcgagaaatcaatggcatcagtgtggctaaccaaacagtggaacaactgcaaaaaatgcttagggaaatgcgggggagtattaccttcaagattgtgccaagttaccgcactcagtcttcgtcctgtgagagagattccccttccacttccagacagtccccagctaatggtcatagcagcactaacaattctgtttcgatctatgtaagagcacaatttgaatatgatccagccaaggatgacctcatcccctgtaaagaagctggcattcgattcagagttggtgacatcatccagattattagtaaggatgatcataattggtggcagggtaaactggaaaactccaaaaatggaactgcaggtctcattccttctcctgaacttcaggaatggcgagtagcttgcattgccatggagaagaccaaacaggagcagcaggccagctgtacttggtttggcaagaaaaagaagcagtacaaagataaatatttggcaaagcacaatgcagatcttgtcacatatgaagaagtagtaaaactgccagcattcaagaggaaaacactagtcttattaggcgcacatggtgttgggagaagacacataaaaaacactctcatcacaaagcacccagaccggtttgcgtaccctattccacatacaaccagacctccaaagaaagacgaagaaaatggaaagaattattactttgtatctcatgaccaaatgatgcaagacatctctaataacgagtacttggagtacggcagccacgaggatgcgatgtatgggacaaaactggagaccatccggaagatccacgagcaggggctgattgcaatactggacgtggagcctcaggcactgaaggtcctgagaactgcagagtttgctccttttgttgttttcattgctgcaccaactattactccaggtttaaatgaggatgaatctcttcagcgtctgcagaaggagtctgacatcttacagagaacatatgcacactacttcgatctcacaattatcaacaatgaaattgatgagacaatcagacatctggaggaagctgttgagctcgtgtgcacagccccacagtgggtccctgtctcctgggtctattaggcctctccccagatatctgagcataactgggagcacctcatttgtggaaaagcctctttgttatcggccttgtgtcagcaggtcatggtccctagagactacctagttgtagtgtgacctacatttataattattgtcatgtccgaatagataggaggagaaaaacaattacacactaatttaaagagacagtatcttttttaatcagttctcctaaactttaataaaatgtatctttaaatgtatgtattattcaatcctttggaatgttatatttttggaaatcatagctttttatttccaaggcccctaaaaactgcacaaaatagatgctgctttctataatctattttaataataataaacaatgattctgttaccttgactgggggtggaacactacattctttttagagtctgattttatggattggaatattgggatatctttctttcctttatttatttgaaataattagtgtagtgattacaaaacagtcataaatttttaaaggccttttttctctctttttttttttttagaatagtatttttttttaagtcctttatgtaacatccagataatgtgatactgtctctttgaagcaccctgtaaaccttttagagatttgaagttgggtcttgactcttaatgcatgtggacagtcgcgagcgtttatgctgtcggtgtgtctgtgttggacaaaacaatctgtaatctacagcaaagtacattctacattccgttcatggggcacacccaggggaataagaataaaatgctattatgactaagttgtaaacctatgcacatcccttgcattttgggcaactttataaaaaaaaagaaactgatttttattaataataatcatgtagtgaaatgtgtttgtaattttgtctcaatttaatttgttgtaaggtggggtggggggaattgctggtttcaccatttcagatctgtgttgtctaagagtattaacgttttaattaagcaaagaaatgatttttaatctgtatgtaattgttttaaagcacccattttaagagaaaatactgtgcaatgaagaaaccagtttaggcatttgctataaactgaaatattccaaaagaatcatctataacagccctgtaaattcctttaaaatgataactaacaggacagtttgaccaattttttttaaatatacttccttttatgtgttcaataattaaatgcctttgggtccttcatttcattatagatttgttcaggcttccaagctgataatctttacaattgtataatttgttagatgctcattgaacctttgaaggcccaggagtgagtatcagttggcagggtgacaaagtagcctgccagagcacagctggaccacgtctgactcgcacagagccatgcgcccaagggccacgggtgtactggaggccacctgtggtctctccttcctcttgctgtatcccttggcacaggggaatcatctgtccttgttgctttagagacattaaccatctcataactcttccatgaagtcacattcttccaatacaggagattcgggctggggttctcagactctttgccagaggtcagtagaatgtttttcattagcatgtgagggtgtgaagtgcttatattaacctgtgatccttgaaaacataccatcattttttgcttcttgtaggttagatggccttgtcactttgtgccttggcaggatgtgcagggtgtgttctgagctgaacagctcctcttaaaggaccaaacagagaaggcattagtatacttcttttacattgtcaacaccatacccgcctccgccccccaccgcctattattaaatggtggcgatttttttttttctgatgttgttctttgccagtgaccagatgagtctgcaacttactaacaaggtattgagtgaactacttctgtatgggccccacagtggggtgaccaagccaccaaaccagagataagctcaacagtggtctcacactagatagagagagaaaccttcaaagagttgggtagggctgtgttagaactgattcgaatctgatagatgccaaggccagacagtcgttcctggtatggtactgaccacaatttcgggctcttagtgtgaaggtgcgcactctacctcttttctggtgaagcacaaagacaactacaactaacacatgggaaacagaaacttccctccctctagtggaaacccccacgcccccacttgccctttgagcccacatctccagagatgctgatgatgcctgtcttaagccatctgccatatttataaaggtggattaagcagaggaggagaaaagcaatgccaacttaaatgtctgtggccccacaattcacaagcactgtagcactcatcctcagtggctttatacgtcctctgagaagcacacaggcaggcatcattcttgccatcattccgatggtgaaatccctgcatgcagaactcattgacttctcaaagatgttacctgttccattccactaatacatgtcttctctaaagcagtgtctttatgacctagctgcatatacttacatttctgaattcagagtaatttcagtacattgctgctgctgctgctgctgctgctgctgctgctgctgctgctgctgctgctactgctacattacaattgtccactaagcaatcagagaaaattgctaaaagcttctttactgcttccattccatcagcagaacctttttttttctttctttcttttaaagaccagaatgaatgtttagagtactaaatcttattagtggtcaattgaagtattggagagccacattttgaaggttctctcccccacccaactccattccccacagcaagaaagggagtgtttttatatgttgaattctttgttaaaaagatgaaatgtcctgattttccagtcacaagacagtaattactttgcacatacagcatatcccattttaatgctaaaaagggaaatgtcactcaatttaattcatctggaagtttcccagtgtcaagataacattgtagcctttttaaatgcaattaaatgtatctcttgtcaggtgagatgatttaaaatctttgctcagagaggaaaacaaatggttgacctacttcttgctatttgcattcagaaggcatcgtcccagcccatcctattggtggcagaatatctaaagatgtcgcaaagtcccccactgcagtagaaatgcaggaggtgttcctgttccccgtccaattccttcttaggctgctagagacagccagtgggccaagccttcccctgtgctccaggcaggcctgggctgcagctactgttacctttttacagcctttgatctgatcgctgcagagttcttttgtttttaaatcacttgtatttgtctcttcattaaggcttcaagtttatttcttgaaaaagtttagtcaattgaaccaccctccaggaagattcccagcgtggaaactgcccctgaaaaacaaggcagcccaaagccagctctcttttgtcccccactgatgtcatgtcctttttttttttcatttcaggccagtttcttaacttggggcaaagagaatgtgttgctaaagctaccaagaaaactgcttgattaacaaattcttaatagaaatgcctcccacactgtctctttgaaaagagaaggcaccttggaatcggcattccaaaaccaagctccttgtcatcctcatccctcctccttcttgcttcctattatcaaactcgtgtgtgtttcttgttttctcagaactgaacacagcctcctaattccatcctcttgactagggcttacaatactgagagcgattacaggctgtaataagttaaaggtccctgagcgtggctttcttgttctgcgcctctaattaattcttctattaaaagatgctttccttctcactgcagcttacagaaaggctacaagctttaatcacagatcatttcatttgccagagcctttccttttctaactcctttagaaataagatttccctctctgtttggaatctctggatacaggactctcctccaagctcatggcttgattggctttgcctgtgcacacacacatcagtttgccttaaacttggagctatggggagtcccagattttccagcttagtgggtgaagtttagctgtcacctacatccaggaagtgggggaaaagggaaaaaaagaggatattcaccaccatgttcccatccggtctttcccctgccttgctttgtgcagcaggtgggcagacagagcccacagaaacagaagtagaaagagggccgcaccatctctggggccagcactcctaagtcttagctctttgtgggaatagaaaatcctgagctcccaccacctctcgtctgaccctccatcaactccctcgaacctgtgcaaatggactgagcaaaagaaaatggaaagagatgtttgtcaccacacaggagacctcctttctggccccaagcacaactccatctctgcgtatgctcagaaactcagaatttagctgctacttatgtgttagctccattctctctggtgtgtgactgagagaacacgccagtgttcttactgacagaggcttaggggtgaccctctctggacccagaggaagtacaacctctgtagcgagaattgtccttgggaacagaaacaggcattcctccacagtgagtggctccccctattttttttttatttggaagagaccaagaattgggggaattgatttccagtcttagctgtttcccggaatgtcatctgtgcaggcaggtaggcggctgccgggtgcagcaggcagcgtgactgatgtgaaggccgcccaatcctcacgtgctaagacccgagtatcgtgtttaattgcagtgtaggcacgtcgccattcaaactcagttctggggtggttttgcataaagttttgccaacgtgttcttttttctgtatgtattattgcctttttataaaaggtgttgaagtattgtctcagtgataaaaagagagagatgttaatggttgttgtatatttcaccgtatccaattgtaagtatttgcagggtacagcagagccttagcttgcaagagcgtttgtgcaggaggtgtccctcaacacccaggagctgaagggattggaaaggtttggattctttgtaaatgtcctgcttttctttctctctgtgtgtatctatttacatgccttagcacacgccctcccatcctgatccctttgccctgtcgccggaacaaccagaatgctggtgcgctgccggcacagtacaagttgatgaaaccctaatcagttatcttgtgtgacaggggaagaagagaaactccatagtattccttgtagaatatacatacctgtaggatgctgtgtaatgggaaaccatagaattgggcttttgtcatttcaaagttggagaaatgtatgaataaaatgtataaaacatgaaaa

SEQ ID NO: 4279 - DNA, 2494 bp, Homo sapiens
gccgccgccacctccctccgcggcgatcctcgctccatggtcctgccgcggccccctctgtagcccgagctgctccgcgacgcgacggagccggcctcggacagagggagcggtcgcggcctcgcggcccgcgcgggctgacgagcggagagcgcgacgccgcgcggtccccgaggatccgcacgccgggcagcgcggcccgagcagcgcgagaagcagcgggcgggcgggcggcgccgggcccgggccgccctcgctcccgcgccccggccccgccgcccgcgccggggcggtcgcctgcagaggaaggcgccgcagtctctgggcctcgcggccccactcgagcgtcctcggcaccgagggctcgcgggtcctgaggggaggaggcgatcccggggctgggcactgagctcttgggcgcccccacccccgttttcgaagccctccacgctgcggccgctatcccctccggaccatggccgacgacgacgtgctgttcgaggatgtgtacgagctgtgcgaggtgatcggaaagggtcccttcagtgttgtacgacgatgtatcaacagagaaactgggcaacaatttgctgtaaaaattgttgatgtagccaagttcacatcaagtccagggttaagtacagaagatctaaagcgggaagccagtatctgtcatatgctgaaacatccacacattgtagagttattggagacatatagctcagatggaatgctttacatggttttcgaatttatggatggagcagatctgtgttttgaaatcgtaaagcgagctgacgctggttttgtgtacagtgaagctgtagccagccattatatgagacagatactggaagctctacgctactgccatgataataacataattcacagggatgtgaagccccactgtgttctccttgcctcaaaagaaaactcggcacctgttaaacttggaggctttggggtagctattcaattaggggagtctggacttgtagctggaggacgtgttggaacacctcattttatggcaccagaagtggtcaaaagagagccttacggaaagcctgtagacgtctgggggtgcggtgtgatcctttttatcctgctcagtggttgtttgcctttttacggaaccaaggaaagattgtttgaaggcattattaaaggaaaatataagatgaatccaaggcagtggagccatatctctgaaagtgccaaagacctagtacgtcgcatgctgatgctggatccagctgaaaggatcactgtttatgaagcactgaatcacccatggcttaaggagcgggatcgttacgcctacaagattcatcttccagaaacagtagagcagctgaggaaattcaatgcaaggaggaaactaaagggtgcagtactagccgctgtgtcaagtcacaaattcaactcattctatggggatccccctgaagagttaccagatttctccgaagaccctacctcctcaggacttctagcagcagaaagagcagtctcacaggtgctggacagcctggaagagattcatgcgcttacagactgcagtgaaaaggacctagattttctacacagtgttttccaggatcagcatcttcacacactactagatctgtatgacaaaattaacacaaagtcttcaccacaaatcaggaatcctccaagcgatgcagtacagagagccaaagaggtattggaagaaatttcatgttaccctgagaataacgacgcaaaggaactaaagcgtattttaacacaacctcatttcatggccttacttcagactcacgacgtagtggcacatgaagtttacagtgatgaagcattgagggtcacacctcctcccacctctccctatttaaacggcgattctccagaaagtgctaacggagacatggatatggagaatgtgaccagagttcggctggtacagtttcaaaagaacacagatgaaccaatgggaatcactttaaaaatgaatgaactaaatcattgtattgttgcaagaattatgcatgggggcatgattcacaggcaaggtacacttcatgttggtgatgaaattcgagaaatcaatggcatcagtgtggctaaccaaacagtggaacaactgcaaaaaatgcttagggaaatgcgggggagtattaccttcaagattgtgccaagttaccgcactcagtcttcgtcctgtgaggtaatgactctaacaaaccacccccatctgctctgagttcttaactaactgtctgctgatggctgtatgtttttgctttctgggaaattgtttctgcctgtgctgttagatcactgcacaccaattttacaacaaagataacggaacagagtaggtcccatccacctactcagccctgcttccatgtggatctcctcagcactttgaactttttgcaggctgaaatctgagcaaaatgtagagaagttacaaatgatgacataaggcttaataaggaaaaaa

SEQ ID NO: 4280 - DNA, 3848 bp, Homo sapiens
cggcccgcgcgggctgacgagcggagagcgcgacgccgcgcggtccccgaggatccgcacgccgggcagcgcggcccgagcagcgcgagaagcagcgggcgggcgggcggcgccgggcccgggccgccctcgctcccgcgccccggccccgccgcccgcgccggggcggtcgcctgcagaggaaggcgccgcagtctctgggcctcgcggccccactcgagcgtcctcggcaccgagggctcgcgggtcctgaggggaggaggcgatcccggggctgggcactgagctcttgggcgcccccacccccgttttcgaagccctccacgctgcggccgctatcccctccggaccatggccgacgacgacgtgctgttcgaggatgtgtacgagctgtgcgaggtgatcggaaagggtcccttcagtgttgtacgacgatgtatcaacagagaaactgggcaacaatttgctgtaaaaattgttgatgtagccaagttcacatcaagtccagggttaagtacagaagatctaaagcgggaagccagtatctgtcatatgctgaaacatccacacattgtagagttattggagacatatagctcagatggaatgctttacatggttttcgaatttatggatggagcagatctgtgttttgaaatcgtaaagcgagctgacgctggttttgtgtacagtgaagctgtagccagccattatatgagacagatactggaagctctacgctactgccatgataataacataattcacagggatgtgaagccccactgtgttctccttgcctcaaaagaaaactcggcacctgttaaacttggaggctttggggtagctattcaattaggggagtctggacttgtagctggaggacgtgttggaacacctcattttatggcaccagaagtggtcaaaagagagccttacggaaagcctgtagacgtctgggggtgcggtgtgatcctttttatcctgctcagtggttgtttgcctttttacggaaccaaggaaagattgtttgaaggcattattaaaggaaaatataagatgaatccaaggcagtggagccatatctctgaaagtgccaaagacctagtacgtcgcatgctgatgctggatccagctgaaaggatcactgtttatgaagcactgaatcacccatggcttaaggagcgggatcgttacgcctacaagattcatcttccagaaacagtagagcagctgaggaaattcaatgcaaggaggaaactaaagggtgcagtactagccgctgtgtcaagtcacaaattcaactcattctatggggatccccctgaagagttaccagatttctccgaagaccctacctcctcaggacttctagcagcagaaagagcagtctcacaggtgctggacagcctggaagagattcatgcgcttacagactgcagtgaaaaggacctagattttctacacagtgttttccaggatcagcatcttcacacactactagatctgtatgacaaaattaacacaaagtcttcaccacaaatcaggaatcctccaagcgatgcagtacagagagccaaagaggtattggaagaaatttcatgttaccctgagaataacgacgcaaaggaactaaagcgtattttaacacaacctcatttcatggccttacttcagactcacgacgtagtggcacatgaagtttacagtgatgaagcattgagggtcacacctcctcccacctctccctatttaaacggcgattctccagaaagtgctaacggagacatggatatggagaatgtgaccagagttcggctggtacagtttcaaaagaacacagatgaaccaatgggaatcactttaaaaatgaatgaactaaatcattgtattgttgcaagaattatgcatgggggcatgattcacaggcaaggtacacttcatgttggtgatgaaattcgagaaatcaatggcatcagtgtggctaaccaaacagtggaacaactgcaaaaaatgcttagggaaatgcgggggagtattaccttcaagattgtgccaagttaccgcactcagtcttcgtcctgtgagagagattccccttccacttccagacagtccccagctaatggtcatagcagcactaacaattctgtttcgatctatgtaagagcacaatttgaatatgatccagccaaggatgacctcatcccctgtaaagaagctggcattcgattcagagttggtgacatcatccagattattagtaaggatgatcataattggtggcagggtaaactggaaaactccaaaaatggaactgcaggtctcattccttctcctgaacttcaggaatggcgagtagcttgcattgccatggagaagaccaaacaggagcagcaggccagctgtacttggtttggcaagaaaaagaagcagtacaaagataaatatttggcaaagcacaatgcagatcttgtcacatatgaagaagtagtaaaactgccagcattcaagaggaaaacactagtcttattaggcgcacatggtgttgggagaagacacataaaaaacactctcatcacaaagcacccagaccggtttgcgtaccctattccacatacaaccagacctccaaagaaagacgaagaaaatggaaagaattattactttgtatctcatgaccaaatgatgcaagacatctctaataacgagtacttggagtacggcagccacgaggatgcgatgtatgggacaaaactggagaccatccggaagatccacgagcaggggctgattgcaatactggacgtggagcctcaggcactgaaggtcctgagaactgcagagtttgctccttttgttgttttcattgctgcaccaactattactccaggtttaaatgaggatgaatctcttcagcgtctgcagaaggagtctgacatcttacagagaacatatgcacactacttcgatctcacaattatcaacaatgaaattgatgagacaatcagacatctggaggaagctgttgagctcgtgtgcacagccccacagtgggtccctgtctcctgggtctattaggcctctccccagatatctgagcataactgggagcacctcatttgtggaaaagcctctttgttatcggccttgtgtcagcaggtcatggtccctagagactacctagttgtagtgtgacctacatttataattattgtcatgtccgaatagataggaggagaaaaacaattacacactaatttaaagagacagtatcttttttaatcagttctcctaaactttaataaaatgtatctttaaatgtatgtattattcaatcctttggaatgttatatttttggaaatcatagctttttatttccaaggcccctaaaaactgcacaaaatagatgctgctttctataatctattttaataataataaacaatgattctgttaccttgactgggggtggaacactacattctttttagagtctgattttatggattggaatattgggatatctttctttcctttatttatttgaaataattagtgtagtgattacaaaacagtcataaatttttaaaggccttttttctctctttttttttttttagaatagtatttttttttaagtcctttatgtaacatccagataatgtgatactgtctctttgaagcaccctgtaaaccttttagagatttgaagttgggtcttgactcttaatgcatgtggacagtcgcgagcgtttatgctgtcggtgtgtctgtgttggacaaaacaatctgtaatctacagcaaagtacattctacattccgttcatggggcacacccagggg

SEQ ID NO: 4281 - DNA, 4411 bp, Homo sapiens
gccgccgccacctccctccgcggcgatcctcgctccatggtcctgccgcggccccctctgtagcccgagctgctccgcgacgcgacggagccggcctcggacagagggagcggtcgcggcctcgcggcccgcgcgggctgacgagcggagagcgcgacgccgcgcggtccccgaggatccgcacgccgggcagcgcggcccgagcagcgcgagaagcagcgggcgggcgggcggcgccgggcccgggccgccctcgctcccgcgccccggccccgccgcccgcgccggggcggtcgcctgcagaggaaggcgccgcagtctctgggcctcgcggccccactcgagcgtcctcggcaccgagggctcgcgggtcctgaggggaggaggcgatcccggggctgggcactgagctcttgggcgcccccacccccgttttcgaagccctccacgctgcggccgctatcccctccggaccatggccgacgacgacgtgctgttcgaggatgtgtacgagctgtgcgaggtgatcggaaagggtcccttcagtgttgtacgacgatgtatcaacagagaaactgggcaacaatttgctgtaaaaattgttgatgtagccaagttcacatcaagtccagggttaagtacagaagatctaaagcgggaagccagtatctgtcatatgctgaaacatccacacattgtagagttattggagacatatagctcagatggaatgctttacatggttttcgaatttatggatggagcagatctgtgttttgaaatcgtaaagcgagctgacgctggttttgtgtacagtgaagctgtagccagccattatatgagacagatactggaagctctacgctactgccatgataataacataattcacagggatgtgaagccccactgtgttctccttgcctcaaaagaaaactcggcacctgttaaacttggaggctttggggtagctattcaattaggggagtctggacttgtagctggaggacgtgttggaacacctcattttatggcaccagaagtggtcaaaagagagccttacggaaagcctgtagacgtctgggggtgcggtgtgatcctttttatcctgctcagtggttgtttgcctttttacggaaccaaggaaagattgtttgaaggcattattaaaggaaaatataagatgaatccaaggcagtggagccatatctctgaaagtgccaaagacctagtacgtcgcatgctgatgctggatccagctgaaaggatcactgtttatgaagcactgaatcacccatggcttaaggagcgggatcgttacgcctacaagattcatcttccagaaacagtagagcagctgaggaaattcaatgcaaggaggaaactaaagggtgcagtactagccgctgtgtcaagtcacaaattcaactcattctatggggatccccctgaagagttaccagatttctccgaagaccctacctcctcaggacttctagcagcagaaagagcagtctcacaggtgctggacagcctggaagagattcatgcgcttacagactgcagtgaaaaggacctagattttctacacagtgttttccaggatcagcatcttcacacactactagatctgtatgacaaaattaacacaaagtcttcaccacaaatcaggaatcctccaagcgatgcagtacagagagccaaagaggtattggaagaaatttcatgttaccctgagaataacgacgcaaaggaactaaagcgtattttaacacaacctcatttcatggccttacttcagactcacgacgtagtggcacatgaagtttacagtgatgaagcattgagggtcacacctcctcccacctctccctatttaaacggcgattctccagaaagtgctaacggagacatggatatggagaatgtgaccagagttcggctggtacagtttcaaaagaacacagatgaaccaatgggaatcactttaaaaatgaatgaactaaatcattgtattgttgcaagaattatgcatgggggcatgattcacaggcaaggtacacttcatgttggtgatgaaattcgagaaatcaatggcatcagtgtggctaaccaaacagtggaacaactgcaaaaaatgcttagggaaatgcgggggagtattaccttcaagattgtgccaagttaccgcactcagtcttcgtcctgtgagagagattccccttccacttccagacagtccccagctaatggtcatagcagcactaacaattctgtttcggacttgccatcaactacccaaccaaaaggacgacagatctatgtaagagcacaatttgaatatgatccagccaaggatgacctcatcccctgtaaagaagctggcattcgattcagagttggtgacatcatccagattattagtaaggatgatcataattggtggcagggtaaactggaaaactccaaaaatggaactgcaggtctcattccttctcctgaacttcaggaatggcgagtagcttgcattgccatggagaagaccaaacaggagcagcaggccagctgtacttggtttggcaagaaaaagaagcagtacaaagataaatatttggcaaagcacaatgcagtgtttgatcaattagatcttgtcacatatgaagaagtagtaaaactgccagcattcaagaggaaaacactagtcttattaggcgcacatggtgttgggagaagacacataaaaaacactctcatcacaaagcacccagaccggtttgcgtaccctattccacatacaaccagacctccaaagaaagacgaagaaaatggaaagaattattactttgtatctcatgaccaaatgatgcaagacatctctaataacgagtacttggagtacggcagccacgaggatgcgatgtatgggacaaaactggagaccatccggaagatccacgagcaggggctgattgcaatactggacgtggagcctcaggcactgaaggtcctgagaactgcagagtttgctccttttgttgttttcattgctgcaccaactattactccaggtttaaatgaggatgaatctcttcagcgtctgcagaaggagtctgacatcttacagagaacatatgcacactacttcgatctcacaattatcaacaatgaaattgatgagacaatcagacatctggaggaagctgttgagctcgtgtgcacagccccacagtgggtccctgtctcctgggtctattaggcctctccccagatatctgagcataactgggagcacctcatttgtggaaaagcctctttgttatcggccttgtgtcagcaggtcatggtccctagagactacctagttgtagtgtgacctacatttataattattgtcatgtccgaatagataggaggagaaaaacaattacacactaatttaaagagacagtatcttttttaatcagttctcctaaactttaataaaatgtatctttaaatgtatgtattattcaatcctttggaatgttatatttttggaaatcatagctttttatttccaaggcccctaaaaactgcacaaaatagatgctgctttctataatctattttaataataataaacaatgattctgttaccttgactgggggtggaacactacattctttttagagtctgattttatggattggaatattgggatatctttctttcctttatttatttgaaataattagtgtagtgattacaaaacagtcataaatttttaaaggccttttttctctctttttttttttttagaatagtatttttttttaagtcctttatgtaacatccagataatgtgatactgtctctttgaagcaccctgtaaaccttttagagatttgaagttgggtcttgactcttaatgcatgtggacagtcgcgagcgtttatgctgtcggtgtgtctgtgttggacaaaacaatctgtaatctacagcaaagtacattctacattccgttcatggggcacacccaggggaataagaataaaatgctattatgactaagttgtaaacctatgcacatcccttgcattttgggcaactttataaaaaaaaagaaactgatttttattaataataatcatgtagtgaaatgtgtttgtaattttgtctcaatttaatttgttgtaaggtggggtggggggaattgctggtttcaccatttcagatctgtgttgtctaagagtattaacgttttaattaagcaaagaaatgatttttaatctgtatgtaattgttttaaagcacccattttaagagaaaatactgtgcaatgaagaaaccagtttaggcatttgctataaactgaaatattccaaaagaatcatctataacagccctgtaaattcctttaaaatgataact

SEQ ID NO: 4282 - DNA, 3123 bp, Homo sapiens
cgctgcggccgctatcccctccggaccatggccgacgacgacgtgctgttcgaggatgtgtacgagctgtgcgaggtgatcggaaagggtcccttcagtgttgtacgacgatgtatcaacagagaaactgggcaacaatttgctgtaaaaattgttgatgtagccaagttcacatcaagtccagggttaagtacagaagatctaaagcgggaagccagtatctgtcatatgctgaaacatccacacattgtagagttattggagacatatagctcagatggaatgctttacatggttttcgaatttatggatggagcagatctgtgttttgaaatcgtaaagcgagctgacgctggttttgtgtacagtgaagctgtagccagccattatatgagacagatactggaagctctacgctactgccatgataataacataattcacagggatgtgaagccccactgtgttctccttgcctcaaaagaaaactcggcacctgttaaacttggaggctttggggtagctattcaattaggggagtctggacttgtagctggaggacgtgttggaacacctcattttatggcaccagaagtggtcaaaagagagccttacggaaagcctgtagacgtctgggggtgcggtgtgatcctttttatcctgctcagtggttgtttgcctttttacggaaccaaggaaagattgtttgaaggcattattaaaggaaaatataagatgaatccaaggcagtggagccatatctctgaaagtgccaaagacctagtacgtcgcatgctgatgctggatccagctgaaaggatcactgtttatgaagcactgaatcacccatggcttaaggagcgggatcgttacgcctacaagattcatcttccagaaacagtagagcagctgaggaaattcaatgcaaggaggaaactaaagggtgcagtactagccgctgtgtcaagtcacaaattcaactcattctatggggatccccctgaagagttaccagatttctccgaagaccctacctcctcaggacttctagcagcagaaagagcagtctcacaggtgctggacagcctggaagagattcatgcgcttacagactgcagtgaaaaggacctagattttctacacagtgttttccaggatcagcatcttcacacactactagatctgtatgacaaaattaacacaaagtcttcaccacaaatcaggaatcctccaagcgatgcagtacagagagccaaagaggtattggaagaaatttcatgttaccctgagaataacgacgcaaaggaactaaagcgtattttaacacaacctcatttcatggccttacttcagactcacgacgtagtggcacatgaagtttacagtgatgaagcattgagggtcacacctcctcccacctctccctatttaaacggcgattctccagaaagtgctaacggagacatggatatggagaatgtgaccagagttcggctggtacagtttcaaaagaacacagatgaaccaatgggaatcactttaaaaatgaatgaactaaatcattgtattgttgcaagaattatgcatgggggcatgattcacaggcaaggtacacttcatgttggtgatgaaattcgagaaatcaatggcatcagtgtggctaaccaaacagtggaacaactgcaaaaaatgcttagggaaatgcgggggagtattaccttcaagattgtgccaagttaccgcactcagtcttcgtcctgtgagagagattccccttccacttccagacagtccccagctaatggtcatagcagcactaacaattctgtttcggacttgccatcaactacccaaccaaaaggacgacagatctatgtaagagcacaatttgaatatgatccagccaaggatgacctcatcccctgtaaagaagctggcattcgattcagagttggtgacatcatccagattattagtaaggatgatcataattggtggcagggtaaactggaaaactccaaaaatggaactgcaggtctcattccttctcctgaacttcaggaatggcgagtagcttgcattgccatggagaagaccaaacaggagcagcaggccagctgtacttggtttggcaagaaaaagaagcagtacaaagataaatatttggcaaagcacaatgcagatcttgtcacatatgaagaagtagtaaaactgccagcattcaagaggaaaacactagtcttattaggcgcacatggtgttgggagaagacacataaaaaacactctcatcacaaagcacccagaccggtttgcgtaccctattccacatacaaccagacctccaaagaaagacgaagaaaatggaaagaattattactttgtatctcatgaccaaatgatgcaagacatctctaataacgagtacttggagtacggcagccacgaggatgcgatgtatgggacaaaactggagaccatccggaagatccacgagcaggggctgattgcaatactggacgtggagcctcaggcactgaaggtcctgagaactgcagagtttgctccttttgttgttttcattgctgcaccaactattactccaggtttaaatgaggatgaatctcttcagcgtctgcagaaggagtctgacatcttacagagaacatatgcacactacttcgatctcacaattatcaacaatgaaattgatgagacaatcagacatctggaggaagctgttgagctcgtgtgcacagccccacagtgggtccctgtctcctgggtctattaggcctctccccagatatctgagcataactgggagcacctcatttgtggaaaagcctctttgttatcggccttgtgtcagcaggtcatggtccctagagactacctagttgtagtgtgacctacatttataattattgtcatgtccgaatagataggaggagaaaaacaattacacactaatttaaagagacagtatcttttttaatcagttctcctaaactttaataaaatgtatctttaaatgtatgtattattcaatcctttggaatgttatatttttggaaatcatagctttttatttccaaggcccctaaaaactgcacaaaataga

SEQ ID NO: 4283 - DNA, 2017 bp, Homo sapiens
gatgaaattcgagaaatcaatggcatcagtgtggctaaccaaacagtggaacaactgcaaaaaatgcttagggaaatgcgggggagtattaccttcaagattgtgccaagttaccgcactcagtcttcgtcctgtgagagagattccccttccacttccagacagtccccagctaatggtcatagcagcactaacaattctgtttcgatctatgtaagagcacaatttgaatatgatccagccaaggatgacctcatcccctgtaaagaagctggcattcgattcagagttggtgacatcatccagattattagtaaggatgatcataattggtggcagggtaaactggaaaactccaaaaatggaactgcaggtctcattccttctcctgaacttcaggaatggcgagtagcttgcattgccatggagaagaccaaacaggagcagcaggccagctgtacttggtttggcaagaaaaagaagcagtacaaagataaatatttggcaaagcacaatgcagtgtttgatcaattagatcttgtcacatatgaagaagtagtaaaactgccagcattcaagaggaaaacactagtcttattaggcgcacatggtgttgggagaagacacataaaaaacactctcatcacaaagcacccagaccggtttgcgtaccctattccacatacaaccagacctccaaagaaagacgaagaaaatggaaagaattattactttgtatctcatgaccaaatgatgcaagacatctctaataacgagtacttggagtacggcagccacgaggatgcgatgtatgggacaaaactggagaccatccggaagatccacgagcaggggctgattgcaatactggacgtggagcctcaggcactgaaggtcctgagaactgcagagtttgctccttttgttgttttcattgctgcaccaactattactccaggtttaaatgaggatgaatctcttcagcgtctgcagaaggagtctgacatcttacagagaacatatgcacactacttcgatctcacaattatcaacaatgaaattgatgagacaatcagacatctggaggaagctgttgagctcgtgtgcacagccccacagtgggtccctgtctcctgggtctattaggcctctccccagatatctgagcataactgggagcacctcatttgtggaaaagcctctttgttatcggccttgtgtcagcaggtcatggtccctagagactacctagttgtagtgtgacctacatttataattattgtcatgtccgaatagataggaggagaaaaacaattacacactaatttaaagagacagtatcttttttaatcagttctcctaaactttaataaaatgtatctttaaatgtatgtattattcaatcctttggaatgttatatttttggaaatcatagctttttatttccaaggcccctaaaaactgcacaaaatagatgctgctttctataatctattttaataataataaacaatgattctgttaccttgactgggggtggaacactacattctttttagagtctgattttatggattggaatattgggatatctttctttcctttatttatttgaaataattagtgtagtgattacaaaacagtcataaatttttaaaggccttttttctctctttttttttttttagaatagtatttttttttaagtcctttatgtaacatccagataatgtgatactgtctctttgaagcaccctgtaaaccttttagagatttgaagttgggtcttgactcttaatgcatgtggacagtcgcgagcgtttatgctgtcggtgtgtctgtgttggacaaaacaatctgtaatctacagcaaagtacattctacattccgttcatggggcacacccaggggaataagaataaaatgctattatgactaagttgtaaacctatgcacatcccttgcattttgggcaactttataaaaaaaaagaaactgatttttattaataataa

SEQ ID NO: 4284 - DNA, 2809 bp, Homo sapiens
gccagaaagcattctttcattttactctgtattcatgctattgaaagttgcttctgtcagaggaaacaaacactgtgattgaggaaatattgatgaattttaaatgacaaggaaattgccacattgacagaattttggtccatctatttaaagatgattttttgaaaagatatgcataagactcatattctgacaagtttcacagaacaattcagaggttattaccaagaggatcccactgaaatcatcagcctgcctttttaaaagaaaaatattgtttagtgaaataataaatatgaagctctgatttttagcaaagaattgtgagtgtttactggattttcttctttgctttttagctgtatgacaaaattaacacaaagtcttcaccacaaatcaggaatcctccaagcgatgcagtacagagagccaaagaggtattggaagaaatttcatgttaccctgagaataacgacgcaaaggaactaaagcgtattttaacacaacctcatttcatggccttacttcagactcacgacgtagtggcacatgaagtttacagtgatgaagcattgagggtcacacctcctcccacctctccctatttaaacggcgattctccagaaagtgctaacggagacatggatatggagaatgtgaccagagttcggctggtacagtttcaaaagaacacagatgaaccaatgggaatcactttaaaaatgaatgaactaaatcattgtattgttgcaagaattatgcatgggggcatgattcacaggcaaggtacacttcatgttggtgatgaaattcgagaaatcaatggcatcagtgtggctaaccaaacagtggaacaactgcaaaaaatgcttagggaaatgcgggggagtattaccttcaagattgtgccaagttaccgcactcagtcttcgtcctgtgaggacttgccatcaactacccaaccaaaaggacgacagatctatgtaagagcacaatttgaatatgatccagccaaggatgacctcatcccctgtaaagaagctggcattcgattcagagttggtgacatcatccagattattagtaaggatgatcataattggtggcagggtaaactggaaaactccaaaaatggaactgcaggtctcattccttctcctgaacttcaggaatggcgagtagcttgcattgccatggagaagaccaaacaggagcagcaggccagctgtacttggtttggcaagaaaaagaagcagtacaaagataaatatttggcaaagcacaatgcagtgtttgatcaattagatcttgtcacatatgaagaagtagtaaaactgccagcattcaagaggaaaacactagtcttattaggcgcacatggtgttgggagaagacacataaaaaacactctcatcacaaagcacccagaccggtttgcgtaccctattccacatacaaccagacctccaaagaaagacgaagaaaatggaaagaattattactttgtatctcatgaccaaatgatgcaagacatctctaataacgagtacttggagtacggcagccacgaggatgcgatgtatgggacaaaactggagaccatccggaagatccacgagcaggggctgattgcaatactggacgtggagcctcaggcactgaaggtcctgagaactgcagagtttgctccttttgttgttttcattgctgcaccaactattactccaggtttaaatgaggatgaatctcttcagcgtctgcagaaggagtctgacatcttacagagaacatatgcacactacttcgatctcacaattatcaacaatgaaattgatgagacaatcagacatctggaggaagctgttgagctcgtgtgcacagccccacagtgggtccctgtctcctgggtctattaggcctctccccagatatctgagcataactgggagcacctcatttgtggaaaagcctctttgttatcggccttgtgtcagcaggtcatggtccctagagactacctagttgtagtgtgacctacatttataattattgtcatgtccgaatagataggaggagaaaaacaattacacactaatttaaagagacagtatcttttttaatcagttctcctaaactttaataaaatgtatctttaaatgtatgtattattcaatcctttggaatgttatatttttggaaatcatagctttttatttccaaggcccctaaaaactgcacaaaatagatgctgctttctataatctattttaataataataaacaatgattctgttaccttgactgggggtggaacactacattctttttagagtctgattttatggattggaatattgggatatctttctttcctttatttatttgaaataattagtgtagtgattacaaaacagtcataaatttttaaaggccttttttctctctttttttttttttagaatagtatttttttttaagtcctttatgtaacatccagataatgtgatactgtctctttgaagcaccctgtaaaccttttagagatttgaagttgggtcttgactcttaatgcatgtggacagtcgcgagcgtttatgctgtcggtgtgtctgtgttggacaaaacaatctgtaatctacagcaaagtacattctacattccgttcatggggcacacccaggggaataagaataaaatgctattatgactaagttgtaaacctatgcacatcccttgcattttgggcaactttataaaaaaaaagaaactgatttttattaataataatcatgtagtgaaatgtgtttgt

SEQ ID NO: 4285 - DNA, 8204 bp, Homo sapiens
tgcggccgctatcccctccggaccatggccgacgacgacgtgctgttcgaggatgtgtacgagctgtgcgaggtgatcggaaagggtcccttcagtgttgtacgacgatgtatcaacagagaaactgggcaacaatttgctgtaaaaattgttgatgtagccaagttcacatcaagtccagggttaagtacagaagatctaaagcgggaagccagtatctgtcatatgctgaaacatccacacattgtagagttattggagacatatagctcagatggaatgctttacatggttttcgaatttatggatggagcagatctgtgttttgaaatcgtaaagcgagctgacgctggttttgtgtacagtgaagctgtagccagccattatatgagacagatactggaagctctacgctactgccatgataataacataattcacagggatgtgaagccccactgtgttctccttgcctcaaaagaaaactcggcacctgttaaacttggaggctttggggtagctattcaattaggggagtctggacttgtagctggaggacgtgttggaacacctcattttatggcaccagaagtggtcaaaagagagccttacggaaagcctgtagacgtctgggggtgcggtgtgatcctttttatcctgctcagtggttgtttgcctttttacggaaccaaggaaagattgtttgaaggcattattaaaggaaaatataagatgaatccaaggcagtggagccatatctctgaaagtgccaaagacctagtacgtcgcatgctgatgctggatccagctgaaaggatcactgtttatgaagcactgaatcacccatggcttaaggagcgggatcgttacgcctacaagattcatcttccagaaacagtagagcagctgaggaaattcaatgcaaggaggaaactaaagggtgcagtactagccgctgtgtcaagtcacaaattcaactcattctatggggatccccctgaagagttaccagatttctccgaagaccctacctcctcaggagcagtctcacaggtgctggacagcctggaagagattcatgcgcttacagactgcagtgaaaaggacctagattttctacacagtgttttccaggatcagcatcttcacacactactagatctgtatgacaaaattaacacaaagtcttcaccacaaatcaggaatcctccaagcgatgcagtacagagagccaaagaggtattggaagaaatttcatgttaccctgagaataacgacgcaaaggaactaaagcgtattttaacacaacctcatttcatggccttacttcagactcacgacgtagtggcacatgaagtttacagtgatgaagcattgagggtcacacctcctcccacctctccctatttaaacggcgattctccagaaagtgctaacggagacatggatatggagaatgtgaccagagttcggctggtacagtttcaaaagaacacagatgaaccaatgggaatcactttaaaaatgaatgaactaaatcattgtattgttgcaagaattatgcatgggggcatgattcacaggcaaggtacacttcatgttggtgatgaaattcgagaaatcaatggcatcagtgtggctaaccaaacagtggaacaactgcaaaaaatgcttagggaaatgcgggggagtattaccttcaagattgtgccaagttaccgcactcagtcttcgtcctgtgaggacttgccatcaactacccaaccaaaaggacgacagatctatgtaagagcacaatttgaatatgatccagccaaggatgacctcatcccctgtaaagaagctggcattcgattcagagttggtgacatcatccagattattagtaaggatgatcataattggtggcagggtaaactggaaaactccaaaaatggaactgcaggtctcattccttctcctgaacttcaggaatggcgagtagcttgcattgccatggagaagaccaaacaggagcagcaggccagctgtacttggtttggcaagaaaaagaagcagtacaaagataaatatttggcaaagcacaatgcagtgtttgatcaattagatcttgtcacatatgaagaagtagtaaaactgccagcattcaagaggaaaacactagtcttattaggcgcacatggtgttgggagaagacacataaaaaacactctcatcacaaagcacccagaccggtttgcgtaccctattccacatacaaccagacctccaaagaaagacgaagaaaatggaaagaattattactttgtatctcatgaccaaatgatgcaagacatctctaataacgagtacttggagtacggcagccacgaggatgcgatgtatgggacaaaactggagaccatccggaagatccacgagcaggggctgattgcaatactggacgtggagcctcaggcactgaaggtcctgagaactgcagagtttgctccttttgttgttttcattgctgcaccaactattactccaggtttaaatgaggatgaatctcttcagcgtctgcagaaggagtctgacatcttacagagaacatatgcacactacttcgatctcacaattatcaacaatgaaattgatgagacaatcagacatctggaggaagctgttgagctcgtgtgcacagccccacagtgggtccctgtctcctgggtctattaggcctctccccagatatctgagcataactgggagcacctcatttgtggaaaagcctctttgttatcggccttgtgtcagcaggtcatggtccctagagactacctagttgtagtgtgacctacatttataattattgtcatgtccgaatagataggaggagaaaaacaattacacactaatttaaagagacagtatcttttttaatcagttctcctaaactttaataaaatgtatctttaaatgtatgtattattcaatcctttggaatgttatatttttggaaatcatagctttttatttccaaggcccctaaaaactgcacaaaatagatgctgctttctataatctattttaataataataaacaatgattctgttaccttgactgggggtggaacactacattctttttagagtctgattttatggattggaatattgggatatctttctttcctttatttatttgaaataattagtgtagtgattacaaaacagtcataaatttttaaaggccttttttctctctttttttttttttagaatagtatttttttttaagtcctttatgtaacatccagataatgtgatactgtctctttgaagcaccctgtaaaccttttagagatttgaagttgggtcttgactcttaatgcatgtggacagtcgcgagcgtttatgctgtcggtgtgtctgtgttggacaaaacaatctgtaatctacagcaaagtacattctacattccgttcatggggcacacccaggggaataagaataaaatgctattatgactaagttgtaaacctatgcacatcccttgcattttgggcaactttataaaaaaaaagaaactgatttttattaataataatcatgtagtgaaatgtgtttgtaattttgtctcaatttaatttgttgtaaggtggggtggggggaattgctggtttcaccatttcagatctgtgttgtctaagagtattaacgttttaattaagcaaagaaatgatttttaatctgtatgtaattgttttaaagcacccattttaagagaaaatactgtgcaatgaagaaaccagtttaggcatttgctataaactgaaatattccaaaagaatcatctataacagccctgtaaattcctttaaaatgataactaacaggacagtttgaccaattttttttaaatatacttccttttatgtgttcaataattaaatgcctttgggtccttcatttcattatagatttgttcaggcttccaagctgataatctttacaattgtataatttgttagatgctcattgaacctttgaaggcccaggagtgagtatcagttggcagggtgacaaagtagcctgccagagcacagctggaccacgtctgactcgcacagagccatgcgcccaagggccacgggtgtactggaggccacctgtggtctctccttcctcttgctgtatcccttggcacaggggaatcatctgtccttgttgctttagagacattaaccatctcataactcttccatgaagtcacattcttccaatacaggagattcgggctggggttctcagactctttgccagaggtcagtagaatgtttttcattagcatgtgagggtgtgaagtgcttatattaacctgtgatccttgaaaacataccatcattttttgcttcttgtaggttagatggccttgtcactttgtgccttggcaggatgtgcagggtgtgttctgagctgaacagctcctcttaaaggaccaaacagagaaggcattagtatacttcttttacattgtcaacaccatacccgcctccgccccccaccgcctattattaaatggtggcgatttttttttttctgatgttgttctttgccagtgaccagatgagtctgcaacttactaacaaggtattgagtgaactacttctgtatgggccccacagtggggtgaccaagccaccaaaccagagataagctcaacagtggtctcacactagatagagagagaaaccttcaaagagttgggtagggctgtgttagaactgattcgaatctgatagatgccaaggccagacagtcgttcctggtatggtactgaccacaatttcgggctcttagtgtgaaggtgcgcactctacctcttttctggtgaagcacaaagacaactacaactaacacatgggaaacagaaacttccctccctctagtggaaacccccacgcccccacttgccctttgagcccacatctccagagatgctgatgatgcctgtcttaagccatctgccatatttataaaggtggattaagcagaggaggagaaaagcaatgccaacttaaatgtctgtggccccacaattcacaagcactgtagcactcatcctcagtggctttatacgtcctctgagaagcacacaggcaggcatcattcttgccatcattccgatggtgaaatccctgcatgcagaactcattgacttctcaaagatgttacctgttccattccactaatacatgtcttctctaaagcagtgtctttatgacctagctgcatatacttacatttctgaattcagagtaatttcagtacattgctgctgctgctgctgctgctgctgctgctgctgctgctgctgctgctgctactgctacattacaattgtccactaagcaatcagagaaaattgctaaaagcttctttactgcttccattccatcagcagaacctttttttttctttctttcttttaaagaccagaatgaatgtttagagtactaaatcttattagtggtcaattgaagtattggagagccacattttgaaggttctctcccccacccaactccattccccacagcaagaaagggagtgtttttatatgttgaattctttgttaaaaagatgaaatgtcctgattttccagtcacaagacagtaattactttgcacatacagcatatcccattttaatgctaaaaagggaaatgtcactcaatttaattcatctggaagtttcccagtgtcaagataacattgtagcctttttaaatgcaattaaatgtatctcttgtcaggtgagatgatttaaaatctttgctcagagaggaaaacaaatggttgacctacttcttgctatttgcattcagaaggcatcgtcccagcccatcctattggtggcagaatatctaaagatgtcgcaaagtcccccactgcagtagaaatgcaggaggtgttcctgttccccgtccaattccttcttaggctgctagagacagccagtgggccaagccttcccctgtgctccaggcaggcctgggctgcagctactgttacctttttacagcctttgatctgatcgctgcagagttcttttgtttttaaatcacttgtatttgtctcttcattaaggcttcaagtttatttcttgaaaaagtttagtcaattgaaccaccctccaggaagattcccagcgtggaaactgcccctgaaaaacaaggcagcccaaagccagctctcttttgtcccccactgatgtcatgtcctttttttttttcatttcaggccagtttcttaacttggggcaaagagaatgtgttgctaaagctaccaagaaaactgcttgattaacaaattcttaatagaaatgcctcccacactgtctctttgaaaagagaaggcaccttggaatcggcattccaaaaccaagctccttgtcatcctcatccctcctccttcttgcttcctattatcaaactcgtgtgtgtttcttgttttctcagaactgaacacagcctcctaattccatcctcttgactagggcttacaatactgagagcgattacaggctgtaataagttaaaggtccctgagcgtggctttcttgttctgcgcctctaattaattcttctattaaaagatgctttccttctcactgcagcttacagaaaggctacaagctttaatcacagatcatttcatttgccagagcctttccttttctaactcctttagaaataagatttccctctctgtttggaatctctggatacaggactctcctccaagctcatggcttgattggctttgcctgtgcacacacacatcagtttgccttaaacttggagctatggggagtcccagattttccagcttagtgggtgaagtttagctgtcacctacatccaggaagtgggggaaaagggaaaaaaagaggatattcaccaccatgttcccatccggtctttcccctgccttgctttgtgcagcaggtgggcagacagagcccacagaaacagaagtagaaagagggccgcaccatctctggggccagcactcctaagtcttagctctttgtgggaatagaaaatcctgagctcccaccacctctcgtctgaccctccatcaactccctcgaacctgtgcaaatggactgagcaaaagaaaatggaaagagatgtttgtcaccacacaggagacctcctttctggccccaagcacaactccatctctgcgtatgctcagaaactcagaatttagctgctacttatgtgttagctccattctctctggtgtgtgactgagagaacacgccagtgttcttactgacagaggcttaggggtgaccctctctggacccagaggaagtacaacctctgtagcgagaattgtccttgggaacagaaacaggcattcctccacagtgagtggctccccctattttttttttatttggaagagaccaagaattgggggaattgatttccagtcttagctgtttcccggaatgtcatctgtgcaggcaggtaggcggctgccgggtgcagcaggcagcgtgactgatgtgaaggccgcccaatcctcacgtgctaagacccgagtatcgtgtttaattgcagtgtaggcacgtcgccattcaaactcagttctggggtggttttgcataaagttttgccaacgtgttcttttttctgtatgtattattgcctttttataaaaggtgttgaagtattgtctcagtgataaaaagagagagatgttaatggttgttgtatatttcaccgtatccaattgtaagtatttgcagggtacagcagagccttagcttgcaagagcgtttgtgcaggaggtgtccctcaacacccaggagctgaagggattggaaaggtttggattctttgtaaatgtcctgcttttctttctctctgtgtgtatctatttacatgccttagcacacgccctcccatcctgatccctttgccctgtcgccggaacaaccagaatgctggtgcgctgccggcacagtacaagttgatgaaaccctaatcagttatcttgtgtgacaggggaagaagagaaactccatagtattccttgtagaatatacatacctgtaggatgctgtgtaatgggaaaccatagaattgggcttttgtcatttcaaagttggagaaatgtatgaataaaatgtataaaacatgaaaa

SEQ ID NO: 4286 - DNA, 2800 bp, Homo sapiens
ccgctatcccctccggaccatggccgacgacgacgtgctgttcgaggatgtgtacgagctgtgcgaggtgatcggaaagggtcccttcagtgttgtacgacgatgtatcaacagagaaactgggcaacaatttgctgtaaaaattgttgatgtagccaagttcacatcaagtccagggttaagtacagaagatctaaagcgggaagccagtatctgtcatatgctgaaacatccacacattgtagagttattggagacatatagctcagatggaatgctttacatggttttcgaatttatggatggagcagatctgtgttttgaaatcgtaaagcgagctgacgctggttttgtgtacagtgaagctgtagccagccattatatgagacagatactggaagctctacgctactgccatgataataacataattcacagggatgtgaagccccactgtgttctccttgcctcaaaagaaaactcggcacctgttaaacttggaggctttggggtagctattcaattaggggagtctggacttgtagctggaggacgtgttggaacacctcattttatggcaccagaagtggtcaaaagagagccttacggaaagcctgtagacgtctgggggtgcggtgtgatcctttttatcctgctcagtggttgtttgcctttttacggaaccaaggaaagattgtttgaaggcattattaaaggaaaatataagatgaatccaaggcagtggagccatatctctgaaagtgccaaagacctagtacgtcgcatgctgatgctggatccagctgaaaggatcactgtttatgaagcactgaatcacccatggcttaaggagcgggatcgttacgcctacaagattcatcttccagaaacagtagagcagctgaggaaattcaatgcaaggaggaaactaaagggtgcagtactagccgctgtgtcaagtcacaaattcaactcattctatggggatccccctgaagagttaccagatttctccgaagaccctacctcctcaggacttctagcagcagaaagagcagtctcacaggtgctggacagcctggaagagattcatgcgcttacagactgcagtgaaaaggacctagattttctacacagtgttttccaggatcagcatcttcacacactactagatctgtatgacaaaattaacacaaagtcttcaccacaaatcaggaatcctccaagcgatgcagtacagagagccaaagaggtattggaagaaatttcatgttaccctgagaataacgacgcaaaggaactaaagcgtattttaacacaacctcatttcatggccttacttcagactcacgacgtagtggcacatgaagtttacagtgatgaagcattgagggtcacacctcctcccacctctccctatttaaacggcgattctccagaaagtgctaacggagacatggatatggagaatgtgaccagagttcggctggtacagtttcaaaagaacacagatgaaccaatgggaatcactttaaaaatgaatgaactaaatcattgtattgttgcaagaattatgcatgggggcatgattcacaggcaaggtacacttcatgttggtgatgaaattcgagaaatcaatggcatcagtgtggctaaccaaacagtggaacaactgcaaaaaatgcttagggaaatgcgggggagtattaccttcaagattgtgccaagttaccgcactcagtcttcgtcctgtgaggacttgccatcaactacccaaccaaaaggacgacagatctatgtaagagcacaatttgaatatgatccagccaaggatgacctcatcccctgtaaagaagctggcattcgattcagagttggtgacatcatccagattattagtaaggatgatcataattggtggcagggtaaactggaaaactccaaaaatggaactgcaggtctcattccttctcctgaacttcaggaatggcgagtagcttgcattgccatggagaagaccaaacaggagcagcaggccagctgtacttggtttggcaagaaaaagaagcagtacaaagataaatatttggcaaagcacaatgcagatcttgtcacatatgaagaagtagtaaaactgccagcattcaagaggaaaacactagtcttattaggcgcacatggtgttgggagaagacacataaaaaacactctcatcacaaagcacccagaccggtttgcgtaccctattccacatacaaccagacctccaaagaaagacgaagaaaatggaaagaattattactttgtatctcatgaccaaatgatgcaagacatctctaataacgagtacttggagtacggcagccacgaggatgcgatgtatgggacaaaactggagaccatccggaagatccacgagcaggggctgattgcaatactggacgtggagcctcaggcactgaaggtcctgagaactgcagagtttgctccttttgttgttttcattgctgcaccaactattactccaggtttaaatgaggatgaatctcttcagcgtctgcagaaggagtctgacatcttacagagaacatatgcacactacttcgatctcacaattatcaacaatgaaattgatgagacaatcagacatctggaggaagctgttgagctcgtgtgcacagccccacagtgggtccctgtctcctgggtctattaggcctctccccagatatctgagcataactgggagcacctcatttgtggaaaagcctctttgttatcggccttgtgtcagcaggtc

SEQ ID NO: 4287 - DNA, 3361 bp, Homo sapiens
tcccttgccctggagagacggcagaaccatggcattttatagctgctgctgggtcctcttggcactcacctggcacacctctgcctacgggccagaccagcgagcccaaaagaagggggacattatccttggggggctctttcctattcattttggagtagcagctaaagatcaagatctcaaatcaaggccggagtctgtggaatgtatcaggtataatttccgtgggtttcgctggttacaggctatgatatttgccatagaggagataaacagcagcccagcccttcttcccaacttgacgctgggatacaggatatttgacacttgcaacaccgtttctaaggccttggaagccaccctgagttttgttgctcaaaacaaaattgattctttgaaccttgatgagttctgcaactgctcagagcacattccctctacgattgctgtggtgggagcaactggctcaggcgtctccacggcagtggcaaatctgctggggctcttctacattccccaggtcagttatgcctcctccagcagactcctcagcaacaagaatcaattcaagtctttcctccgaaccatccccaatgatgagcaccaggccactgccatggcagacatcatcgagtatttccgctggaactgggtgggcacaattgcagctgatgacgactatgggcggccggggattgagaaattccgagaggaagctgaggaaagggatatctgcatcgacttcagtgaactcatctcccagtactctgatgaggaagagatccagcatgtggtagaggtgattcaaaattccacggccaaagtcatcgtggttttctccagtggcccagatcttgagcccctcatcaaggagattgtccggcgcaatatcacgggcaagatctggctggccagcgaggcctgggccagctcctccctgatcgccatgcctcagtacttccacgtggttggcggcaccattggattcgctctgaaggctgggcagatcccaggcttccgggaattcctgaagaaggtccatcccaggaagtctgtccacaatggttttgccaaggagttttgggaagaaacatttaactgccacctccaagaaggtgcaaaaggacctttacctgtggacacctttctgagaggtcacgaagaaagtggcgacaggtttagcaacagctcgacagccttccgacccctctgtacaggggatgagaacatcagcagtgtcgagaccccttacatagattacacgcatttacggatatcctacaatgtgtacttagcagtctactccattgcccacgccttgcaagatatatatacctgcttacctgggagagggctcttcaccaatggctcctgtgcagacatcaagaaagttgaggcgtggcaggtcctgaagcacctacggcatctaaactttacaaacaatatgggggagcaggtgacctttgatgagtgtggtgacctggtggggaactattccatcatcaactggcacctctccccagaggatggctccatcgtgtttaaggaagtcgggtattacaacgtctatgccaagaagggagaaagactcttcatcaacgaggagaaaatcctgtggagtgggttctccagggaggtgcccttctccaactgcagccgagactgcctggcagggaccaggaaagggatcattgagggggagcccacctgctgctttgagtgtgtggagtgtcctgatggggagtatagtgatgagacagatgccagtgcctgtaacaagtgcccagatgacttctggtccaatgagaaccacacctcctgcattgccaaggagatcgagtttctgtcgtggacggagccctttgggatcgcactcaccctctttgccgtgctgggcattttcctgacagcctttgtgctgggtgtgtttatcaagttccgcaacacacccattgtcaaggccaccaaccgagagctctcctacctcctcctcttctccctgctctgctgcttctccagctccctgttcttcatcggggagccccaggactggacgtgccgcctgcgccagccggcctttggcatcagcttcgtgctctgcatctcatgcatcctggtgaaaaccaaccgtgtcctcctggtgtttgaggccaagatccccaccagcttccaccgcaagtggtgggggctcaacctgcagttcctgctggttttcctctgcaccttcatgcagattgtcatctgtgtgatctggctctacaccgcgcccccgtcaagctaccgcaaccaggagctggaggatgagatcatcttcatcacgtgccacgagggctccctcatggccctgggcttcctgatcggctacacctgcctgctggctgccatctgcttcttctttgccttcaagtcccggaagctgccggagaacttcaatgaagccaagttcatcaccttcagcatgctcatcttcttcatcgtctggatctccttcattccagcctatgccagcacctatggcaagtttgtctctgccgtagaggtgattgccatcctggcagccagctttggcttgctggcgtgcatcttcttcaacaagatctacatcattctcttcaagccatcccgcaacaccatcgaggaggtgcgttgcagcaccgcagctcacgctttcaaggtggctgcccgggccacgctgcgccgcagcaacgtctcccgcaagcggtccagcagccttggaggctccacgggatccaccccctcctcctccatcagcagcaagagcaacagcgaagacccattcccacagcccgagaggcagaagcagcagcagccgctggccctaacccagcaagagcagcagcagcagcccctgaccctcccacagcagcaacgatctcagcagcagcccagatgcaagcagaaggtcatctttggcagcggcacggtcaccttctcactgagctttgatgagcctcagaagaacgccatggcccacaggaattctacgcaccagaactccctggaggcccagaaaagcagcgatacgctgacccgacacgagccattactcccgctgcagtgcggggaaacggacttagatctgaccgtccaggaaacaggtctgcaaggacctgtgggtggagaccagcggccagaggtggaggaccctgaagagttgtccccagcacttgtagtgtccagttcacagagctttgtcatcagtggtggaggcagcactgttacagaaaacgtagtgaattcataaaatggaaggagaagactgggctagggagaatgcagagaggtttcttggggtcccagggaagaggaatcgccccagactcctttcctctgaggaaga

SEQ ID NO: 4288 - DNA, 3783 bp, Homo sapiens
caacaggcacctggctgcagccaggaaggaccgcacgccctttcgcgcaggagagtggaaggagggagctgtttgccagcaccgaggtcttgcggcacaggcaacgcttgacctgagtcttgcagaatgaaaggcatcacaggaggcctctgcatgatgtggcttccaaagactcaaggaccacccacattacaagtctggattgaggaaggcagaaatggagattcaaacaccacgtcttctattattttattaatcaatctgtagacatgtgtccccactgcagggagtgaactgctccaagggagaaacttctgggagcctccaaactcctagctgtctcatcccttgccctggagagacggcagaaccatggcattttatagctgctgctgggtcctcttggcactcacctggcacacctctgcctacgggccagaccagcgagcccaaaagaagggggacattatccttggggggctctttcctattcattttggagtagcagctaaagatcaagatctcaaatcaaggccggagtctgtggaatgtatcaggtataatttccgtgggtttcgctggttacaggctatgatatttgccatagaggagataaacagcagcccagcccttcttcccaacttgacgctgggatacaggatatttgacacttgcaacaccgtttctaaggccttggaagccaccctgagttttgttgctcaaaacaaaattgattctttgaaccttgatgagttctgcaactgctcagagcacattccctctacgattgctgtggtgggagcaactggctcaggcgtctccacggcagtggcaaatctgctggggctcttctacattccccaggtcagttatgcctcctccagcagactcctcagcaacaagaatcaattcaagtctttcctccgaaccatccccaatgatgagcaccaggccactgccatggcagacatcatcgagtatttccgctggaactgggtgggcacaattgcagctgatgacgactatgggcggccggggattgagaaattccgagaggaagctgaggaaagggatatctgcatcgacttcagtgaactcatctcccagtactctgatgaggaagagatccagcatgtggtagaggtgattcaaaattccacggccaaagtcatcgtggttttctccagtggcccagatcttgagcccctcatcaaggagattgtccggcgcaatatcacgggcaagatctggctggccagcgaggcctgggccagctcctccctgatcgccatgcctcagtacttccacgtggttggcggcaccattggattcgctctgaaggctgggcagatcccaggcttccgggaattcctgaagaaggtccatcccaggaagtctgtccacaatggttttgccaaggagttttgggaagaaacatttaactgccacctccaagaaggtgcaaaaggacctttacctgtggacacctttctgagaggtcacgaagaaagtggcgacaggtttagcaacagctcgacagccttccgacccctctgtacaggggatgagaacatcagcagtgtcgagaccccttacatagattacacgcatttacggatatcctacaatgtgtacttagcagtctactccattgcccacgccttgcaagatatatatacctgcttacctgggagagggctcttcaccaatggctcctgtgcagacatcaagaaagttgaggcgtggcaggtcctgaagcacctacggcatctaaactttacaaacaatatgggggagcaggtgacctttgatgagtgtggtgacctggtggggaactattccatcatcaactggcacctctccccagaggatggctccatcgtgtttaaggaagtcgggtattacaacgtctatgccaagaagggagaaagactcttcatcaacgaggagaaaatcctgtggagtgggttctccagggaggtgcccttctccaactgcagccgagactgcctggcagggaccaggaaagggatcattgagggggagcccacctgctgctttgagtgtgtggagtgtcctgatggggagtatagtgatgagacagatgccagtgcctgtaacaagtgcccagatgacttctggtccaatgagaaccacacctcctgcattgccaaggagatcgagtttctgtcgtggacggagccctttgggatcgcactcaccctctttgccgtgctgggcattttcctgacagcctttgtgctgggtgtgtttatcaagttccgcaacacacccattgtcaaggccaccaaccgagagctctcctacctcctcctcttctccctgctctgctgcttctccagctccctgttcttcatcggggagccccaggactggacgtgccgcctgcgccagccggcctttggcatcagcttcgtgctctgcatctcatgcatcctggtgaaaaccaaccgtgtcctcctggtgtttgaggccaagatccccaccagcttccaccgcaagtggtgggggctcaacctgcagttcctgctggttttcctctgcaccttcatgcagattgtcatctgtgtgatctggctctacaccgcgcccccgtcaagctaccgcaaccaggagctggaggatgagatcatcttcatcacgtgccacgagggctccctcatggccctgggcttcctgatcggctacacctgcctgctggctgccatctgcttcttctttgccttcaagtcccggaagctgccggagaacttcaatgaagccaagttcatcaccttcagcatgctcatcttcttcatcgtctggatctccttcattccagcctatgccagcacctatggcaagtttgtctctgccgtagaggtgattgccatcctggcagccagctttggcttgctggcgtgcatcttcttcaacaagatctacatcattctcttcaagccatcccgcaacaccatcgaggaggtgcgttgcagcaccgcagctcacgctttcaaggtggctgcccgggccacgctgcgccgcagcaacgtctcccgcaagcggtccagcagccttggaggctccacgggatccaccccctcctcctccatcagcagcaagagcaacagcgaagacccattcccacagcccgagaggcagaagcagcagcagccgctggccctaacccagcaagagcagcagcagcagcccctgaccctcccacagcagcaacgatctcagcagcagcccagatgcaagcagaaggtcatctttggcagcggcacggtcaccttctcactgagctttgatgagcctcagaagaacgccatggcccacaggaattctacgcaccagaactccctggaggcccagaaaagcagcgatacgctgacccgacacgagccattactcccgctgcagtgcggggaaacggacttagatctgaccgtccaggaaacaggtctgcaaggacctgtgggtggagaccagcggccagaggtggaggaccctgaagagttgtccccagcacttgtagtgtccagttcacagagctttgtcatcagtggtggaggcagcactgttacagaaaacgtagtgaattcataaaatggaaggagaagactgggctagggagaatgcagagaggtttcttggggtcccagggaagaggaatcgccccagactcctttcctctgaggaagaagggataatagacacatcaaatgccccgaatttagtcacaccatcttaaatgacagtgaattgacccatgttcccttt

SEQ ID NO: 4289 - DNA, 5009 bp, Homo sapiens
ggggctgctgtggccggacccgaaggcgggcgccgggagcgcagcgagccagacgcgcctctccaagaccgtgaccttggcatagggagcggggctgcgcgcagtcctgagatcagaccagagctcatcctcgtggagacccacggccgaggggccggagctgcctctgtgcgagggagccctggccgcggcgcagaaggcatcacaggaggcctctgcatgatgtggcttccaaagactcaaggaccacccacattacaagtctggattgaggaaggcagaaatggagattcaaacaccacgtcttctattattttattaatcaatctgtagacatgtgtccccactgcagggagtgaactgctccaagggagaaacttctgggagcctccaaactcctagctgtctcatcccttgccctggagagacggcagaaccatggcattttatagctgctgctgggtcctcttggcactcacctggcacacctctgcctacgggccagaccagcgagcccaaaagaagggggacattatccttggggggctctttcctattcattttggagtagcagctaaagatcaagatctcaaatcaaggccggagtctgtggaatgtatcaggtataatttccgtgggtttcgctggttacaggctatgatatttgccatagaggagataaacagcagcccagcccttcttcccaacttgacgctgggatacaggatatttgacacttgcaacaccgtttctaaggccttggaagccaccctgagttttgttgctcaaaacaaaattgattctttgaaccttgatgagttctgcaactgctcagagcacattccctctacgattgctgtggtgggagcaactggctcaggcgtctccacggcagtggcaaatctgctggggctcttctacattccccaggtcagttatgcctcctccagcagactcctcagcaacaagaatcaattcaagtctttcctccgaaccatccccaatgatgagcaccaggccactgccatggcagacatcatcgagtatttccgctggaactgggtgggcacaattgcagctgatgacgactatgggcggccggggattgagaaattccgagaggaagctgaggaaagggatatctgcatcgacttcagtgaactcatctcccagtactctgatgaggaagagatccagcatgtggtagaggtgattcaaaattccacggccaaagtcatcgtggttttctccagtggcccagatcttgagcccctcatcaaggagattgtccggcgcaatatcacgggcaagatctggctggccagcgaggcctgggccagctcctccctgatcgccatgcctcagtacttccacgtggttggcggcaccattggattcgctctgaaggctgggcagatcccaggcttccgggaattcctgaagaaggtccatcccaggaagtctgtccacaatggttttgccaaggagttttgggaagaaacatttaactgccacctccaagaaggtgcaaaaggacctttacctgtggacacctttctgagaggtcacgaagaaagtggcgacaggtttagcaacagctcgacagccttccgacccctctgtacaggggatgagaacatcagcagtgtcgagaccccttacatagattacacgcatttacggatatcctacaatgtgtacttagcagtctactccattgcccacgccttgcaagatatatatacctgcttacctgggagagggctcttcaccaatggctcctgtgcagacatcaagaaagttgaggcgtggcaggtcctgaagcacctacggcatctaaactttacaaacaatatgggggagcaggtgacctttgatgagtgtggtgacctggtggggaactattccatcatcaactggcacctctccccagaggatggctccatcgtgtttaaggaagtcgggtattacaacgtctatgccaagaagggagaaagactcttcatcaacgaggagaaaatcctgtggagtgggttctccagggagccactcacctttgtgctgtctgtcctccaggtgcccttctccaactgcagccgagactgcctggcagggaccaggaaagggatcattgagggggagcccacctgctgctttgagtgtgtggagtgtcctgatggggagtatagtgatgagacagatgccagtgcctgtaacaagtgcccagatgacttctggtccaatgagaaccacacctcctgcattgccaaggagatcgagtttctgtcgtggacggagccctttgggatcgcactcaccctctttgccgtgctgggcattttcctgacagcctttgtgctgggtgtgtttatcaagttccgcaacacacccattgtcaaggccaccaaccgagagctctcctacctcctcctcttctccctgctctgctgcttctccagctccctgttcttcatcggggagccccaggactggacgtgccgcctgcgccagccggcctttggcatcagcttcgtgctctgcatctcatgcatcctggtgaaaaccaaccgtgtcctcctggtgtttgaggccaagatccccaccagcttccaccgcaagtggtgggggctcaacctgcagttcctgctggttttcctctgcaccttcatgcagattgtcatctgtgtgatctggctctacaccgcgcccccgtcaagctaccgcaaccaggagctggaggatgagatcatcttcatcacgtgccacgagggctccctcatggccctgggcttcctgatcggctacacctgcctgctggctgccatctgcttcttctttgccttcaagtcccggaagctgccggagaacttcaatgaagccaagttcatcaccttcagcatgctcatcttcttcatcgtctggatctccttcattccagcctatgccagcacctatggcaagtttgtctctgccgtagaggtgattgccatcctggcagccagctttggcttgctggcgtgcatcttcttcaacaagatctacatcattctcttcaagccatcccgcaacaccatcgaggaggtgcgttgcagcaccgcagctcacgctttcaaggtggctgcccgggccacgctgcgccgcagcaacgtctcccgcaagcggtccagcagccttggaggctccacgggatccaccccctcctcctccatcagcagcaagagcaacagcgaagacccattcccacagcccgagaggcagaagcagcagcagccgctggccctaacccagcaagagcagcagcagcagcccctgaccctcccacagcagcaacgatctcagcagcagcccagatgcaagcagaaggtcatctttggcagcggcacggtcaccttctcactgagctttgatgagcctcagaagaacgccatggcccacaggaattctacgcaccagaactccctggaggcccagaaaagcagcgatacgctgacccgacacgagccattactcccgctgcagtgcggggaaacggacttagatctgaccgtccaggaaacaggtctgcaaggacctgtgggtggagaccagcggccagaggtggaggaccctgaagagttgtccccagcacttgtagtgtccagttcacagagctttgtcatcagtggtggaggcagcactgttacagaaaacgtagtgaattcataaaatggaaggagaagactgggctagggagaatgcagagaggtttcttggggtcccagggaagaggaatcgccccagactcctttcctctgaggaagaagggataatagacacatcaaatgccccgaatttagtcacaccatcttaaatgacagtgaattgacccatgttccctttaaaattaaaaaaaagaagagccttgtgtttctgtggttgcatttgtcaaagcattgagatctccacggtcagatttgctgttcacccacatctaatgtctcttcctctgttctatcccacccaacagctcagagatgaaactatggctttaaactaccctccagagtgtgcagactgatgggacatcaaatttgccaccactagagctgagagtctgaaagacagaatgtcaccagtcctgcccaatgccttgacaacagactgaattttaaatgttcacaacataaggagaatgtatctcctcctatttatgaaaaccatatgatattttgtctcctacctgctgctgctattatgtaacatccagaaggtttgcacccctcctataccatatgtctgcttctgtccaggacatgatactgatgccatgtttagattccaggatcacaagaatcacctcaaattgttaggaagggactgcataaaccaatgagctgtatctgtaattaatattcctatatgtagctttatccttaggaaaatgcttctgttgtaatagtccatggacaatataaactgaaaaatgtcagtctggtttatataaggcagtattattgagctctatttccccaccccactatcctcactcccataagctaagccttatgtgagccccttcagggactcaagggtccagaagtccctcccatctctaccccaaagaattcctgaagccagatccaccctatccctgtacagagtaagttctcaattattggcctgctaatagctgctagggtaggaaagcgtggttccaagaaagatccaccctcaaatgtcagagctatgttccctccagcagtggtattaatactgccggtcacccaggctctggagccagagagacagaccggggttcaagccatggcttcgtcatttgcaagctgagtgactgtaggcagggaaccttaacctctctaagccacagcttcttcatctttaaaataaggataataatcattctttcccctcagagctcttatgtggattaaacgagataatgtatataaagtactttagcctggtacctagcacacaataagcattcaataaatattagttaatattat

SEQ ID NO: 4290 - DNA, 1606 bp, Homo sapiens
acagtgcattcatgcagctgggccccaccccatctccagaggcaccttccactagcaacagtctccccaggcacaacacagctaacacaaggccccgcaggcaggactctgggacagacgcaggccagctgcccagagcccagaccaagcatggacgccgtggatgccaccatggagaaactccgggcacagtgcctgtcccgcggggcctcgggcatccagggcctggccaggtttttccgccaactagaccgggacgggagcagatccctggacgctgatgagttccggcagggtctggccaaactcgggctggtgctggaccaggcggaggcagagggtgtgtgcaggaagtgggaccgcaatggcagcgggacgctggatctggaggagttccttcgggcgctgcggccccccatgtcccaggcccgggaggctgtcatcgcagctgcatttgccaagctggaccgcagtggggacggcgtcgtgacggtggacgacctccgcggggtgtacagtggccgtgcccaccccaaggtgcgcagtggggagtggaccgaggacgaggtgctgcgccgcttcctggacaacttcgactcctctgagaaggacgggcaggtcacactggcggaattccaggactactacagcggcgtgagtgcctccatgaacacggatgaggagttcgtggccatgatgaccagtgcctggcagctgtgagcagctccggctcagccctgctgccctggcctgtcactccccacccctgccggagacctcccttccctgggccccttctctcctgggcagccacaccacagagcggggaggggcaggtgggggaatggaggctgcaggactggctagaccaggtccctgccggtccaccaggcggaggtgggacaaaggtcctaacaggagtcactggctcaggaccccagggagaaacgctctccccacccacgccatgctgaccagagatcttgcagcccctgtggatgcccccgccgaggtcccccgatccccgcacccggactgctgctccctgcccctcccttgcgggtcccccaggaagccaggtgaccccaggtgggaggctgtgtgtggaggccatcctggaaggaagtttagacctgcccaggtgtggagcgaggggcacaggggcatcctaacctcagaaactgaaataaagcctttgaaaaaaaaatctgtaaaacatcaacccccaatcagaagatggcaaatggggaataaaaatagcaggtaacatgtccagcgggcccagtatctacattctggtgagcggcccgaggctgggagctctgggcgggggcagaccggcggggccttgcagcaggggtgggggtaaagtgcgggtggtggtggagagaacagggctgtggctggaccccagcactggtgacacgctgggtgggagcatgaggccccaggctgctggaggtcctcgcccggggaggtggaggccgttcctggtcaggggcttcctgaggcccctggggcatgcagaggccagggttttagttaaaagtttaatgtagttcccaaatacatttcatatgacaatcttacataaatgttccaaaac

SEQ ID NO: 4291 - DNA, 4081 bp, Homo sapiens
caagaaattcttactaaacatttacaaatgagatgccaaaacagcacttcagtaatagtggttatattttatagttctctacacagaaaaaaaaatgctgcttgtaacactcatagacatgaaagtatttctctgcctatttaaataattctggattgcagtgagccaccaggattttggcagccagatgtcaccatgatttctcataaaactgatgatgttacatcagtggtggcctgaatcaagatgctgggatgcctgtaacctacagattggtttcagactccaaaggcaacttttttttttttttttttttgagacggagtctggctctgccaccctgccacccaggctgaagtacagtggtgtgatctaggctcactgcaacctctgcctccagggttcaagtgattctcctgccttggcctcctgagtagctgggattacaggcatgcaccaccatgcccagctatttattttttttagtagagatggggtttcaaaatgttggccaggctggtcttgaactcctgacctcaagtgatccgcccacctcagcctcccaaagtgctgggattacagctgtgagccaccgcgcccagccctggcctctttttttaagttatttatttatttttgagacagagtctcactctgtcgcccaggctgtggtgcagtggcatggtcttggttcactgcaacctctgcctcctgggttcaagtgattctcctgcctcagcctctggagtaggtgggattacaggcacccgccaccatacctggctaattttctttttttttttttgagacaaagtcttgctcttgtcccccagtctggagtgcaatggcacgatctcggctcactgcaacctccgcttcccaggttcatgcaattctcctgcctcagcctcccgagtagctgggattacaggcacataccaccacgcccagctagtttttcgtattttaagtagagacagggtttcaccatgttggccaggctggtctcaaactcctgacctcaggtgatctgtctgcctcggcctcccaaagtgctgtgattacaggcatgagccaccgcacccggctgactaatttttgtatttatagtagagacagggtttcaccatgttggccaggctggtctcgaactgctgacctcatgatctgcccgcctcggcctcccaaagtgctgggattacaggcgtgagccaccgtgcccggccagtttatttacttatttttaagaggcgggcgtcttgctctgtaacccaggctggagtgcagtggtgcgatcatagctcactgcagcctccaactcccgggctcaagtgatcctcctgcctcagccttccaagtaggtgggattacaggaacacaccaccatgcctggctaattttttgtagtttttgtagagatgggggggtctcactatgttgcacaggcgggtctcaaactcctgggctcaagtgatcttcctgccctggcttcccaaagtgttgggattacaggcatgagccaccgcgctcaggcaaggcaacttctgacaatataattgtgctgtgagcgaggtaaagccaggcttggagaaggctccgattgatgatccttgggtcggggcgaacagtgggtcctcaaacagggcccacgtttcaagtcctggaaaacccacctatcttagcgggcaggtatatccgatgtctccgttgaaggccttcagtgaggtggcttcgtctcttgaggtttatgtccaggatcagggctgctcttccactcggggtcacaacctctggctcaccaccttgtcaggagccagcccactaagtcacgtttcaggcctgaaaaccaacaacaaaagatccgtaaagacagaaatcctgggactggctcctaacaacggccagtgacaagctttgtggcagtgagcagaggtgtccctcaggctcagctcagtctctgtgggttgcaggacctgcccttggaggtgggcctgggtgggaggtcttagggccccaggacctgggccacctggggctttttttttttttttctttttgagatggagtcttgctctgtcgcccagactggagtgcagtggtgcaatcttggctcactgcaagctccacctcctgggttcaagcgattctcctgcctcagcttcctaagtagctcggattacaggcgcccaccatcatgcacggctaatttttgtatttttagtagaggcggggtttcaccatgttggtcaggctggtctcaaactcctcaccttgtgatctgcccacctcggcctcccaaagtgctgggattacaggcatgagccaccgcgcccagcccacctggggcatttttgttgctgtacaatagaaacaagttctctatatgttccccaggctggtccaaactcctgggctcaagtgatcctcccacctagacctcccaaagtgctgggatttcaggcatgagccgcagtggccggtcagaacctggggcccttttgaactttgattcctcagcaattttgtcagccctggctcgggctgagaagcccctgtgaagccagagagggaaagggacctgtccagggtcacacaggaatcatgcgtcaagcctccccagccacggacttgtctccatccagggcatttcagcccctgcagggcagtggcctgcccctcctccttggagccaggaagggatgcagtgccacagggatctggctctgtcccaggccctgtggggctggcagttgagtaagcagtcaggctgggcgcacccatccctcccccactccccactgcccagcacagtgcattcatgcagctgggccccaccccatctccagaggcaccttccactagcaacagtctccccaggcacaacacagctaacacaaggccccgcaggcaggactctgggacagacgcaggccagctgcccagagcccagaccaagcatggacgccgtggatgccaccatggagaaactccgggcacagtgcctgtcccgcggggcctcgggcatccagggcctggccaggtttttccgccaactagaccgggacgggagcagatccctggacgctgatgagttccggcagggtctggccaaactcgggctggtgctggaccaggcggaggcagagggtgtgtgcaggaagtgggaccgcaatggcagcgggacgctggatctggaggagttccttcgggcgctgcggccccccatgtcccaggcccgggaggctgtcatcgcagctgcatttgccaagctggaccgcagtggggacggcgtcgtgacggtggacgacctccgcggggtgtacagtggccgtgcccaccccaaggtgcgcagtggggagtggaccgaggacgaggtgctgcgccgcttcctggacaacttcgactcctctgagaaggacgggcaggtcacactggcggaattccaggactactacagcggcgtgagtgcctccatgaacacggatgaggagttcgtggccatgatgaccagtgcctggcagctgtgagcagctccggctcagccctgctgccctggcctgtcactccccacccctgccggagacctcccttccctgggccccttctctcctgggcagccacaccacagagcggggaggggcaggtgggggaatggaggctgcaggactggctagaccaggtccctgccggtccaccaggcggaggtgggacaaaggtcctaacaggagtcactggctcaggaccccagggagaaacgctctccccacccacgccatgctgaccagagatcttgcagcccctgtggatgcccccgccgaggtcccccgatccccgcacccggactgctgctccctgcccctcccttgcgggtcccccaggaagccaggtgaccccaggtgggaggctgtgtgtggaggccatcctggaaggaagtttagacctgcccaggtgtggagcgaggggcacaggggcatcctaacctcagaaactgaaataaagcctttgaaaaaaaaatctgtaaaacatcaacccccaatcagaagatggcaaatggggaataaaaatagcaggtaacatgtcc

SEQ ID NO: 4292 - DNA, 1525 bp, Homo sapiens
acagtgcattcatgcagctgggccccaccccatctccagaggcaccttccactagcaacagtctccccaggcacaacacagctaacacaaggccccgcaggcaggactctgggacagacgcaggccagctgcccagagcccagaccaagcatggacgccgtggatgccaccatggagaaactccgggcacagtgcctgtcccgcggggcctcgggcatccagggcctggccaggtttttccgccaactagaccgggacgggagcagatccctggacgctgatgagttccggcagggtctggccaaactcgggctggtgctggaccaggcggaggcagagggtgtgtgcaggaagtgggaccgcaatggcagcgggacgctggatctggaggagttccttcgggcgctgcggccccccatgtcccaggcccgggaggctgtcatcgcagctgcatttgccaagctggaccgcagtggggacggcgtcgtgacggtggacgacctccgcggggtgtacagtggccgtgcccaccccaaggtcacactggcggaattccaggactactacagcggcgtgagtgcctccatgaacacggatgaggagttcgtggccatgatgaccagtgcctggcagctgtgagcagctccggctcagccctgctgccctggcctgtcactccccacccctgccggagacctcccttccctgggccccttctctcctgggcagccacaccacagagcggggaggggcaggtgggggaatggaggctgcaggactggctagaccaggtccctgccggtccaccaggcggaggtgggacaaaggtcctaacaggagtcactggctcaggaccccagggagaaacgctctccccacccacgccatgctgaccagagatcttgcagcccctgtggatgcccccgccgaggtcccccgatccccgcacccggactgctgctccctgcccctcccttgcgggtcccccaggaagccaggtgaccccaggtgggaggctgtgtgtggaggccatcctggaaggaagtttagacctgcccaggtgtggagcgaggggcacaggggcatcctaacctcagaaactgaaataaagcctttgaaaaaaaaatctgtaaaacatcaacccccaatcagaagatggcaaatggggaataaaaatagcaggtaacatgtccagcgggcccagtatctacattctggtgagcggcccgaggctgggagctctgggcgggggcagaccggcggggccttgcagcaggggtgggggtaaagtgcgggtggtggtggagagaacagggctgtggctggaccccagcactggtgacacgctgggtgggagcatgaggccccaggctgctggaggtcctcgcccggggaggtggaggccgttcctggtcaggggcttcctgaggcccctggggcatgcagaggccagggttttagttaaaagtttaatgtagttcccaaatacatttcatatgacaatcttacataaatgttccaaaac

SEQ ID NO: 4293 - DNA, 1145 bp, Homo sapiens
cttataaatatcctgtatagggctgtcatcagtgatccagagcaaaatttagccattgagcaaaaagaaagtgatcatatccttccagattcaaagatgacacctcttcgatttagaaaaagaacactacatgaaacaaagataagaactcattctacattaactgaaaatgtgctttctcataaattacagtttgatggtaggatcgtatcacgaacaaatgtgcttccttttattcaaaaaagcatttatagtcatcagtgtggacgaagaaaaggaaaacaataccgacttggtgatttttatgttggtgcaaccttgacatttttgagttctgatcatctcagccttccagaaagcatcaaagaaaacacattacttaaactccgaatcacaaatattgatcaaatagctttggattctctcaaaactgcttctatggaacaggaggatgatataatcattcaagaaaccaatgataggctggtcttcaaagcaattcaagatgtgctaaaagaaaaactacataaaagaggtgttcgtattttgactggattgggaaaatattttcaacagttggacaaggaaggaaatggacttttagataaggcagattttaagcaagctctaaaagtgtttcacttagaagtgtctgaaaaggattttgagtctgcatggctaattctgaatgacaatggcaatggcaaggttgattatggagaattcaaacgtggtattattggtgaaatgaatgaatacaggaaatcatatgttcgaaaggcctttatgaaactggatttcaacaaaagtggcagtgtgcctattataaacataagaaaatgttactgtgcaaagaagcattctcaagtaatttcaggttgaccagcaaggacaaacatgaaaatgcttaaaaaaaagaaagcgcttaaaacaaagaaatagaaggtaatgggcatatataaaataagccaagcaagagaagagcaaagacaatctgcagggtggacatggatgtattcgtttctgatcatgagaagaggctcttgtcatacatatcgttccatttttattttaaagttctataaacttctgaggtaaactgatttcttggatgtacttaataaagaataaatgtttcatattgg

SEQ ID NO: 4294 - DNA, 3430 bp, Homo sapiens
ggagccaaattcagccattctttggaagaaagaagcctctacaacaaaggtggacttctgagtcatggacaaaccagaattcttgcccaccagtggtcccacgacttgatttgggaagccttgttgactctgatgatgaggacaatttttcatatattccacttagtacagcaaacctgccaaattcatcttctactcttggctgggtcacaccatgtcaaactccatatactcagtatcatctaaataaattggatcagaacataatacctgaaaatttgccagcaccaacagacaaatgtaaactaaaatatcagcaatgtaaaactgaaattaaagagggctataagcagtatagtcagagaaatgcagaaaatacaaaatcaaatgttacacataaacagtctccaagaaacaagatagatgaaaagtgtgtgcaagatgaagaagccaacacagatgaccttacgactctggataggaaagccatcttacagcaaggttatgcagacaactcttgcgataaacaacagagggcaagaaaattggatgcagaaattgtggctgcagagaagaagaaacagattgttgcagagcaagtgatgatagaccacttatctagggctgtcatcagtgatccagagcaaaatttagccattgagcaaaaagaaagtgatcatatccttccagattcaaagatgacacctcttcgatttagaaaaagaacactacatgaaacaaagataagaactcattctacattaactgaaaatgtgctttctcataaattacagtttgatggtaggatcgtatcacgtaatggacgtgatgcttgcagagagctcattgggttctttttcactcatgaccaatcccttacaatttatgaatatcgacaatttgggaaaaatagaacaaatgtgcttccttttattcaaaaaagcatttatagtcatcagtgtggacgaagaaaaggaaaacaataccgacttggtgatttttatgttggtgcaaccttgacatttttgagttctgatcatctcagccttccagaaagcatcaaagaaaacacattacttaaactccgaatcacaaatattgatcaaatagctttggattctctcaaaactgcttctatggaacaggaggatgatataatcattcaagaaaccaatgataggctggtcttcaaagcaattcaagatgtgctaaaagaaaaactacataaaagaggtgttcgtattttgactggattgggaaaatattttcaacagttggacaaggaaggaaatggacttttagataaggcagattttaagcaagctctaaaagtgtttcacttagaagtgtctgaaaaggattttgagtctgcatggctaattctgaatgacaatggcaatggcaaggttgattatggagaattcaaacgtggtattattggtgaaatgaatgaatacaggaaatcatatgttcgaaaggcctttatgaaactggatttcaacaaaagtggcagtgtgcctattataaacataagaaaatgttactgtgcaaagaagcattctcaagtaatttcaggccattcaacagaggaagaaatcaaatcatcctttctagaaacattaaaagttgcctgcagcaagtctgatgaagtgtcatatggtgaatttgaagattactatgaaggtttaagtataggaatagtagatgatgaagactttgttaacatcttacgtactccatgggggatttagtctttaataatacatatgtcatcaacactaagcattttattggagagatgatatcaatgtaaaggatgatcaaacactggaatatattttcctaggacttcctttattctggtttcttgtttgtttgttttgttttgttttgttttctcaaaaatgttgaatttggaaagagaactatccagaaagatagatgtaggggtgtgttagtgtttgtgcatgtgtatgcctgttcacatgtccttacatttgtaaagatatctttttggtttattacttatcttgcgtatattttagaggtcattttttattaacttcagtaggaaagttacatctgcatcaaacaatatggcaacatctatttattaaccaagtttcctgtcctttcacattgttttttgctacctcttcctcagaatatatttgccaccatggtcaatttgataaattagaattgggcccaaagccagtgagataattcaatgtgtttttaacacatgaaaatattaaaggatatgcaagagaaatttttcaagcagtgtgattatagatgttttctgtatatagaatatttcaaatgatggaggtttaccccatgatgctcatttaaatactgacttgtcttttaaatctgtcttctaaattatgtactgttgttggttaaatagagcacaatgtagttattctaatgcccagttgtatttgttcttttattctgctttttaactgtaatcctttttaccagcatacgattgttattgagcaatatgaaagggaaatgttctttattaaaatcaatacattatcttattaaacaaagatcctaaaagtatattgttgcatatatgaatccaaggaatagttcagtaattattgcctaaaatgtgaaagcatattttgtatcctaaaatgaatgtatgatattctaaacatctgttttagtataacaaacaattgaaacatttccttctaaatatatgttatttaatagttacatgtattataatcattctttctaaattctttgctagtcatttcttcctgggaatacagagaaaagagacaactttatgagttgttttcaacttcataattttaaattttctatgttaatataacataaattagaaaaaataagtgattcaaaatgaaaatatttactttgtagaatatgactttagacatatcactgtatccatctatacttggcagcaacatgagaagtgtgatacatgtgaacccaacaaattcaaagttgcacttttcaagatgtgagaaggtactaaaacttaatactaaaacatgagagggaaaatatgtgtaaacctctagtgctattttcactggctaaattctttatttcttgatttttttaaaaattaggttattaaaattaaaacaatatgctagaagacattttggcagaaataagtctataacactatttttgtcacatatctttttcttggaaaaatttatccaactatagacatcttaaaccctacaaattgttcttgttaaaaatgactaatactgggggtgctcaatatgcatatagtgtttttcattgataatttttatttagttcttaagaaacctgttcttaatgttggcatgtcacatttttctgttactataatcagaaaatgtatagtctgttatactgtaaaaaaaaaaaaaaa

SEQ ID NO: 4295 - DNA, 2135 bp, Homo sapiens
agacgcgggcctggactgtctagactgtcctgtctaaagctttctgaatgcggtttttggaggaatcgcgctagtttataccttttccaactcttctaactctggacctcttcttaccgagcttgttaggtgaaatcaggctgactgtctcttgtgcccctcgcctgtcctgtccaggaatcccagttaggtaggggatggggaattccttctgctacactgcagtatactgcatgataaacacaggaactcaaatggatttagaggttaaaggagttgctgccacttctaggagccaaattcagccattctttggaagaaagaagcctctacaacaaaggtggacttctgagtcatggacaaaccagaattcttgcccaccagtggtcccacgacttgatttgggaagccttgttgactctgatgatgaggacaatttttcatatattccacttagtacagcaaacctgccaaattcatcttctactcttggctgggtcacaccatgtcaaactccatatactcagtatcatctaaataaattggatcagaacataatacctgaaaatttgccagcaccaacagacaaatgtaaactaaaatatcagcaatgtaaaactgaaattaaagagggctataagcagtatagtcagagaaatgcagaaaatacaaaatcaaatgttacacataaacagtctccaagaaacaagatagatgaaaagtgtgtgcaagatgaagaagccaacacagatgaccttacgactctggataggaaagccatcttacagcaaggttatgcagacaactcttgcgataaacaacagagggcaagaaaattggatgcagaaattgtggctgcagagaagaagaaacagattgttgcagagcaagtgatgatagaccacttatctagggctgtcatcagtgatccagagcaaaatttagccattgagcaaaaagaaagtgatcatatccttccagattcaaagatgacacctcttcgatttagaaaaagaacactacatgaaacaaagataagaactcattctacattaactgaaaatgtgctttctcataaattacagtttgatggtaggatcgtatcacgtaatggacgtgatgcttgcagagagctcattgggttctttttcactcatgaccaatcccttacaatttatgaatatcgacaatttgggaaaaatagaacaaatgtgcttccttttattcaaaaaagcatttatagtcatcagtgtggacgaagaaaaggaaaacaataccgacttggtgatttttatgttggtgcaaccttgacatttttgagttctgatcatctcagccttccagaaagcatcaaagaaaacacattacttaaactccgaatcacaaatattgatcaaatagctttggattctctcaaaactgcttctatggaacaggaggatgatataatcattcaagaaaccaatgataggctggtcttcaaagcaattcaagatgtgctaaaagaaaaactacataaaagaggtgttcgtattttgactggattgggaaaatattttcaacagttggacaaggaaggaaatggacttttagataaggcagattttaagcaagctctaaaagtgtttcacttagaagtgtctgaaaaggattttgagtctgcatggctaattctgaatgacaatggcaatggcaaggttgattatggagaattcaaacgtggtattattggtgaaatgaatgaatacaggaaatcatatgttcgaaaggcctttatgaaactggatttcaacaaaagtggcagtgtgcctattataaacataagaaaatgttactgtgcaaagaagcattctcaagtaatttcaggttgaccagcaaggacaaacatgaaaatgcttaaaaaaaagaaagcgcttaaaacaaagaaatagaaggtaatgggcatatataaaataagccaagcaagagaagagcaaagacaatctgcagggtggacatggatgtattcgtttctgatcatgagaagaggctcttgtcatacatatcgttccatttttattttaaagttctataaacttctgaggtaaactgatttcttggatgtacttaataaagaataaatgtttcatattgga

SEQ ID NO: 4296 - DNA, 2569 bp, Homo sapiens
ggggagaggaggggaaagctagacctgcagagtgaagaaagctggtaatagatgtctgacaaactaaagaaagacttgtgttacgatcagaacataatacctgaaaatttgccagcaccaacagacaaatgtaaactaaaatatcagcaatgtaaaactgaaattaaagagggctataagcagtatagtcagagaaatgcagaaaatacaaaatcaaatgttacacataaacagtctccaagaaacaagatagatgaaaagtgtgtgcaagatgaagaagccaacacagatgaccttacgactctggataggaaagccatcttacagcaaggttatgcagacaactcttgcgataaacaacagagggcaagaaaattggatgcagtaagttgtcagcatttttacttatttggaaattgtggctgcagagaagaagaaacagattgttgcagagcaagtgatgatagaccacttatctagggctgtcatcagtgatccagagcaaaatttagccattgagcaaaaagaaagtgatcatatccttccagattcaaagatgacacctcttcgatttagaaaaagaacactacatgaaacaaaggtgcaaccttgacatttttgagttctgatcatctcagccttccagaaagcatcaaagaaaacacattacttaaactccgaatcacaaatattgatcaaatagctttggattctctcaaaactgcttctatggaacaggaggatgatataatcattcaagaaaccaatgataggctggtcttcaaagcaattcaagatgtgctaaaagaaaaactacataaaagaggtgttcgtattttgactggattgggaaaatattttcaacagttggacaaggaaggaaatggacttttagataaggcagattttaagcaagctctaaaagtgtttcacttagaagtgtctgaaaaggattttgagtctgcatggctaattctgaatgacaatggcaatggcaaggttgattatggagaattcaaacgtggtattattggtgaaatgaatgaatacaggaaatcatatgttcgaaaggcctttatgaaactggatttcaacaaaagtggcagtgtgcctattataaacataagaaaatgttactgtgcaaagaagcattctcaagtaatttcaggccattcaacagaggaagaaatcaaatcatcctttctagaaacattaaaagttgcctgcagcaagtctgatgaagtgtcatatggtgaatttgaagattactatgaaggtttaagtataggaatagtagatgatgaagactttgttaacatcttacgtactccatgggggatttagtctttaataatacatatgtcatcaacactaagcattttattggagagatgatatcaatgtaaaggatgatcaaacactggaatatattttcctaggacttcctttattctggtttcttgtttgtttgttttgttttgttttgttttctcaaaaatgttgaatttggaaagagaactatccagaaagatagatgtaggggtgtgttagtgtttgtgcatgtgtatgcctgttcacatgtccttacatttgtaaagatatctttttggtttattacttatcttgcgtatattttagaggtcattttttattaacttcagtaggaaagttacatctgcatcaaacaatatggcaacatctatttattaaccaagtttcctgtcctttcacattgttttttgctacctcttcctcagaatatatttgccaccatggtcaatttgataaattagaattgggcccaaagccagtgagataattcaatgtgtttttaacacatgaaaatattaaaggatatgcaagagaaatttttcaagcagtgtgattatagatgttttctgtatatagaatatttcaaatgatggaggtttaccccatgatgctcatttaaatactgacttgtcttttaaatctgtcttctaaattatgtactgttgttggttaaatagagcacaatgtagttattctaatgcccagttgtatttgttcttttattctgctttttaactgtaatcctttttaccagcatacgattgttattgagcaatatgaaagggaaatgttctttattaaaatcaatacattatcttattaaacaaagatcctaaaagtatattgttgcatatatgaatccaaggaatagttcagtaattattgcctaaaatgtgaaagcatattttgtatcctaaaatgaatgtatgatattctaaacatctgttttagtataacaaacaattgaaacatttccttctaaatatatgttatttaatagttacatgtattataatcattctttctaaattctttgctagtcatttcttcctgggaatacagagaaaagagacaactttatgagttgttttcaacttcataattttaaattttctatgttaatataacataaattagaaaaaataagtgattcaaaatgaaaatatttactttgtagaatatgactttagacatatcactgtatccatctatacttggcagcaacatgagaagtgtg

SEQ ID NO: 4297 - DNA, 6289 bp, Homo sapiens
gactccagctccgcggcgccctcgccgggtgcgtgccgctcgcgcgcccgccagccaggctctccgcgcccgccgcccgcgccgcgctggcccgggctctcccgcccgcgcttcatggctgcacacgagtgggactggttccaacgcgaggagctcatcgggcagattagcgacatccgagtgcagaacctgcaagttgagagggaaaatgtgcagaagaggacctttacacgatggataaatctacatctagaaaagtgcaacccacctctagaagttaaagatttattcgtcgatatacaagatggcaaaatcctaatggctttgttagaagtcctgtctgggcggaatctgctgcacgaatacaaatcctcgtcgcatcgtatttttcggttgaacaacatagcgaaagcacttaagtttttggaagatagcaatgtaaaactggttagcattgatgcagcagaaatagcagatggcaacccttctttggttcttgggctgatatggaacataatcctcttcttccagattaaggagctcacaggcaacctcagcagaaactctccatcttccagcttgtcccctggctcagggggcacagactcagactcatccttcccacccacacccactgcagagaggagcgtggcaatatcggtgaaagaccagaggaaggctatcaaggccctgttggcgtgggtgcagaggaaaacgagaaagtatggcgtggcggtgcaggactttgcgggcagttggaggagtgggctggctttcctggcggtgatcaaggccattgaccccagcctggtggacatgaaacaggccctggaaaattccacacgagaaaatctagagaaggctttcagcatcgcacaggatgccctgcacatccccaggctcctggagccagaagacatcatggttgacacaccagacgagcagtctatcatgacttacgtggcacagtttctagaacgttttccggagttggaagccgaagatattttcgattcagataaagaagttcctatcgaatccacttttgttcgcatcaaagaaactccttctgaacaggagagcaaagtcttcgttctgactgaaaatggggagcgtacctacactgttaaccatgaaaccagccacccaccaccctccaaagtctttgtctgtgacaagcccgagagcatgaaggaattccgcctggatggtgtttccagccatgcgctgtcagacagctccaccgagttcatgcaccagattattgaccaggtcctgcaagggggcccaggtaagaccagcgacatcagtgagccatctccagaatcctccattttatcatccagaaaggagaacgggaggtccaactctttgccgatcaagaaaacagttcactttgaggctgacacctacaaggatcctttctgcagtaagaacctgtccctttgctttgaagggagcccaagagtggcaaaggaatcattgaggcaggatggacatgtcttggcagttgaggttgctgaggaaaaggaacagaaacaggaatcctcgaagattccagaatcctcctctgacaaggtcgctggtgacatttttttggtggagggcacaaacaataattctcagtcttcttcctgtaatggtgctttagagagtacagcccgccacgatgaagaaagtcactctctttcacccccaggagaaaatactgtgatggccgattccttccagatcaaggttaacctgatgactgtagaagctttagaggagggagactattttgaagccatcccattaaaagcctcaaaatttaacagcgacctaatagattttgcttctaccagccaggctttcaacaaagttccttcacctcatgagacaaaacctgacgaggatgctgaggcttttgagaatcatgctgaaaaactaggtaaaaggagtattaaatctgctcacaaaaagaaggattcgccagagcctcaagttaagatggacaaacatgaacctcatcaggactccggagaagaagctgaaggctgtccttcagccccagaagagacaccagtggataaaaagccagaggtgcatgaaaaggccaagagaaagtccacccgtcctcattatgaggaagagggagaagacgatgacctccagggtgtgggcgaggaattatcttccagccccccaagcagctgtgtcagcttggagacccttgggagtcacagcgaagaaggcctggatttcaagccctccccacccctctcaaaggtttccgtcattccccacgacctcttctatttcccacactatgaggttcccctggctgcagttttggaggcttatgtagaagacccggaggatctaaaaaatgaagaaatggatctcgaagagccagagggctatatgccagacctggactccagggaggaggaggccgatggctctcagagcagctccagttcctcggtgccaggagagagcctccccagtgccagcgaccaggtgctgtatctcagcaggggtggtgtgggtaccacaccagcctcagaacccgctccactggccccccatgaggaccaccagcaaagggagaccaaagagaatgaccccatggacagccatcagtcccaggaatccccaaacctggaaaacatagcaaaccccctagaagaaaatgtaacgaaagaatcaatcagtagtaaaaaaaaggaaaaaaggaaacatgtggaccacgtagaaagttcactatttgtagcaccaggaagtgttcaatcctcagatgacctagaagaagacagtagcgactacagcattccttccaggactagtcacagtgactccagcatttaccttcgacgacatactcataggtcttcggaatcggatcattttagctatgttcagttgaggaacgcagcagatctggatgacagaagaaaccgaatattaaccaggaaggccaacagctcaggagaagccatgtcactggggagccacagcccgcagagtgactccctgacacagcttgtccagcagccggatatgatgtattttattctcttcctgtggctcctggtgtactgcttgctgctcttcccacaactggatgttagcaggctctgatacgtgtgtctggataataaaaaagacaggaccctgaccaggggcggggttacttcattttattttgggttctgggtggggcacttctacagacagttgaggacctccgaggaaacttagaccccctttctcgctattgtggtttttttttttttttcaggtttccttttttttctggacaacctgagcatgcttttttctttggctgtgtactcaaaactcaggcatgcagctggatccgtaggtggggttttgtccttgtgtgccttgctgggttggatagggagcattgttagtgatcattagcccgcctggatcttagcacaccccacattgcaggttcacacgctggatgaacttgagtttcttacctctcagatgaagggctgcttaatgagaaagagggtgggcaccccaggccaagccccagctggggagagagctgccacgttttcctccaagcgtgggtgtttgagagaaggtgctggggtccatgcacctgtcgcagtccggtaactggttgcattcactaggggaaatccgagcagccagctctgtgtaagcacatccaggaatggcagaatccagggaggaaggtgaaagctgtgttgagagccactgtgtgctctttttcaccctgttttttttgttgtttttttgttttgttttttgtttgaggggagataacacttgaaattcagttttccattgattggattgagatagaaccatgattttcaaaccagatcgccagggcccagcagggccatataaaagccatgaggagtggctgggctggaatcagctcccagcagtgctggagctgggtggtggggtagcttcctgcccactaaagctttggtgcacacctccctcagaatgcatgtcttggaacgggcattctttgtggtcacttgtaatgggtttcttgaagaggctttctggacagcactccgggagcaggccagcacaggaggtttgtgaaagaagagaggcatctctagcacccctgcccccagtcttcctcagccccaggctccctctgctctctcctccctgccaagactcaggtccgtggtgagtctctgcattggttcctcctccccttgctctccccttcagaaagcatgtaccaggcaacccttataaaatcacaaatgagtcaggaggggactcagtgagcatcttgtctagctggacccagagagacagagcagcttgaccaagatcatatagccgaccaggggcagacttgcagtgagcacacaggcacctgatgccctgtccagagctgtcaccccttgtaggaaacttccactgggcacaccaatgtcctgagaaaaagataaaatgactagattaaaatgtccacattcaagcaaaaccaaaaagtttagaccaactatcgacatttgttttgttcttgtatttttcccatgaggaattcttactcaccttcaagctcatccccaattccttctgaaatacccttgacagctgcaacagcttgtcatttgacataccagcgtcgctcttactccaggaatcacgtttctttctttgctagccaaggacttgctcatttcaagcagtgggtttcaagtttacagaattccagcatggccagaagaatttacatagcacatctgagtcgatgacagccaaaatctggcctctaaaccagtctgattatagtctgtctcccctcctgaaagaatttcagccttccaaccagaaagctgctgggagcttggagtgattccatctggaaggccaagagccccatggaaaatgagctaattaatgagctccctggcatcaatgaaagctcaaaggtacagataataaagattatgtgatagtttataactctgggcaccatgcagtccttgcctaaattagatgctcgaagagcctgggaagagccaacccaaatgtgaatcatttcattttatgggtctagaccttgttcagaaaaacctctgcaagatacttctctcacctattacaacttgtaatattgtttaaaacatctactggcaagatgcctgaaagtcatttggttcaggttggcagtcaactgatattttgcaaaggaaaaaaaaatctcatttgagtataggcttctatggaagaagctggatatagaaaatggatgtggaagtctgcaggacaaaccaccccattgcttgtaaattttttttaaattaaaagaaatacaataaggcttttaacaagaactagcagtcccctaagtctcgctgcttagaagtaaccactttcaactctcttatgtttgcatttctacataacgtgcttacactttattttttaatttagaaacatctactggcttgctgtcacagtagaggaggatttcactcttaccataccgtgctttggttttccagtatagctagatcacatcatttagtacatttctattaggtgttgacattacctggagcacttaaggattgttgactcccaagcccagcagtgtgttatggttacatgtcctttctcctccaaatgtccccattaatttgctattctctctctttactttttttttttttttggtgtggcacattctttaataacttcctgaggaagagaacatgggaagtaaatatggttgtaaatattttgagatttttgcatgacttaagatgtctgtattctgcccttaacagaaatgtggctgagcatagaatgacaggtggaaaataataccctcccctagcccctcccaagcgtgctggttgagatttctgatgccattctgattcccgtacctttatatgtgacttaggtttttttatccacccttcctggaaacatttaagatctctttattcttggtgttctgaactgtcatgatggtgttgtatcccgggtgttaaaccttgtgctgggccttcatgggaaatttcttaaattttcttgtgattatttacattctttctttctggaccacctattatttcaatgttggaccctcccctacacccaggctgatgctctaatattttttatcttttctatttttcgtctatgtttctgatctgctttcaggaagaattattcatttttatcttcccaatctgaatgttttattgaatttttattttccaagttaataaaacctttggttattatcctg

SEQ ID NO: 4298 - DNA, 4242 bp, Homo sapiens
gatacggcgcaccatatatatatcgcggggcgcagactcgcgctccggcagtggtgctgggagtgtcgtggacgccgtgccgttactcgtagtcaggcggcggcgcaggcggcggcggcggcatagcgcacagcgcgccttagcagcagcagcagcagcagcggcatcggaggtacccccgccgtcgcagcccccgcgctggtgcagccaccctcgctccctctgctcttcctcccttcgctcgcaccatggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaaggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtctttttttttttttttccaataaaaagaccattaacttaaagtggtgttaaatgctttgtaaagctgagatctaaatggggacaaggcaggtggaggggaggccagtgtacatgtaaatgcccacagcccagcattgggtttccctcccaaggccccagcaccaacctctgagcccaagaccttgcctgaaaacaagcagataccgattgcttcatcctatttatggacatgtaggtctagttgcattttcactggggggaggggggaaggtgaattatggtaacttttaatgatctattcaggcagtagagctcttaaggaaaaaaaaaaacccactttctctcaagcatgtatttaggggttgttctcaattgtgctgctgattacctgtcttatgtaactacttgagaccatctgcaagagacatgatttagtgtgtctgtaattcaatcttcgctgtgtgtggtagaagcagtagtcacttttgtaagccagtctcttcatgcctaaaagacactaccagtcacctttgattcgcgacttttaatttatgattatacttagcctcctcctcctttttttttttttcccaagttgacttgactttgcttttttccccccaagtagaactaatgctagcttccagcttgaaagtaaaactccagtgtggagtgaattttgtgtctaattataaacctgtaaccaaaactcagacatctggtactggtctttgcattgagattggtccctgtaaaaccccctttaaaagcatattgcatttagtacagagctcttttttgaaatgaaggctggagatgtgcatttttcacggtgttaactggttgtatcttattagcaaggagattggggttttgagtgtttgcgtgggtggtttcaatttgccagggaacagtggcaggctgctagcaaggcagtgagaagctcttggcagccaaatgggtgcattcagggctgatttatagagacccttggcttctccttctcctactccctgtctttctggcattttgtagcttgttagattttctgccagaggggtgggtcagagcagtggaggggagacatcgcccatgtgcttctgctactggtccttgggctgggtggttggtagaggagatgttgacactatgagctaagggttggcttttgtaattacctgaatctgaaaggaatgcctaaggttaccttggggtttctcttctggtgagatagggttcctggtttgagtaagttaatgtcctggatatttcttgtggcagggggtggtcaaagagcctgattgctgacccagtctcaggcctgtggtcgatgacctctcggtagtttcaaagggggctggagggggatatttgacttgttttttcgaaatgtagccttctaaccctcaagtctttagaagctgggtggactcttagtggtcctgcagcgtatcctaaaagactacctttgaaacaggattcttgtatggccaggatcctgtctgggaaccagaaaccctacaccctccccctccagggaatgctgagttccagttttgagcagaggtgaggcagaatccactgtagccttccgccctggtatttggggggatgaccagcccaggcgttgggtgttagtctgcatgagtttgtgagaggaaatagctgggtgtcctggcagtgcccttgaagttggttaggaccttcctgtaaactcttgcccctacttctaactactctataaatatatacatatatttatatataaagtgattagttgaactggcatcctgctttagcctgagacttgccataagaaactgctgagtacttggcaaaccctttcatagttttgttctccatctgtttggggtaggtgttgagcgaggcaaatggatctcgatatttcagatgggcttttgatgcactgttgccaaggaaggctttttctgattttttgacaaatgaatttttgcacactttcattggtgtctttcggcaacttacacacattgaaaatgagctattgtacatatttttatattctctttataaatgcatgtctgattgtacttgtaacaatattgtaatgaacggctgtgcagtaggcccagcgctgctgtgtctcgtcagaggaatagcttaccacgaacccctcagcatactgggaatctcttcctgaacaacgaatgtaaatttggtcaagtctactcttccgttcattcaattattttaagcatttgaattatttattgtatatcctaaatatatttctcctttggcagtgactagatttccactaatgtgtcttaatctatccctccagctggcagttactgtttttttaatcccctgaagttgtcctgtaggagacagaaattctttgctgtctgtatcccttggagtaagaaggtagtggcatgggtggagtgtgtgttctttctccaaatctattatgatgtttattaaacacttctgtagcaaagatggtggtagttcttttgttactgaagttgcccttcaccatggctatttgaaaaggagatgtacttggacgtttctgtaaatcttgagataaactgtttggagatttaaccacctctctgatgggggaccaactctatggaaattgtaaatacgttttatttataaacctggcactgtattcaataaacatttctgcagcctttca

SEQ ID NO: 4299 - DNA, 1302 bp, Homo sapiens
ctcgtttgcgatgttccgttatctggatgcggcggagggatctggcggagggaggtgtttatgaggcgctgggggcggaggaggcgaattagtccgagtggagagagcgagctgagtggttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattagtgctgcagaacttcgccatgtgatgacaaaccttggagagaagttaacagatgaagaagttgatgaaatgatcagggaagcagatattgatggtgatggtcaagtaaactatgaagagtttgtacaaatgatgacagcaaagtgaagaccttgtacagaatgtgttaaatttcttgtacaaaattgtttatttgccttttctttgtttgtaacttatctgtaaaaggtttctccctactgtcaaaaaaatatgcatgtatagtaattaggacttcattcctccatgttttcttcccttatcttactgtcattgtcctaaaaccttattttagaaaattgatcaagtaacatgttgcatgtggcttactctggatatatctaagcccttctgcacatctaaacttagatggagttggtcaaatgagggaacatctgggttatgccttttttaaagtagttttctttaggaactgtcagcatgttgttgttgaagtgtggagttgtaactctgcgtggactatggacagtcaacaatatgtacttaaaagttgcactattgcaaaacgggtgtattatccaggtactcgtacactatttttttgtactgctggtcctgtaccagaaacattttcttttattgttacttgctttttaaactttgtttagccacttaaaatctgcttatggcacaatttgcctcaaaatccattccaagttgtatatttgttttccaataaaaaaattacaatttacccaatggttgctctgcatctgagtcatttaactgttgaagtctaataattttgaaaataaaatatggcattggtttctgcttggta

SEQ ID NO: 4300 - DNA, 2163 bp, Homo sapiens
gcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccatgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcaaattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccacctccccaccccaccccccaccccctgcttcccctcactgcccaggtcgatcaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctga

SEQ ID NO: 4301 - DNA, 655 bp, Homo sapiens
ggagattagaagatactcttgaaggcttccgggacggagaaggatcagggtcgtggaggtggtgaaaagggatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagca

SEQ ID NO: 4302 - DNA, 6581 bp, Homo sapiens
gacgctcctcccggagagtagtgagacccctggtgcggggcgattggcggcgggagcgatgagtggcagccgcacggcccaacgggagctgtgcgtgggccgcggggcggggccagggcgggtgcgcggcggcggcggggtggctgggccggcggcggcggcggtacgaggcgcgcgctcggggtcccggtcgcgaggaggaggaggatgtggcgcgcggaggggaaatggctgccgaaaacaagccggaagagcgtttcccaaagtgtattctgcggaactagcacctactgtgttctcaacaccgtgccacctatagaagatgatcatgggaacagcaatagtagtcatgtaaaaatctttttaccgaaaaagctgcttgaatgtctgccgaaatgttcaagtttaccaaaagagaggcaccgctggaacactaatgaggaaattgcagcttatttaataacatttgagaaacacgaagaatggctaaccacctcccctaagacaagaccacagaatggctcaatgatactctacaacaggaagaaagtgaaatacaggaaagatgggtattgctggaaaaagaggaaagatgggaaaacgaccagagaggaccacatgaaactcaaggtccagggagtggagtgcttgtacggctgctatgtccattcctccatcatccccaccttccaccggaggtgctactggctccttcagaaccccgacatcgtcctggtgcactacctgaacgtgccggccatcgaggactgcggcaagccttgcggccccatcctctgctccatcaacaccgacaagaaggagtgggcgaaatggacgaaagaagagctcatcgggcagctgaaacccatgttccatggcatcaagtggacctgcagcaatgggaacagcagctcaggcttctcggtggaacagctggtgcagcagatcctcgacagccaccagaccaagccccagccgcggacccacaactgcctctgcaccggcagcctgggagctggcggcagcgtgcatcacaagtgtaacagcgccaaacaccgcatcatctcgcccaaggtggagccacggacaggggggtacgggagccactcggaggtgcagcacaatgacgtgtcggagggcaagcacgagcacagccacagcaagggctccagccgtgagaagaggaacggcaaggtggccaagcccgtgctcctgcaccagagcagcaccgaggtctcctccaccaaccaggtggaagtccccgacaccacccagagctcccctgtgtccatcagcagcgggctcaacagcgacccggacatggtggacagcccggtggtcacaggtgtgtccggtatggcggtggcctctgtgatggggagcttgtcccagagcgccacggtgttcatgtcagaggtcaccaatgaggccgtgtacaccatgtcccccaccgctggccccaaccaccacctcctctcacctgacgcctctcagggcctcgtcctggccgtgagctctgatggccacaagttcgcctttcccaccacgggcagctcggagagcctgtccatgctgcccaccaacgtgtccgaagagctggtcctctccaccaccctcgacggtggccggaagattccagaaaccaccatgaactttgaccccgactgtttccttaataacccaaagcagggccagacgtacgggggtggaggcctgaaagccgagatggtcagctccaacatccggcactcgccacccggggagcggagcttcagctttaccaccgtcctcaccaaggagatcaagaccgaggacacctccttcgagcagcagatggccaaagaagcgtactcctcctccgcggcggctgtggcagccagctccctcaccctgaccgccggctccagcctcctgccgtcgggcggcggcctgagtcccagcaccaccctggagcagatggacttcagcgccatcgactccaacaaggactacacgtccagcttcagccagacgggccacagcccccacatccaccagaccccctccccgagcttcttcctgcaggacgccagcaaacccctccccgtcgagcagaacacccacagcagcctgagtgactctgggggcaccttcgtgatgcccacggtgaaaacggaggcctcgtcccaaaccagctcctgcagcggtcacgtggagacgcggatcgagtccacttcctccctccacctcatgcagttccaggccaacttccaggccatgacggcagaaggggaggtcaccatggagacctcgcaggcggcggaagggagcgaggtcctgctcaagtctggggagctgcaggcttgcagctctgagcactacctgcagccggagaccaacggggtaatccgaagcgccggcggcgtccccatcctcccgggcaacgtggtgcagggactctaccccgtggcccagcccagcctcggcaacgcctccaacatggagctcagcctggaccactttgacatctccttcagcaaccagttctccgacctgatcaacgacttcatctccgtggaggggggcagcagcaccatctatgggcaccagctggtgtcgggggacagcacggcgctctcacagtcagaggacggggcgcgggcccccttcacccaggcagagatgtgcctcccctgctgtagcccccagcagggtagcctgcagctgagcagctcggagggcggggccagcaccatggcctacatgcacgtcgccgaggtggtctcggccgcctcggcccagggcaccctaggcatgctgcagcagagcggacgggtgttcatggtgaccgactactccccagagtggtcttacccagagggaggagtgaaggtcctcatcacaggcccgtggcaagaagccagcaataactacagctgcctgtttgaccagatctcagtgcctgcatccctgattcagcctggggtgctgcgctgctactgcccagcccatgacactggtcttgtgaccctacaagttgccttcaacaaccagatcatctccaactcggtggtgtttgagtacaaagcccgggctctgcccacgctcccttcctcccagcacgactggctgtcgttggacgataaccagttcaggatgtccatcctggaacgactggagcagatggagaggaggatggccgagatgacggggtcccagcagcacaaacaggcgagcggaggcggcagcagtggaggcggcagcgggagcgggaatggagggagccaggcacagtgtgcttctgggactggggccttggggagctgctttgagagccgtgtggtcgtggtatgcgagaagatgatgagccgagcctgctgggcgaagtccaagcacttgatccactcaaagactttccgcggaatgaccctactccacctggccgctgcccagggctatgccaccctaatccagaccctcatcaaatggcgtacaaagcacgcggatagcattgacctggaactggaagttgaccccttgaatgtggaccacttctcctgtactcctctgatgtgggcgtgtgccctagggcacttggaagctgccgtcgtgctgtacaagtgggaccgtcgggccatctcgattcccgactctctaggaaggctgcctttgggaattgccaggtcacggggtcatgtgaaattagcagagtgtctggagcacctgcagagagatgagcaggctcagctgggacagaaccccagaatccactgtcctgcaagcgaagagcccagcacagagagctggatggcccagtggcacagcgaagccatcagctctccagaaatacccaagggagtcactgttattgcaagcaccaacccagagctgagaagacctcgttctgaaccctctaattactacagcagtgagagccacaaagattatccggctcccaaaaagcataaattgaaccctgagtacttccagacaaggcaggagaagctgcttcccactgcactgagtctggaagagccaaatatcaggaagcaaagccctagttctaagcagtctgtccccgagacactcagccccagtgaaggagtgagggacttcagccgggaactctcccctcccactccagagactgcagcatttcaagcctctggatctcagcctgtaggaaagtggaattccaaagatctttacattggtgtgtctacagtacaggtgactggaaatccgaaggggaccagtgtaggaaaggaggcagcaccttcacaggtgcgtccacgggaaccaatgagtgtcctgatgatggctaacagagaggtggtgaatacagagctggggtcctaccgtgatagtgcagaaaatgaagaatgcggccagcccatggatgacatacaggtgaacatgatgaccttggcagaacacattattgaagccacacctgaccgaatcaagcaggagaattttgtgcccatggagtcctcaggattggaaagaacagaccctgccaccattagcagtacaatgagctggctggccagttatctagcggatgctgactgccttcccagtgctgcccagatccgaagtgcatataacgagcctctaaccccttcttctaataccagcttgagccctgttggctctcccgtcagtgaaatcgctttcgagaaacctaaccttccctccgccgcggattggtcagaattcctgagtgcatctaccagtgagaaggtagagaatgagtttgctcagctcactctgtctgatcatgaacagagagaactctatgaggctgccaggcttgtccagacagctttccggaaatacaagggccgacccttgcgggaacagcaagaagtagctgctgctgttattcagcgttgttacagaaaatataaacagtacgcactttataaaaagatgacacaggctgccatccttatccagagcaaattccgaagttactatgaacaaaaaaaattccagcagagccgacgggctgctgtgctcatccaaaagtactaccgaagttataagaaatgtggcaaaagacggcaggctcgccggacggctgtgattgtacaacagaaactcaggagcagtttgctaaccaaaaagcaggatcaagctgctcgaaaaataatgaggtttcttcgccgctgtcgccacagccccctggtggaccataggctgtacaaaaggagtgaaagaattgaaaaaggccaaggaacttgaagacatacagcagcatcccttagcaatgtgacattgcttttcagactgttttcatttctgtttttagcagagacatgcaacaacaacacacacgcacacacgcacacacacacacgtacacacacatacaaaatccctctgcagttttggggagatcagctgcaggattttaacaggaatgttttggtcattgcatttgcactttcatggacaacttttaatttgatcagcaagacatcttggaactcaatcttctgttggatcacgggaaatcaagacacccaggaggaattgaaagaggcttcctcttctcaggaagaagccatttccttctcatatagggctgtattcaaacatcgtgtggaactgtacaaatatttataccaaaaatatagataagaaaaggtggggctatactagcaacaaaaaaagaatgctgttcctgcacctgccggttatttccaagaagctgaatctttgggactgattctcagtggagggcttagatcatacaaaaatctttattgggtccgtgtgttctcatttccttcactgtttatttttgtttgtttgtttgtttgttttaatctctacagcacatttaatgcaacttttgaaatctgcaggtttttaatgtcttgtggaaatttgcagaggggcaggtgtgtggtaaacgggtaatgcatgggaaataatgagaagcagctcacagagtttaaactattttcttgtccccaccaccttccaagaacctgcgagggtagtaatcatcttgtcccctttttcatgttcagcactttaatttttttgccttactttcatgtgcaatgagaattacttaagaattggtaacgcatgtagccttttttagtaaccttggaagctgtagtaattctaaggaatcatgaaccttgcctggacatttgccacctaaacgatcagtgtggtgctgcgttctggccagtaaattccatgtttttggctatatctcatccaaactgagcagtttctgtgtatatatagaaggtagaaatgaaaagtgagaaaatatttgaaagggattatattaattgctaaatattttattcacaaaggtcaataacatggcaagataaaattatttgtatagttttgtctgaatgagcgagaaaaatgtggatgtactgtttgtatatattgtatatattaaaacagagatatgtgcatgaaatcaagaaaaaagaaatgaacaaaagcaaagcattagtggctatggtctgtaaaatgaaacaaaaaaactttatttcactataagagtactttattttaaatgttctttaggagaacattttgctaaagcatgactaaactgc

SEQ ID NO: 4303 - DNA, 2467 bp, Homo sapiens
gcagtcgcagcgcaaagggggccgcgggaacagctagtcgggagcgcgggggtcccgggcctctggccagccacggggcctggccatgaactttgcgtccgggccaatgctgcagtggccgggcggtgataaccagttcaggatgtccatcctggaacgactggagcagatggagaggaggatggccgagatgacggggtcccagcagcacaaacaggcgagcggaggcggcagcagtggaggcggcagcgggagcgggaatggagggagccaggcacagtgtgcttctgggactggggccttggggagctgctttgagagccgtgtggtcgtggtatgcgagaagatgatgagccgagcctgctgggcgaagtccaagcacttgatccactcaaagactttccgcggaatgaccctactccacctggccgctgcccagggctatgccaccctaatccagaccctcatcaaatggcgtacaaagcacgcggatagcattgacctggaactggaagttgaccccttgaatgtggaccacttctcctgtactcctctgatgtgggcgtgtgccctagggcacttggaagctgccgtcgtgctgtacaagtgggaccgtcgggccatctcgattcccgactctctaggaaggctgcctttgggaattgccaggtcacggggtcatgtgaaattagcagagtgtctggagcacctgcagagagatgagcaggctcagctgggacagaaccccagaatccactgtcctgcaagcgaagagcccagcacagagagctggatggcccagtggcacagcgaagccatcagctctccagaaatacccaagggagtcactgttattgcaagcaccaacccagagctgagaagacctcgttctgaaccctctaattactacagcagtgagagccacaaagattatccggctcccaaaaagcataaattgaaccctgagtacttccagacaaggcaggagaagctgcttcccactgcactgagtctggaagagccaaatatcaggaagcaaagccctagttctaagcagtctgtccccgagacactcagccccagtgaaggagtgagggacttcagccgggaactctcccctcccactccagagactgcagcatttcaagcctctggatctcagcctgtaggaaagtggaattccaaagatctttacattggtgtgtctacagtacaggtgactggaaatccgaaggggaccagtgtaggaaaggaggcagcaccttcacaggtgcgtccacgggaaccaatgagtgtcctgatgatggctaacagagaggtggtgaatacagagctggggtcctaccgtgatagtgcagaaaatgaagaatgcggccagcccatggatgacatacaggtgaacatgatgaccttggcagaacacattattgaagccacacctgaccgaatcaagcaggagaattttgtgcccatggagtcctcaggattggaaagaacagaccctgccaccattagcagtacaatgagctggctggccagttatctagcggatgctgactgccttcccagtgctgcccagatccgaagtgcatataacgagcctctaaccccttcttctaataccagcttgagccctgttggctctcccgtcagtgaaatcgctttcgagaaacctaaccttccctccgccgcggattggtcagaattcctgagtgcatctaccagtgagaaggtagagaatgagtttgctcagctcactctgtctgatcatgaacagagagaactctatgaggctgccaggcttgtccagacagctttccggaaatacaagggccgacccttgcgggaacagcaagaagtagctgctgctgttattcagcgttgttacagaaaatataaacagggaaaaaatatatgtctgaagtacgcactttataaaaagatgacacaggctgccatccttatccagagcaaattccgaagttactatgaacaaaaaaaattccagcagagccgacgggctgctgtgctcatccaaaagtactaccgaagttataagaaatgtggcaaaagacggcaggctcgccggacggctgtgattgtacaacagaaactcaggagcagtttgctaaccaaaaagcaggatcaagctgctcgaaaaataatgaggtttcttcgccgctgtcgccacagagtgaaagaattgaaaaaggccaaggaacttgaagacatacagcagcatcccttagcaatgtgacattgcttttcagactgttttcatttctgtttttagcagagacatgcaacaacaacacacacgcacacacgcacacacacacacgtacacacacatacaaaatccctctgcagttttggggagatcagctgcaggattttaacaggaatgttttggtcattgcatttgcactttcatggacaacttttaatttgatcagcaagacatctt

SEQ ID NO: 4304 - DNA, 2320 bp, Homo sapiens
gtcttctgctcctgggctgttgctggcaggactcccttggctgccccatctcatcaccaccagccctcaggatggcctgtccagtgagccctgaccataaacaggagggggcccatgacactggtcttgtgaccctacaagttgccttcaacaaccagatcatctccaactcggtggtgtttgagtacaaagcccgggctctgcccacgctcccttcctcccagcacgactggctgtcgttggacgataaccagttcaggatgtccatcctggaacgactggagcagatggagaggaggatggccgagatgacggggtcccagcagcacaaacaggcgagcggaggcggcagcagtggaggcggcagcgggagcgggaatggagggagccaggcacagtgtgcttctgggactggggccttggggagctgctttgagagccgtgtggtcgtggtatgcgagaagatgatgagccgagcctgctgggcgaagtccaagcacttgatccactcaaagactttccgcggaatgaccctactccacctggccgctgcccagggctatgccaccctaatccagaccctcatcaaatggcgtacaaagcacgcggatagcattgacctggaactggaagttgaccccttgaatgtggaccacttctcctgtactcctctgatgtgggcgtgtgccctagggcacttggaagctgccgtcgtgctgtacaagtgggaccgtcgggccatctcgattcccgactctctaggaaggctgcctttgggaattgccaggtcacggggtcatgtgaaattagcagagtgtctggagcacctgcagagagatgagcaggctcagctgggacagaaccccagaatccactgtcctgcaagcgaagagcccagcacagagagctggatggcccagtggcacagcgaagccatcagctctccagaaatacccaagggagtcactgttattgcaagcaccaacccagagctgagaagacctcgttctgaaccctctaattactacagcagtgagagccacaaagattatccggctcccaaaaagcataaattgaaccctgagtacttccagacaaggcaggagaagctgcttcccactgcactgagtctggaagagccaaatatcaggaagcaaagccctagttctaagcagtctgtccccgagacactcagccccagtgaaggagtgagggacttcagccgggaactctcccctcccactccagagactgcagcatttcaagcctctggatctcagcctgtaggaaagtggaattccaaagatctttacattggtgtgtctacagtacaggtgactggaaatccgaaggggaccagtgtaggaaaggaggcagcaccttcacaggtgcgtccacgggaaccaatgagtgtcctgatgatggctaacagagaggtggtgaatacagagctggggtcctaccgtgatagtgcagaaaatgaagaatgcggccagcccatggatgacatacaggtgaacatgatgaccttggcagaacacattattgaagccacacttagcagtacaatgagctggctggccagttatctagcggatgctgactgccttcccagtgctgcccagatccgaagtgcatataacgagcctctaaccccttcttctaataccagcttgagccctgttggctctcccgtcagtgaaatcgctttcgagaaggtagagaatgagtttgctcagctcactctgtctgatcatgaacagagagaactctatgaggctgccaggcttgtccagacagctttccggaaatacaagggccgacccttgcgggaacagcaagaagtagctgctgctgttattcagcgttgttacagaaaatataaacagtacgcactttataaaaagatgacacaggctgccatccttatccagagcaaattccgaagttactatgaacaaaaaaaattccagcagagccgacgggctgctgtgctcatccaaaagtactaccgaagttataagaaatgtggcaaaagacggcaggctcgccggacggctgtgattgtacaacagaaactcaggagcagtttgctaaccaaaaagcaggatcaagctgctcgaaaaataatgaggtttcttcgccgctgtcgccacagagtgaaagaattgaaaaaggccaaggaacttgaagacatacagcagcatcccttagcaatgtgacattgcttttcagactgttttcatttctgtttttagcagagacatgcaacaacaacacacacgcacacacgcacacacacacacgtacacacacatac

SEQ ID NO: 4305 - DNA, 4980 bp, Homo sapiens
atgtggcgcgcggaggggaaatggctgccgaaaacaagccggaagagcgtttcccaaagtgtattctgcggaactagcacctactgtgttctcaacaccgtgccacctatagaagatgatcatgggaacagcaatagtagtcatgtaaaaatctttttaccgaaaaagctgcttgaatgtctgccgaaatgttcaagtttaccaaaagagaggcaccgctggaacactaatgaggaaattgcagcttatttaataacatttgagaaacacgaagaatggctaaccacctcccctaagacaagaccacagaatggctcaatgatactctacaacaggaagaaagtgaaatacaggaaagatgggtattgctggaaaaagaggaaagatgggaaaacgaccagagaggaccacatgaaactcaaggtccagggagtggagtgcttgtacggctgctatgtccattcctccatcatccccaccttccaccggaggtgctactggctccttcagaaccccgacatcgtcctggtgcactacctgaacgtgccggccatcgaggactgcggcaagccttgcggccccatcctctgctccatcaacaccgacaagaaggagtgggcgaaatggacgaaagaagagctcatcgggcagctgaaacccatgttccatggcatcaagtggacctgcagcaatgggaacagcagctcaggcttctcggtggaacagctggtgcagcagatcctcgacagccaccagaccaagccccagccgcggacccacaactgcctctgcaccggcagcctgggagctggcggcagcgtgcatcacaagtgtaacagcgccaaacaccgcatcatctcgcccaaggtggagccacggacaggggggtacgggagccactcggaggtgcagcacaatgacgtgtcggagggcaagcacgagcacagccacagcaagggctccagccgtgagaagaggaacggcaaggtggccaagcccgtgctcctgcaccagagcagcaccgaggtctcctccaccaaccaggtggaagtccccgacaccacccagagctcccctgtgtccatcagcagcgggctcaacagcgacccggacatggtggacagcccggtggtcacaggtgtgtccggtatggcggtggcctctgtgatggggagcttgtcccagagcgccacggtgttcatgtcagaggtcaccaatgaggccgtgtacaccatgtcccccaccgctggccccaaccaccacctcctctcacctgacgcctctcagggcctcgtcctggccgtgagctctgatggccacaagttcgcctttcccaccacgggcagctcggagagcctgtccatgctgcccaccaacgtgtccgaagagctggtcctctccaccaccctcgacggtggccggaagattccagaaaccaccatgaactttgaccccgactgtttccttaataacccaaagcagggccagacgtacgggggtggaggcctgaaagccgagatggtcagctccaacatccggcactcgccacccggggagcggagcttcagctttaccaccgtcctcaccaaggagatcaagaccgaggacacctccttcgagcagcagatggccaaagaagcgtactcctcctccgcggcggctgtggcagccagctccctcaccctgaccgccggctccagcctcctgccgtcgggcggcggcctgagtcccagcaccaccctggagcagatggacttcagcgccatcgactccaacaaggactacacgtccagcttcagccagacgggccacagcccccacatccaccagaccccctccccgagcttcttcctgcaggacgccagcaaacccctccccgtcgagcagaacacccacagcagcctgagtgactctgggggcaccttcgtgatgcccacggtgaaaacggaggcctcgtcccaaaccagctcctgcagcggtcacgtggagacgcggatcgagtccacttcctccctccacctcatgcagttccaggccaacttccaggccatgacggcagaaggggaggtcaccatggagacctcgcaggcggcggaagggagcgaggtcctgctcaagtctggggagctgcaggcttgcagctctgagcactacctgcagccggagaccaacggggtaatccgaagcgccggcggcgtccccatcctcccgggcaacgtggtgcagggactctaccccgtggcccagcccagcctcggcaacgcctccaacatggagctcagcctggaccactttgacatctccttcagcaaccagttctccgacctgatcaacgacttcatctccgtggaggggggcagcagcaccatctatgggcaccagctggtgtcgggggacagcacggcgctctcacagtcagaggacggggcgcgggcccccttcacccaggcagagatgtgcctcccctgctgtagcccccagcagggtagcctgcagctgagcagctcggagggcggggccagcaccatggcctacatgcacgtcgccgaggtggtctcggccgcctcggcccagggcaccctaggcatgctgcagcagagcggacgggtgttcatggtgaccgactactccccagagtggtcttacccagagggaggagtgaaggtcctcatcacaggcccgtggcaagaagccagcaataactacagctgcctgtttgaccagatctcagtgcctgcatccctgattcagcctggggtgctgcgctgctactgcccagcccatgacactggtcttgtgaccctacaagttgccttcaacaaccagatcatctccaactcggtggtgtttgagtacaaagcccgggctctgcccacgctcccttcctcccagcacgactggctgtcgttggacgataaccagttcaggatgtccatcctggaacgactggagcagatggagaggaggatggccgagatgacggggtcccagcagcacaaacaggcgagcggaggcggcagcagtggaggcggcagcgggagcgggaatggagggagccaggcacagtgtgcttctgggactggggccttggggagctgctttgagagccgtgtggtcgtggtatgcgagaagatgatgagccgagcctgctgggcgaagtccaagcacttgatccactcaaagactttccgcggaatgaccctactccacctggccgctgcccagggctatgccaccctaatccagaccctcatcaaatggcgtacaaagcacgcggatagcattgacctggaactggaagttgaccccttgaatgtggaccacttctcctgtactcctctgatgtgggcgtgtgccctagggcacttggaagctgccgtcgtgctgtacaagtgggaccgtcgggccatctcgattcccgactctctaggaaggctgcctttgggaattgccaggtcacggggtcatgtgaaattagcagagtgtctggagcacctgcagagagatgagcaggctcagctgggacagaaccccagaatccactgtcctgcaagcgaagagcccagcacagagagctggatggcccagtggcacagcgaagccatcagctctccagaaatacccaagggagtcactgttattgcaagcaccaacccagagctgagaagacctcgttctgaaccctctaattactacagcagtgagagccacaaagattatccggctcccaaaaagcataaattgaaccctgagtacttccagacaaggcaggagaagctgcttcccactgcactgagtctggaagagccaaatatcaggaagcaaagccctagttctaagcagtctgtccccgagacactcagccccagtgaaggagtgagggacttcagccgggaactctcccctcccactccagagactgcagcatttcaagcctctggatctcagcctgtaggaaagtggaattccaaagatctttacattggtgtgtctacagtacaggtgactggaaatccgaaggggaccagtgtaggaaaggaggcagcaccttcacaggtgcgtccacgggaaccaatgagtgtcctgatgatggctaacagagaggtggtgaatacagagctggggtcctaccgtgatagtgcagaaaatgaagaatgcggccagcccatggatgacatacaggtgaacatgatgaccttggcagaacacattattgaagccacacctgaccgaatcaagcaggagaattttgtgcccatggagtcctcaggattggaaagaacagaccctgccaccattagcagtacaatgagctggctggccagttatctagcggatgctgactgccttcccagtgctgcccagatccgcttgagccctgttggctctcccgtcagtgaaatcgctttcgagaaacctaaccttccctccgccgcggattggtcagaattcctgagtgcatctaccagtgagaaggtagagaatgagtttgctcagctcactctgtctgatcatgaacagagagaactctatgaggctgccaggcttgtccagacagctttccggaaatacaagggccgacccttgcgggaacagcaagaagtagctgctgctgttattcagcgttgttacagaaaatataaacagtacgcactttataaaaagatgacacaggctgccatccttatccagagcaaattccgaagttactatgaacaaaaaaaattccagcagagccgacgggctgctgtgctcatccaaaagtactaccgaagttataagaaatgtggcaaaagacggcaggctcgccggacggctgtgattgtacaacagaaactcaggagcagtttgctaaccaaaaagcaggatcaagctgctcgaaaaataatgaggtttcttcgccgctgtcgccacagagtgaaagaattgaaaaaggccaaggaacttgaagacatacagcagcatcccttagcaatgtga

SEQ ID NO: 4306 - DNA, 567 bp, Homo sapiens
ggcggcggtacgaggcgcgcgctcggggtcccggtcgcgaggaggaggaggatgtggcgcgcggaggggaaatggctgccgaaaacaagccggaagagcgtttcccaaagtgtattctgcggaactagcacctactgtgttctcaacaccgtgccacctatagaagatgatcatgggaacagcaatagtagtcatgtaaaaatctttttaccgaaaaagctgcttgaatgtctgccgaaatgttcaagtttaccaaaagagaggcaccgctggaacactaatgagagatcatgatgcagccgtccttttggatttctttttaataatgtgtgacccttcacctttgatcccctgacctgcattaccttggtaaccatttcattttttaatttaatttcattttttaattttggtgtacaagctgtaacatttcatctttcaaagtgtaacacgctgatttcctcaaatagagatacccctttgagtgataaatttgcaaaatgctgtcttcattttctgtattaaaattcatttcagttttaaaataaagtgtaatctgtgttttca

SEQ ID NO: 4307 - DNA, 486 bp, Homo sapiens
gaggcgcgcgctcggggtcccggtcgcgaggaggaggaggatgtggcgcgcggaggggaaatggctgccgaaaacaagccggaagagcgtttcccaaagtgtattctgcggaactagcacctactgtgttctcaacaccgtgccacctatagaagatgatcatgggaacagcaatagtagtcatgtaaaaatctttttaccgaaaaagctgcttgaatgtctgccgaaatgttcaagtttaccaaaagagaggcaccgctggaacactaatgaggctctcaccacacacttgttcatgggcgcagcaaagaagagggatccacagagctggagccatgagggctgacacattggaatgaaagctggcagaattcgtagggagagctttcccatcctgccagccccatgtctggctttaagacagttctattagtgaattaactgttctcaaaaccccaaattaatttgaaccgaatgttactaaaa

SEQ ID NO: 4308 - DNA, 4491 bp, Homo sapiens
ggggggggtcggtgtggggtagaatggccgctgccgccgtcacccgcgggaccccgggagcacagactccccctccccccggcccctcaggccgggggtgaccttgccccctggagccctcaccatgaataccaaggacaccaccgaggttgctgaaaacagccaccacctgaagatctttctccccaagaagctgctggagtgtcttcctcgctgcccgctgctgcctccagagaggctacggtggaatacaaatgaggagattgcatcctacctgatcacctttgagaagcatgatgagtggctgtcttgtgccccaaagacaaggcctcagaatggctccatcatcctctacaatcgcaagaaggtgaaatatcggaaggatggttacctctggaagaagcggaaggatgggaagaccacccgagaggaccacatgaagctgaaggtccagggcatggagtgtctctatggctgctacgttcactcttccatcgtccccacattccatcggcgctgctactggctgctccagaaccctgacatcgtccttgtgcactacctgaacgtcccagccctggaggactgtggaaagggctgcagccccatcttttgttccatcagcagcgaccgtcgagagtggctgaagtggtcccgggaggagttgttgggacagctgaagcccatgtttcatggcatcaagtggagctgcgggaatggaacagaagagttctctgtagaacacctggtgcagcagattttggacacccacccaaccaagcctgctccccgaacccacgcctgtctctgcagtggggggcttggttctgggagccttacccacaaatgcagcagcacgaaacaccgcatcatctctcccaaagtggagccccgagctttaaccctgacctctatcccccacgctcaccccccagagcctcctccactgatagccccacttcccccagagctccccaaggcacacacctccccatcttcttcctcttcttcctcctcatcaggttttgcagagcccctagaaatcagacctagccctcccacttctcgagggggttcttcaagaggaggcactgctatcctcctcctgacaggactggagcagcgggctggaggcttgacgcccaccaggcacttggctccacaggctgatcctaggccttccatgagtttggcagtggttgtaggcactgagccttctgccccaccagctcctcccagtcctgcctttgaccctgatcgttttctcaacagcccccagaggggccagacatatggaggggggcagggagtaagcccagacttccccgaggcagaggccgctcataccccctgttctgccctagagcctgctgctgccctggagccccaggcagctgctcggggtcccccaccacagtcagtagcaggtgggagaagaggaaactgcttcttcatccaagatgatgacagtggggaggagctcaagggtcacggggctgccccacccataccttcaccccctccctcacccccaccctcacctgcccccttggagccgtcaagcagggtaggaagaggagaggccttgtttggaggacctgttggggccagtgaactggagcccttcagtctttcatcattcccagaccttatgggagaactcatcagtgacgaagctccaagcatccctgctccgaccccccagctgtctcctgctcttagcaccatcacagacttctccccagagtggtcctacccagagggtggggtcaaggtgctcatcacaggtccttggaccgaagccgccgagcattactcctgtgtctttgatcacatcgcagtgccagcctcacttgtccagcctggtgtcttacgctgctactgtcccgcccatgaggtagggctggtgtctttgcaggtggcagggcgggaggggcccctttctgcttctgtgctctttgagtatcgagcccgccgattcctgtctctgcctagtactcaacttgactggctgtcactggacgacaaccagttccggatgtccatactagagcgactggagcagatggagaagcggatggcagagatcgcagcagctgggcaggtgccttgccagggtcctgatgctcctccagttcaggatgaaggccaggggcctgggttcgaagcacgggtagtggtcttggtagaaagcatgatcccacgctccacctggaagggtcctgaacgtctggcccatggaagccccttccggggcatgagccttctgcacctggctgctgcccagggctatgcccgcctcatcgagaccctgagccagtggcggagtgtggagactggaagcttggacttagagcaggaggttgacccgctcaacgtggatcatttctcttgcacccctctgatgtgggcttgtgccctgggacacctggaagctgctgtgctccttttccgttggaaccgacaggcactgagcattcccgactctctgggccgtctgccattgtctgtggctcattcccggggtcatgtgcgccttgcccgctgccttgaggaactacagagacaggagccttcggtggagcccccatttgccctatcgccaccctcctccagcccagacactggtctgagcagcgtctcctcgccctcggagctgtcggatggcaccttttccgtcacgtcagcctattctagtgccccagatggcagtcccccccctgcacctctgccagcctctgagatgactatggaggacatggccccaggccagctttcctctggtgtcccagaagcccccctactcctcatggactatgaggctaccaactccaaggggcccctctcctcccttcctgccctcccaccagcttcagatgatggggctgctccagaggacgctgacagcccacaggctgtggatgtgatcccggtggacatgatctcactagccaagcagatcatcgaagccacaccggagcggattaaacgagaggacttcgtggggctgcccgaggctggagcctcaatgcgggagcggacaggggctgtggggctcagtgagaccatgtcctggctggccagctacctggagaatgtggaccatttccccagctcaacccctcccagcgaactgccctttgagcgaggtcgcctggctgtcccttcagcaccctcctgggcagagtttctctctgcatccaccagtggcaagatggaaagtgattttgccctgctgacactatcagatcacgagcagcgggaactgtatgaggctgcccgagtcatccagacggccttccgaaagtacaagggccggcggctgaaggagcagcaggaggtagcagcagctgtaatccagcgctgttaccggaagtacaagcagctgacctggattgcacttaagtttgcactctataagaagatgacccaggcggccatcctgatccagagcaagttccgaagctactatgaacagaagcgatttcagcagagccgccgagcggctgtgctcatccagcagcactaccgctcctaccgccgcaggcccggccctccccaccggacttcggccaccctgcctgcccgcaacaaaggctcctttctcaccaagaagcaggaccaggcagcccggaagatcatgagattcctgcggcgctgccgacacaggatgagggaactgaagcagaaccaggagctggaagggcttccccagccgggactggccacatgacctggccaccgcctttctcaccaccctgggggcgcctcgtgcagtcttaacagggagagggctttctggggcagggggagcccctgtcggcagctttcctgttcacctttgttggagccctctgtaggcctcctccctcctccccacgccttgctcccacacccctctcctcgtccctcctggtcgtgccccgtctcttttggtcctggctccagaaaacccgcgccccacatacctgcatcttccgctgtgacctccggagccctgcctgcccctgctccccagctcctcctgcctgcacccgactcggccccctcctgacttgccttatttatttgttcgacgcgtctctgaatgtatccgcctcggttcccaccactgccttcgctgcgcacgcccctcgtgtttcagggctgaccgtgtccccacccgactccgcatgtttgcgtctgtttcctccctctctggccctgtcttaccccatcacccgactctggccactgacctcagggccgaaggggaggtggtgtacataggaacgcgttgcggagtccgccccgtcccccgaggggaggggtcttgtacatactgtaacatacagagtatagtgaagaatctatttaaggcgccgcggggagggctgcacggccgggcttgtggttctctagcgcggcgggggcctcctgccggctccacgggcactttctacttgtgcatgggcttggtttatacgaattgccattaaacatcgctgcacc

SEQ ID NO: 4309 - DNA, 4489 bp, Homo sapiens
gtcagccggcgctggggggggtcggtgtggggtagaatggccgctgccgccgtcacccgcgggaccccgggagcacagactccccctccccccggcccctcaggccgggggtgaccttgccccctggagccctcaccatgaataccaaggacaccaccgaggttgctgaaaacagccaccacctgaagatctttctccccaagaagctgctggagtgtcttcctcgctgcccgctgctgcctccagagaggctacggtggaatacaaatgaggagattgcatcctacctgatcacctttgagaagcatgatgagtggctgtcttgtgccccaaagacaaggcctcagaatggctccatcatcctctacaatcgcaagaaggtgaaatatcggaaggatggttacctctggaagaagcggaaggatgggaagaccacccgagaggaccacatgaagctgaaggtccagggcatggagtgtctctatggctgctacgttcactcttccatcgtccccacattccatcggcgctgctactggctgctccagaaccctgacatcgtccttgtgcactacctgaacgtcccagccctggaggactgtggaaagggctgcagccccatcttttgttccatcagcagcgaccgtcgagagtggctgaagtggtcccgggaggagttgttgggacagctgaagcccatgtttcatggcatcaagtggagctgcgggaatggaacagaagagttctctgtagaacacctggtgcagcagattttggacacccacccaaccaagcctgctccccgaacccacgcctgtctctgcagtggggggcttggttctgggagccttacccacaaatgcagcagcacgaaacaccgcatcatctctcccaaagtggagccccgagctttaaccctgacctctatcccccacgctcaccccccagagcctcctccactgatagccccacttcccccagagctccccaaggcacacacctccccatcttcttcctcttcttcctcctcatcaggttttgcagagcccctagaaatcagacctagccctcccacttctcgagggggttcttcaagaggaggcactgctatcctcctcctgacaggactggagcagcgggctggaggcttgacgcccaccaggcacttggctccacaggctgatcctaggccttccatgagtttggcagtggttgtaggcactgagccttctgccccaccagctcctcccagtcctgcctttgaccctgatcgttttctcaacagcccccagaggggccagacatatggaggggggcagggagtaagcccagacttccccgaggcagaggccgctcataccccctgttctgccctagagcctgctgctgccctggagccccaggcagctgctcggggtcccccaccacagtcagtagcaggtgggagaagaggaaactgcttcttcatccaagatgatgacagtggggaggagctcaagggtcacggggctgccccacccataccttcaccccctccctcacccccaccctcacctgcccccttggagccgtcaagcagggtaggaagaggagaggccttgtttggaggacctgttggggccagtgaactggagcccttcagtctttcatcattcccagaccttatgggagaactcatcagtgacgaagctccaagcatccctgctccgaccccccagctgtctcctgctcttagcaccatcacagacttctccccagagtggtcctacccagagggtggggtcaaggtgctcatcacaggtccttggaccgaagccgccgagcattactcctgtgtctttgatcacatcgcagtgccagcctcacttgtccagcctggtgtcttacgctgctactgtcccgcccatgaggtagggctggtgtctttgcaggtggcagggcgggaggggcccctttctgcttctgtgctctttgagtatcgagcccgccgattcctgtctctgcctagtactcaacttgactggctgtcactggacgacaaccagttccggatgtccatactagagcgactggagcagatggagaagcggatggcagagatcgcagcagctgggcaggtgccttgccagggtcctgatgctcctccagttcaggatgaaggccaggggcctgggttcgaagcacgggtagtggtcttggtagaaagcatgatcccacgctccacctggaagggtcctgaacgtctggcccatggaagccccttccggggcatgagccttctgcacctggctgctgcccagggctatgcccgcctcatcgagaccctgagccagtggcggagtgtggagactggaagcttggacttagagcaggaggttgacccgctcaacgtggatcatttctcttgcacccctctgatgtgggcttgtgccctgggacacctggaagctgctgtgctccttttccgttggaaccgacaggcactgagcattcccgactctctgggccgtctgccattgtctgtggctcattcccggggtcatgtgcgccttgcccgctgccttgaggaactacagagacaggagccttcggtggagcccccatttgccctatcgccaccctcctccagcccagacactggtctgagcagcgtctcctcgccctcggagctgtcggatggcaccttttccgtcacgtcagcctattctagtgccccagatggcagtcccccccctgcacctctgccagcctctgagatgactatggaggacatggccccaggccagctttcctctggtgtcccagaagcccccctactcctcatggactatgaggctaccaactccaaggggcccctctcctcccttcctgccctcccaccagcttcagatgatggggctgctccagaggacgctgacagcccacaggctgtggatgtgatcccggtggacatgatctcactagccaagcagatcatcgaagccacaccggagcggattaaacgagaggacttcgtggggctgcccgaggctggagcctcaatgcgggagcggacaggggctgtggggctcagtgagaccatgtcctggctggccagctacctggagaatgtggaccatttccccagctcaacccctcccagcgaactgccctttgagcgaggtcgcctggctgtcccttcagcaccctcctgggcagagtttctctctgcatccaccagtggcaagatggaaagtgattttgccctgctgacactatcagatcacgagcagcgggaactgtatgaggctgcccgagtcatccagacggccttccgaaagtacaagggccggcggctgaaggagcagcaggaggtagcagcagctgtaatccagcgctgttaccggaagtacaagcagtttgcactctataagaagatgacccaggcggccatcctgatccagagcaagttccgaagctactatgaacagaagcgatttcagcagagccgccgagcggctgtgctcatccagcagcactaccgctcctaccgccgcaggcccggccctccccaccggacttcggccaccctgcctgcccgcaacaaaggctcctttctcaccaagaagcaggaccaggcagcccggaagatcatgagattcctgcggcgctgccgacacaggatgagggaactgaagcagaaccaggagctggaagggcttccccagccgggactggccacatgacctggccaccgcctttctcaccaccctgggggcgcctcgtgcagtcttaacagggagagggctttctggggcagggggagcccctgtcggcagctttcctgttcacctttgttggagccctctgtaggcctcctccctcctccccacgccttgctcccacacccctctcctcgtccctcctggtcgtgccccgtctcttttggtcctggctccagaaaacccgcgccccacatacctgcatcttccgctgtgacctccggagccctgcctgcccctgctccccagctcctcctgcctgcacccgactcggccccctcctgacttgccttatttatttgttcgacgcgtctctgaatgtatccgcctcggttcccaccactgccttcgctgcgcacgcccctcgtgtttcagggctgaccgtgtccccacccgactccgcatgtttgcgtctgtttcctccctctctggccctgtcttaccccatcacccgactctggccactgacctcagggccgaaggggaggtggtgtacataggaacgcgttgcggagtccgccccgtcccccgaggggaggggtcttgtacatactgtaacatacagagtatagtgaagaatctatttaaggcgccgcggggagggctgcacggccgggcttgtggttctctagcgcggcgggggcctcctgccggctccacgggcactttctacttgtgcatgggcttggtttatacgaattgccattaaacatcgctgcaccagccag

SEQ ID NO: 4310 - DNA, 4782 bp, Homo sapiens
ccggcacctgcactgtccctcgcccaccgcgtgcccgcggactctgctcccggcttctccagaacatccctctatgcgggcgggaccctcccacctcggaggttctcctgggaccaccactccgccggggggccgcccagagtgccaagcgtccgatccggcgccgcccaagtgcagcccaaggacccgctcccgctccgcaccctggcaggctgcctagccaggactgcgcacctgcgccctggggcggagtccttaccccaaccccagcttcactgcacatagccgagcccgacgggcctcctcccatctccatcctggacacctggcggagcccgtgctgagagcctccgccagctcccatctgttccccgaggagggcggggggctcaggctggagccagagcggtagatgggcacagactccccctccccccggcccctcaggccgggggtgaccttgccccctggagccctcaccatgaataccaaggacaccaccgaggttgctgaaaacagccaccacctgaagatctttctccccaagaagctgctggagtgtcttcctcgctgcccgctgctgcctccagagaggctacggtggaatacaaatgaggagattgcatcctacctgatcacctttgagaagcatgatgagtggctgtcttgtgccccaaagacaaggcctcagaatggctccatcatcctctacaatcgcaagaaggtgaaatatcggaaggatggttacctctggaagaagcggaaggatgggaagaccacccgagaggaccacatgaagctgaaggtccagggcatggagaaccctgacatcgtccttgtgcactacctgaacgtcccagccctggaggactgtggaaagggctgcagccccatcttttgttccatcagcagcgaccgtcgagagtggctgaagtggtcccgggaggagttgttgggacagctgaagcccatgtttcatggcatcaagtggagctgcgggaatggaacagaagagttctctgtagaacacctggtgcagcagattttggacacccacccaaccaagcctgctccccgaacccacgcctgtctctgcagtggggggcttggttctgggagccttacccacaaatgcagcagcacgaaacaccgcatcatctctcccaaagtggagccccgagctttaaccctgacctctatcccccacgctcaccccccagagcctcctccactgatagccccacttcccccagagctccccaaggcacacacctccccatcttcttcctcttcttcctcctcatcaggttttgcagagcccctagaaatcagacctagccctcccacttctcgagggggttcttcaagaggaggcactgctatcctcctcctgacaggactggagcagcgggctggaggcttgacgcccaccaggcacttggctccacaggctgatcctaggccttccatgagtttggcagtggttgtaggcactgagccttctgccccaccagctcctcccagtcctgcctttgaccctgatcgttttctcaacagcccccagaggggccagacatatggaggggggcagggagtaagcccagacttccccgaggcagaggccgctcataccccctgttctgccctagagcctgctgctgccctggagccccaggcagctgctcggggtcccccaccacagtcagtagcaggtgggagaagaggaaactgcttcttcatccaagatgatgacagtggggaggagctcaagggtcacggggctgccccacccataccttcaccccctccctcacccccaccctcacctgcccccttggagccgtcaagcagggtaggaagaggagaggccttgtttggaggacctgttggggccagtgaactggagcccttcagtctttcatcattcccagaccttatgggagaactcatcagtgacgaagctccaagcatccctgctccgaccccccagctgtctcctgctcttagcaccatcacagacttctccccagagtggtcctacccagagggtggggtcaaggtgctcatcacaggtccttggaccgaagccgccgagcattactcctgtgtctttgatcacatcgcagtgccagcctcacttgtccagcctggtgtcttacgctgctactgtcccgcccatgaggtagggctggtgtctttgcaggtggcagggcgggaggggcccctttctgcttctgtgctctttgagtatcgagcccgccgattcctgtctctgcctagtactcaacttgactggctgtcactggacgacaaccagttccggatgtccatactagagcgactggagcagatggagaagcggatggcagagatcgcagcagctgggcaggtgccttgccagggtcctgatgctcctccagttcaggatgaaggccaggggcctgggttcgaagcacgggtagtggtcttggtagaaagcatgatcccacgctccacctggaagggtcctgaacgtctggcccatggaagccccttccggggcatgagccttctgcacctggctgctgcccagggctatgcccgcctcatcgagaccctgagccagtggcggagtgtggagactggaagcttggacttagagcaggaggttgacccgctcaacgtggatcatttctcttgcacccctctgatgtgggcttgtgccctgggacacctggaagctgctgtgctccttttccgttggaaccgacaggcactgagcattcccgactctctgggccgtctgccattgtctgtggctcattcccggggtcatgtgcgccttgcccgctgccttgaggaactacagagacaggagccttcggtggagcccccatttgccctatcgccaccctcctccagcccagacactggtctgagcagcgtctcctcgccctcggagctgtcggatggcaccttttccgtcacgtcagcctattctagtgccccagatggcagtcccccccctgcacctctgccagcctctgagatgactatggaggacatggccccaggccagctttcctctggtgtcccagaagcccccctactcctcatggactatgaggctaccaactccaaggggcccctctcctcccttcctgccctcccaccagcttcagatgatggggctgctccagaggacgctgacagcccacaggctgtggatgtgatcccggtggacatgatctcactagccaagcagatcatcgaagccacaccggagcggattaaacgagaggacttcgtggggctgcccgaggctggagcctcaatgcgggagcggacaggggctgtggggctcagtgagaccatgtcctggctggccagctacctggagaatgtggaccatttccccagctcaacccctcccagcgaactgccctttgagcgaggtcgcctggctgtcccttcagcaccctcctgggcagagtttctctctgcatccaccagtggcaagatggaaagtgattttgccctgctgacactatcagatcacgagcagcgggaactgtatgaggctgcccgagtcatccagacggccttccgaaagtacaagggccggcggctgaaggagcagcaggaggtagcagcagctgtaatccagcgctgttaccggaagtacaagcagctgacctggattgcacttaagtttgcactctataagaagatgacccaggcggccatcctgatccagagcaagttccgaagctactatgaacagaagcgatttcagcagagccgccgagcggctgtgctcatccagcagcactaccgctcctaccgccgcaggcccggccctccccaccggacttcggccaccctgcctgcccgcaacaaaggctcctttctcaccaagaagcaggaccaggcagcccggaagatcatgagattcctgcggcgctgccgacacaggatgagggaactgaagcagaaccaggagctggaagggcttccccagccgggactggccacatgacctggccaccgcctttctcaccaccctgggggcgcctcgtgcagtcttaacagggagagggctttctggggcagggggagcccctgtcggcagctttcctgttcacctttgttggagccctctgtaggcctcctccctcctccccacgccttgctcccacacccctctcctcgtccctcctggtcgtgccccgtctcttttggtcctggctccagaaaacccgcgccccacatacctgcatcttccgctgtgacctccggagccctgcctgcccctgctccccagctcctcctgcctgcacccgactcggccccctcctgacttgccttatttatttgttcgacgcgtctctgaatgtatccgcctcggttcccaccactgccttcgctgcgcacgcccctcgtgtttcagggctgaccgtgtccccacccgactccgcatgtttgcgtctgtttcctccctctctggccctgtcttaccccatcacccgactctggccactgacctcagggccgaaggggaggtggtgtacataggaacgcgttgcggagtccgccccgtcccccgaggggaggggtcttgtacatactgtaacatacagagtatagtgaagaatctatttaaggcgccgcggggagggctgcacggccgggcttgtggttctctagcgcggcgggggcctcctgccggctccacgggcactttctacttgtgcatgggcttggtttatacgaattgccattaaacatcgctgcaccagccag

SEQ ID NO: 4311 - DNA, 4394 bp, Homo sapiens
gtcagccggcgctggggggggtcggtgtggggtagaatggccgctgccgccgtcacccgcgggaccccgggagaaaacagccaccacctgaagatctttctccccaagaagctgctggagtgtcttcctcgctgcccgctgctgcctccagagaggctacggtggaatacaaatgaggagattgcatcctacctgatcacctttgagaagcatgatgagtggctgtcttgtgccccaaagacaaggcctcagaatggctccatcatcctctacaatcgcaagaaggtgaaatatcggaaggatggttacctctggaagaagcggaaggatgggaagaccacccgagaggaccacatgaagctgaaggtccagggcatggagtgtctctatggctgctacgttcactcttccatcgtccccacattccatcggcgctgctactggctgctccagaaccctgacatcgtccttgtgcactacctgaacgtcccagccctggaggactgtggaaagggctgcagccccatcttttgttccatcagcagcgaccgtcgagagtggctgaagtggtcccgggaggagttgttgggacagctgaagcccatgtttcatggcatcaagtggagctgcgggaatggaacagaagagttctctgtagaacacctggtgcagcagattttggacacccacccaaccaagcctgctccccgaacccacgcctgtctctgcagtggggggcttggttctgggagccttacccacaaatgcagcagcacgaaacaccgcatcatctctcccaaagtggagccccgagctttaaccctgacctctatcccccacgctcaccccccagagcctcctccactgatagccccacttcccccagagctccccaaggcacacacctccccatcttcttcctcttcttcctcctcatcaggttttgcagagcccctagaaatcagacctagccctcccacttctcgagggggttcttcaagaggaggcactgctatcctcctcctgacaggactggagcagcgggctggaggcttgacgcccaccaggcacttggctccacaggctgatcctaggccttccatgagtttggcagtggttgtaggcactgagccttctgccccaccagctcctcccagtcctgcctttgaccctgatcgttttctcaacagcccccagaggggccagacatatggaggggggcagggagtaagcccagacttccccgaggcagaggccgctcataccccctgttctgccctagagcctgctgctgccctggagccccaggcagctgctcggggtcccccaccacagtcagtagcaggtgggagaagaggaaactgcttcttcatccaagatgatgacagtggggaggagctcaagggtcacggggctgccccacccataccttcaccccctccctcacccccaccctcacctgcccccttggagccgtcaagcagggtaggaagaggagaggccttgtttggaggacctgttggggccagtgaactggagcccttcagtctttcatcattcccagaccttatgggagaactcatcagtgacgaagctccaagcatccctgctccgaccccccagctgtctcctgctcttagcaccatcacagacttctccccagagtggtcctacccagagggtggggtcaaggtgctcatcacaggtccttggaccgaagccgccgagcattactcctgtgtctttgatcacatcgcagtgccagcctcacttgtccagcctggtgtcttacgctgctactgtcccgcccatgaggtagggctggtgtctttgcaggtggcagggcgggaggggcccctttctgcttctgtgctctttgagtatcgagcccgccgattcctgtctctgcctagtactcaacttgactggctgtcactggacgacaaccagttccggatgtccatactagagcgactggagcagatggagaagcggatggcagagatcgcagcagctgggcaggtgccttgccagggtcctgatgctcctccagttcaggatgaaggccaggggcctgggttcgaagcacgggtagtggtcttggtagaaagcatgatcccacgctccacctggaagggtcctgaacgtctggcccatggaagccccttccggggcatgagccttctgcacctggctgctgcccagggctatgcccgcctcatcgagaccctgagccagtggcggagtgtggagactggaagcttggacttagagcaggaggttgacccgctcaacgtggatcatttctcttgcacccctctgatgtgggcttgtgccctgggacacctggaagctgctgtgctccttttccgttggaaccgacaggcactgagcattcccgactctctgggccgtctgccattgtctgtggctcattcccggggtcatgtgcgccttgcccgctgccttgaggaactacagagacaggagccttcggtggagcccccatttgccctatcgccaccctcctccagcccagacactggtctgagcagcgtctcctcgccctcggagctgtcggatggcaccttttccgtcacgtcagcctattctagtgccccagatggcagtcccccccctgcacctctgccagcctctgagatgactatggaggacatggccccaggccagctttcctctggtgtcccagaagcccccctactcctcatggactatgaggctaccaactccaaggggcccctctcctcccttcctgccctcccaccagcttcagatgatggggctgctccagaggacgctgacagcccacaggctgtggatgtgatcccggtggacatgatctcactagccaagcagatcatcgaagccacaccggagcggattaaacgagaggacttcgtggggctgcccgaggctggagcctcaatgcgggagcggacaggggctgtggggctcagtgagaccatgtcctggctggccagctacctggagaatgtggaccatttccccagctcaacccctcccagcgaactgccctttgagcgaggtcgcctggctgtcccttcagcaccctcctgggcagagtttctctctgcatccaccagtggcaagatggaaagtgattttgccctgctgacactatcagatcacgagcagcgggaactgtatgaggctgcccgagtcatccagacggccttccgaaagtacaagggccggcggctgaaggagcagcaggaggtagcagcagctgtaatccagcgctgttaccggaagtacaagcagtttgcactctataagaagatgacccaggcggccatcctgatccagagcaagttccgaagctactatgaacagaagcgatttcagcagagccgccgagcggctgtgctcatccagcagcactaccgctcctaccgccgcaggcccggccctccccaccggacttcggccaccctgcctgcccgcaacaaaggctcctttctcaccaagaagcaggaccaggcagcccggaagatcatgagattcctgcggcgctgccgacacaggatgagggaactgaagcagaaccaggagctggaagggcttccccagccgggactggccacatgacctggccaccgcctttctcaccaccctgggggcgcctcgtgcagtcttaacagggagagggctttctggggcagggggagcccctgtcggcagctttcctgttcacctttgttggagccctctgtaggcctcctccctcctccccacgccttgctcccacacccctctcctcgtccctcctggtcgtgccccgtctcttttggtcctggctccagaaaacccgcgccccacatacctgcatcttccgctgtgacctccggagccctgcctgcccctgctccccagctcctcctgcctgcacccgactcggccccctcctgacttgccttatttatttgttcgacgcgtctctgaatgtatccgcctcggttcccaccactgccttcgctgcgcacgcccctcgtgtttcagggctgaccgtgtccccacccgactccgcatgtttgcgtctgtttcctccctctctggccctgtcttaccccatcacccgactctggccactgacctcagggccgaaggggaggtggtgtacataggaacgcgttgcggagtccgccccgtcccccgaggggaggggtcttgtacatactgtaacatacagagtatagtgaagaatctatttaaggcgccgcggggagggctgcacggccgggcttgtggttctctagcgcggcgggggcctcctgccggctccacgggcactttctacttgtgcatgggcttggtttatacgaattgccattaaacatcgctgcaccagccag

SEQ ID NO: 4312 - DNA, 4852 bp, Homo sapiens
ccggcacctgcactgtccctcgcccaccgcgtgcccgcggactctgctcccggcttctccagaacatccctctatgcgggcgggaccctcccacctcggaggttctcctgggaccaccactccgccggggggccgcccagagtgccaagcgtccgatccggcgccgcccaagtgcagcccaaggacccgctcccgctccgcaccctggcaggctgcctagccaggactgcgcacctgcgccctggggcggagtccttaccccaaccccagcttcactgcacatagccgagcccgacgggcctcctcccatctccatcctggacacctggcggagcccgtgctgagagcctccgccagctcccatctgttccccgaggagggcggggggctcaggctggagccagagcggtagatgggcacagactccccctccccccggcccctcaggccgggggtgaccttgccccctggagccctcaccatgaataccaaggacaccaccgaggttgctgaaaacagccaccacctgaagatctttctccccaagaagctgctggagtgtcttcctcgctgcccgctgctgcctccagagaggctacggtggaatacaaatgaggagattgcatcctacctgatcacctttgagaagcatgatgagtggctgtcttgtgccccaaagacaaggcctcagaatggctccatcatcctctacaatcgcaagaaggtgaaatatcggaaggatggttacctctggaagaagcggaaggatgggaagaccacccgagaggaccacatgaagctgaaggtccagggcatggagtgtctctatggctgctacgttcactcttccatcgtccccacattccatcggcgctgctactggctgctccagaaccctgacatcgtccttgtgcactacctgaacgtcccagccctggaggactgtggaaagggctgcagccccatcttttgttccatcagcagcgaccgtcgagagtggctgaagtggtcccgggaggagttgttgggacagctgaagcccatgtttcatggcatcaagtggagctgcgggaatggaacagaagagttctctgtagaacacctggtgcagcagattttggacacccacccaaccaagcctgctccccgaacccacgcctgtctctgcagtggggggcttggttctgggagccttacccacaaatgcagcagcacgaaacaccgcatcatctctcccaaagtggagccccgagctttaaccctgacctctatcccccacgctcaccccccagagcctcctccactgatagccccacttcccccagagctccccaaggcacacacctccccatcttcttcctcttcttcctcctcatcaggttttgcagagcccctagaaatcagacctagccctcccacttctcgagggggttcttcaagaggaggcactgctatcctcctcctgacaggactggagcagcgggctggaggcttgacgcccaccaggcacttggctccacaggctgatcctaggccttccatgagtttggcagtggttgtaggcactgagccttctgccccaccagctcctcccagtcctgcctttgaccctgatcgttttctcaacagcccccagaggggccagacatatggaggggggcagggagtaagcccagacttccccgaggcagaggccgctcataccccctgttctgccctagagcctgctgctgccctggagccccaggcagctgctcggggtcccccaccacagtcagtagcaggtgggagaagaggaaactgcttcttcatccaagatgatgacagtggggaggagctcaagggtcacggggctgccccacccataccttcaccccctccctcacccccaccctcacctgcccccttggagccgtcaagcagggtaggaagaggagaggccttgtttggaggacctgttggggccagtgaactggagcccttcagtctttcatcattcccagaccttatgggagaactcatcagtgacgaagctccaagcatccctgctccgaccccccagctgtctcctgctcttagcaccatcacagacttctccccagagtggtcctacccagagggtggggtcaaggtgctcatcacaggtccttggaccgaagccgccgagcattactcctgtgtctttgatcacatcgcagtgccagcctcacttgtccagcctggtgtcttacgctgctactgtcccgcccatgaggtagggctggtgtctttgcaggtggcagggcgggaggggcccctttctgcttctgtgctctttgagtatcgagcccgccgattcctgtctctgcctagtactcaacttgactggctgtcactggacgacaaccagttccggatgtccatactagagcgactggagcagatggagaagcggatggcagagatcgcagcagctgggcaggtgccttgccagggtcctgatgctcctccagttcaggatgaaggccaggggcctgggttcgaagcacgggtagtggtcttggtagaaagcatgatcccacgctccacctggaagggtcctgaacgtctggcccatggaagccccttccggggcatgagccttctgcacctggctgctgcccagggctatgcccgcctcatcgagaccctgagccagtggcggagtgtggagactggaagcttggacttagagcaggaggttgacccgctcaacgtggatcatttctcttgcacccctctgatgtgggcttgtgccctgggacacctggaagctgctgtgctccttttccgttggaaccgacaggcactgagcattcccgactctctgggccgtctgccattgtctgtggctcattcccggggtcatgtgcgccttgcccgctgccttgaggaactacagagacaggagccttcggtggagcccccatttgccctatcgccaccctcctccagcccagacactggtctgagcagcgtctcctcgccctcggagctgtcggatggcaccttttccgtcacgtcagcctattctagtgccccagatggcagtcccccccctgcacctctgccagcctctgagatgactatggaggacatggccccaggccagctttcctctggtgtcccagaagcccccctactcctcatggactatgaggctaccaactccaaggggcccctctcctcccttcctgccctcccaccagcttcagatgatggggctgctccagaggacgctgacagcccacaggctgtggatgtgatcccggtggacatgatctcactagccaagcagatcatcgaagccacaccggagcggattaaacgagaggacttcgtggggctgcccgaggctggagcctcaatgcgggagcggacaggggctgtggggctcagtgagaccatgtcctggctggccagctacctggagaatgtggaccatttccccagctcaacccctcccagcgaactgccctttgagcgaggtcgcctggctgtcccttcagcaccctcctgggcagagtttctctctgcatccaccagtggcaagatggaaagtgattttgccctgctgacactatcagatcacgagcagcgggaactgtatgaggctgcccgagtcatccagacggccttccgaaagtacaagggccggcggctgaaggagcagcaggaggtagcagcagctgtaatccagcgctgttaccggaagtacaagcagctgacctggattgcacttaagtttgcactctataagaagatgacccaggcggccatcctgatccagagcaagttccgaagctactatgaacagaagcgatttcagcagagccgccgagcggctgtgctcatccagcagcactaccgctcctaccgccgcaggcccggccctccccaccggacttcggccaccctgcctgcccgcaacaagctcctttctcaccaagaagcaggaccaggcagcccggaagatcatgagattcctgcggcgctgccgacacaggatgagggaactgaagcagaaccaggagctggaagggcttccccagccgggactggccacatgacctggccaccgcctttctcaccaccctgggggcgcctcgtgcagtcttaacagggagagggctttctggggcagggggagcccctgtcggcagctttcctgttcacctttgttggagccctctgtaggcctcctccctcctccccacgccttgctcccacacccctctcctcgtccctcctggtcgtgccccgtctcttttggtcctggctccagaaaacccgcgccccacatacctgcatcttccgctgtgacctccggagccctgcctgcccctgctccccagctcctcctgcctgcacccgactcggccccctcctgacttgccttatttatttgttcgacgcgtctctgaatgtatccgcctcggttcccaccactgccttcgctgcgcacgcccctcgtgtttcagggctgaccgtgtccccacccgactccgcatgtttgcgtctgtttcctccctctctggccctgtcttaccccatcacccgactctggccactgacctcagggccgaaggggaggtggtgtacataggaacgcgttgcggagtccgccccgtcccccgaggggaggggtcttgtacatactgtaacatacagagtatagtgaagaatctatttaaggcgccgcggggagggctgcacggccgggcttgtggttctctagcgcggcgggggcctcctgccggctccacgggcactttctacttgtgcatgggcttggtttatacgaattgccattaaacatcgctgcaccagccag

SEQ ID NO: 4313 - DNA, 7161 bp, Homo sapiens
cgccatgtgaaggttagggccgggacatcccgaggagccgcggtgaaagatgggggatgctgcagaccccagggagatgagaaagacgttcattgttccagccatcaagccttttgaccactatgatttctccagggccaaaatcgcctgcaatctggcctggctggtggccaaagcctttgggacagaaaatgtgccagaggaacttcaagaaccattttacacagatcagtatgaccaggaacacatcaaaccacctgttgttaatttgcttctatcggctgaactatactgtcgtgctgggagtctcattctcaagagtgatgctgcaaaaccccttttgggccatgatgctgtaatccaggctttagcacagaaaggtctttatgtcactgaccaggaaaaattggtaactgaacgagatctccacaagaaacccatacagatgagtgcacatttggccatgatcgataccctcatgatggcttatactgtagaaatggtcagtatagaaaaagtaattgcgtgtgctcagcagtattcagctttttttcaagccacagatctgccctatgatattgaggacgctgtcatgtactggataaataaggtaaatgaacatttgaaagacataatggaacaagaacaaaaactgaaagaacatcacacagttgaagctccaggaggtcaaaagtctccttccaaatggttttggaaactggttccagctcgttatcggaaagagcaaacattgcttaagcaactgccttgcattccattggtagaaaatttgttgaaggatgggacagatggctgtgcattagctgcccttattcatttttactgtcctgatgttgtcagattagaggatatttgtttgaaagaaactatgtctttggctgatagcctgtataatctgcagctgattcaagaattttgccaagaatacttgaaccagtgttgccatttcactctggaagatatgctctatgctgcttcatccataaagagtaattatttggtgttcatggcggaactgttctggtggtttgaagtggtgaagccgtcttttgtacagcctcgtgttgttcgtccacaaggagctgaacctgtaaaagatatgccttcaattcctgtcttgaatgctgccaaaagaaatgtcttagatagtagttctgacttcccttcaagtggggaaggagctacatttacacagtctcatcatcatttgccttctaggtattcacgtccccaggctcattcttcagcctcaggaggaattagaaggtcttcatctatgtcttatgttgatggcttcatagggacatggcccaaagagaaaagatcatcagtgcatggcgtatcatttgatatttcttttgataaagaagatagtgtacagagatccactccaaaccgaggaatcactcgttctattagtaatgaaggacttactctgaacaacagtcatgtatctaaacacattaggaaaaatttgtccttcaagccaataaatggagaagaggaagcagagagcattgaagaagaacttaatatagattctcacagtgacctcaaatcttgtgtgccccttaacacaaatgaactaaattctaatgagaatattcattacaagcttccaaatggagctttacaaaatagaatacttcttgacgagtttggcaatcagatcgagacaccaagcattgaagaagcattacaaataattcatgatactgaaaaatctcctcatacacctcagccagaccaaattgctaatggcttctttcttcatagtcaagaaatgagtatcttaaattcaaatatcaagttaaatcaatctagtcctgataatgtaactgatacgaaaggtgccttgagtcccataactgacaatactgaagtagacactggaattcacgttccttcagaagatattcctgaaactatggacgaagattcttcgttgagagattatactgtaagcttggactctgacatggatgatgcatctaaatttcttcaggattatgatattcgaactggcaacaccagggaagctttgagtccttgtccaagtactgtaagtaccaagtctcagccaggcagcagtgcttcttctagttctggagttaaaatgaccagctttgctgaacaaaaattcaggaaactgaatcataccgatggaaaaagtagtggaagcagttctcaaaaaactacaccagaaggctctgaacttaatattcctcatgtggttgcttgggcacaaattccagaagaaacagggcttccacagggacgggacactacccagctgttggcctctgaaatggtgcatcttaggatgaaactagaagaaaagaggcgtgctatagaagcccagaaaaagaaaatggaagctgcttttaccaaacagagacagaaaatgggaaggacagcattccttactgtagtgaaaaagaaaggggatgggatatctcctctacgagaggaagcggcgggtgcagaagatgagaaagtatatactgatcgagcaaaagaaaaggaatcacaaaaaactgatggacaaaggagcaagtcactggcagatataaaagagagcatggagaatcctcaagccaaatggctaaagtctccaactacacctattgatcctgagaagcagtggaacctggcaagcccctcagaagaaactttaaatgaaggagagattttagaatataccaaatccattgaaaagttaaattcatccctgcattttctacaacaagaaatgcaacgcttgtcacttcagcaggagatgttaatgcagatgagagagcaacaatcttgggtgatttcacctccacaaccctctccacagaaacagattcgagattttaagccttctaagcaggcaggcctgtcatcagccattgcaccattctcctcagactcccctcgtcctactcacccatctccacagtcttctaacaggaaaagtgcatctttttctgttaaaagtcaaaggactcctaggccaaatgagttaaaaataacacctttgaatcgaaccttgacacctcctcggtctgtggatagccttcctcggttaaggaggttttcaccaagtcaagttcctattcaaactaggtcatttgtatgttttggggatgatggagaacctcagttaaaggaatccaaacctaaagaggaagttaaaaaggaggaattggaatccaaagggactttggaacagcgtggacataatccagaagaaaaggaaatcaaaccttttgagtcaacagtctctgaagtcctatcactgcctgtcacagagactgtatgtctgacaccaaatgaggaccaattgaatcaacccacagaaccccctcctaaacccgttttcccacccactgctccaaaaaatgttaatctgattgaagtttccctctcagatttgaaaccccctgaaaaggctgatgtacctgttgaaaaatatgatggagaaagtgataaagaacaatttgatgatgaccagaaagtatgctgtggattcttttttaaggatgatcaaaaagcagaaaatgatatggcaatgaaacgggcagctttgttggagaaaagattaagaagggaaaaggaaactcagctccggaaacaacagttggaagcagaaatggagcataagaaggaggaaacaaggcgtaaaactgaggaagaacgtcagaagaaagaagatgagagagcacgcagagaatttattaggcaagaatatatgaggcggaaacaactgaaactaatggaagatatggatacagtaattaaaccccgtcctcaagtagtaaaacaaaaaaaacagcgaccaaaatctattcacagagatcatattgaatcccccaaaacaccaataaagggtcctccagtctctagcctttctttggcatcgctgaacacgggtgataacgagagtgtacattcaggcaagaggacgccaagatcagagtctgtagaaggcttcttatctccaagtcgttgtggcagtcgaaatggagaaaaagactgggagaatgcatcaacaacttcttcagtggcttctggaacagaatatacaggaccaaagctctacaaagaacccagtgcaaaatccaataagcacataatacaaaatgctttagctcattgctgtttggctggaaaagtaaatgaaggtcagaagaaaaaaatactggaggaaatggagaaatcagatgccaacaacttcttaatcttgttccgggattcaggatgccagttcagatctttatacacttattgcccagaaactgaagaaatcaataaactgactgggataggccctaaatctatcactaaaaaaatgattgaaggactttacaaatataattctgacaggaaacagtttagccacatacccgctaaaactttatctgccagtgttgatgcaattaccattcatagccatttatggcagaccaaaagaccagtaacacccaaaaaacttttacccactaaggcatagaagttgggaaatacttgcttcagaacattcatggtaaatttgcacttcatctttcctgcctatagaaaatctttctaattgccaacaagacttttattaattaaaactggacattaagctctgttgtcatgaacaactggaatgtaaaccacagtattttggagtgcagaacattctcaattaagtgataagtccaaatgatgaaggaaatgttttaattcacaaatggagatttgtatgtgttatcaggttcacctgcttgatattagatacattaaagcactgaattttcatggatattagttggatttatcattgaaatatggttaagattacaaattatgtgttttatttgttgcttttttttaaccttttaatgtatattcttgtcttcagatggtttgctatttttctctcctgggggtttattctaagatacctttgtattttatttcatgtggagatcatgaaagtaggaaatatacctttagaagtaactcgcacctttcttatgatgttaagagaaacactagtgtttagttttacagtaaccctcatattttaatggtgttacagcatttgcaaaaattattctgctaagtatttacaactctatttattattcactcaagtattaacattctctattaaataagaggaggtgttgtaaagagctgctagtaggttcgctttaaaccacatgagcttaaccaagaatatgttatgagaagttgctgattaaatcagtgctgtttttacaccacttctggccaactcagaataatttagattgttcttttaacaaaaaaggctttctatctcttttaaagtaagtcactttataagttggcagaagtgaatgacactttgagagtagtctttcaatctgaagatgtaagacttcctgaaacaagttctcaagaagtctttacattatatttataactcatataaaaattatatttagaatttttaaacatgtacaaagggctacattttaattttaaaatagcttcacattattttacttatattgggtttttcttcattttaatccttttcaagtggaatggcttagaataagtatacacttgaaatctcctctacatgatctttgttctttaacagtgtataccagagggttagttggggaaaaacttcattctcaggaaaagacttgaatgattatgtgaccctgttatatttcagtgttgtgacaaatgtgtaaactagcgggggaagacagtattgtatcataaatgagatgcgtagtttgttttctttcatgggaagtagagataaaaatatatacatttctctaattgagttgtttagagaaagaactaatgtctcatatgatgtatttacttattttaaaaaaaagaataggaatgagatgtccctgagctgtacttttctattattataaggcctttaggcatcagtgcatctgggttatcaacattttctcaaatgctgtcaatattttactgtaatttatgttcttatatttatgtatatttgttaaaactgtaaaaaaatttcacagatttttttccaatacctgtgcaagatacatgtgtagctcaaaactatttgtgatctactgtttgcatgtaagagaccaggatatgtaactcttatattttaagtgtatacatattgtgtatataacatatggatattaaaaatggggaattgcacattttaccttttggacagtaatttctatcacagttagaaggaaatgatagtcaaatacacgtttagattaaaactagtttaaaaaattataaatgaatctaatcaaaatgtgaatagtagtcaaaaggataatttaataagcattttacgttactaaatttgttcatttcaatattaactaaatttccctcatcaaagcaatctttgtgatattacttcgctattaaataaagaaaattggatgcaagacaatggagaaactttaaaactaaacaggaccaccctttattcttaaatttgtgtgtgtccaacagttgaattgaatgtctataaggtctaaaggtagaatgtgaatattgccacagagttcattgctctcagtataagattttactttattaatgcagaaggaatatggatatatttctttaagtctgcagatttttttattatggtgcagcttttttttaattatgtttttaaaattatacagttgaaaaatatgccatttcataaagtctgaggattttcgtcaaccttactgaaacacactggtgctttcatcatcagaggtcaaattattatgataactattccattaagtttgccaaacatttgtcgtggttaccagtgcagcctgtcaaattctgctatttgacacagctttggaaagatttagttcttggtttttccgttttgtattagaatgactgttacagttttatttggctgtttaaagccaaattcagctatttaattatggtttcatggacactgttgagcaatgtacagtgtatggtgtgcttacctgtccactctagagcattgcttacaggttttttgttttttaagatgctgtgctgtaaaatactgtcatacttgctatttcctggtacagtgtagtttttcccctttcatttgaataaaagcatggcacc

SEQ ID NO: 4314 - DNA, 7352 bp, Homo sapiens
acggggcggacctcgcgcggacggacggacggagacggcgccgccacattcctatgcccgggagcggcggcggcggcggcggcggctcccgcgggaggcggcaggcgcgcggcgcggacagctgagcttctcctccgtcggcgcccgggcggacatcgcccgggccccgatggtttgagcttgcttctccctccctcccgacccccgtggtggcgaggccacgccatgtgaaggttagggccgggacatcccgaggagccgcggtgaaagatgggggatgctgcagaccccagggagatgagaaagacgttcattgttccagccatcaagccttttgaccactatgatttctccagggccaaaatcgcctgcaatctggcctggctggtggccaaagcctttgggacagaaaatgtgccagaggaacttcaagaaccattttacacagatcagtatgaccaggaacacatcaaaccacctgttgttaatttgcttctatcggctgaactatactgtcgtgctgggagtctcattctcaagagtgatgctgcaaaaccccttttgggccatgatgctgtaatccaggctttagcacagaaaggtctttatgtcactgaccaggaaaaattggtaactgaacgagatctccacaagaaacccatacagatgagtgcacatttggccatgatcgataccctcatgatggcttatactgtagaaatggtcagtatagaaaaagtaattgcgtgtgctcagcagtattcagctttttttcaagccacagatctgccctatgatattgaggacgctgtcatgtactggataaataaggtaaatgaacatttgaaagacataatggaacaagaacaaaaactgaaagaacatcacacagttgaagctccaggaggtcaaaaggctcgttatcggaaagagcaaacattgcttaagcaactgccttgcattccattggtagaaaatttgttgaaggatgggacagatggctgtgcattagctgcccttattcatttttactgtcctgatgttgtcagattagaggatatttgtttgaaagaaactatgtctttggctgatagcctgtataatctgcagctgattcaagaattttgccaagaatacttgaaccagtgttgccatttcactctggaagatatgctctatgctgcttcatccataaagagtaattatttggtgttcatggcggaactgttctggtggtttgaagtggtgaagccgtcttttgtacagcctcgtgttgttcgtccacaaggagctgaacctgtaaaagatatgccttcaattcctgtcttgaatgctgccaaaagaaatgtcttagatagtagttctgacttcccttcaagtggggaaggagctacatttacacagtctcatcatcatttgccttctaggtattcacgtccccaggctcattcttcagcctcaggaggaattagaaggtcttcatctatgtcttatgttgatggcttcatagggacatggcccaaagagaaaagatcatcagtgcatggcgtatcatttgatatttcttttgataaagaagatagtgtacagagatccactccaaaccgaggaatcactcgttctattagtaatgaaggacttactctgaacaacagtcatgtatctaaacacattaggaaaaatttgtccttcaagccaataaatggagaagaggaagcagagagcattgaagaagaacttaatatagattctcacagtgacctcaaatcttgtgtgccccttaacacaaatgaactaaattctaatgagaatattcattacaagcttccaaatggagctttacaaaatagaatacttcttgacgagtttggcaatcagatcgagacaccaagcattgaagaagcattacaaataattcatgatactgaaaaatctcctcatacacctcagccagaccaaattgctaatggcttctttcttcatagtcaagaaatgagtatcttaaattcaaatatcaagttaaatcaatctagtcctgataatgtaactgatacgaaaggtgccttgagtcccataactgacaatactgaagtagacactggaattcacgttccttcagaagatattcctgaaactatggacgaagattcttcgttgagagattatactgtaagcttggactctgacatggatgatgcatctaaatttcttcaggattatgatattcgaactggcaacaccagggaagctttgagtccttgtccaagtactgtaagtaccaagtctcagccaggcagcagtgcttcttctagttctggagttaaaatgaccagctttgctgaacaaaaattcaggaaactgaatcataccgatggaaaaagtagtggaagcagttctcaaaaaactacaccagaaggctctgaacttaatattcctcatgtggttgcttgggcacaaattccagaagaaacagggcttccacagggacgggacactacccagctgttggcctctgaaatggtgcatcttaggatgaaactagaagaaaagaggcgtgctatagaagcccagaaaaagaaaatggaagctgcttttaccaaacagagacagaaaatgggaaggacagcattccttactgtagtgaaaaagaaaggggatgggatatctcctctacgagaggaagcggcgggtgcagaagatgagaaagtatatactgatcgagcaaaagaaaaggaatcacaaaaaactgatggacaaaggagcaagtcactggcagatataaaagagagcatggagaatcctcaagccaaatggctaaagtctccaactacacctattgatcctgagaagcagtggaacctggcaagcccctcagaagaaactttaaatgaaggagagattttagaatataccaaatccattgaaaagttaaattcatccctgcattttctacaacaagaaatgcaacgcttgtcacttcagcaggagatgttaatgcagatgagagagcaacaatcttgggtgatttcacctccacaaccctctccacagaaacagattcgagattttaagccttctaagcaggcaggcctgtcatcagccattgcaccattctcctcagactcccctcgtcctactcacccatctccacagtcttctaacaggaaaagtgcatctttttctgttaaaagtcaaaggactcctaggccaaatgagttaaaaataacacctttgaatcgaaccttgacacctcctcggtctgtggatagccttcctcggttaaggaggttttcaccaagtcaagttcctattcaaactaggtcatttgtatgttttggggatgatggagaacctcagttaaaggaatccaaacctaaagaggaagttaaaaaggaggaattggaatccaaagggactttggaacagcgtggacataatccagaagaaaaggaaatcaaaccttttgagtcaacagtctctgaagtcctatcactgcctgtcacagagactgtatgtctgacaccaaatgaggaccaattgaatcaacccacagaaccccctcctaaacccgttttcccacccactgctccaaaaaatgttaatctgattgaagtttccctctcagatttgaaaccccctgaaaaggctgatgtacctgttgaaaaatatgatggagaaagtgataaagaacaatttgatgatgaccagaaagtatgctgtggattcttttttaaggatgatcaaaaagcagaaaatgatatggcaatgaaacgggcagctttgttggagaaaagattaagaagggaaaaggaaactcagctccggaaacaacagttggaagcagaaatggagcataagaaggaggaaacaaggcgtaaaactgaggaagaacgtcagaagaaagaagatgagagagcacgcagagaatttattaggcaagaatatatgaggcggaaacaactgaaactaatggaagatatggatacagtaattaaaccccgtcctcaagtagtaaaacaaaaaaaacagcgaccaaaatctattcacagagatcatattgaatcccccaaaacaccaataaagggtcctccagtctctagcctttctttggcatcgctgaacacgggtgataacgagagtgtacattcaggcaagaggacgccaagatcagagtctgtagaaggcttcttatctccaagtcgttgtggcagtcgaaatggagaaaaagactgggagaatgcatcaacaacttcttcagtggcttctggaacagaatatacaggaccaaagctctacaaagaacccagtgcaaaatccaataagcacataatacaaaatgctttagctcattgctgtttggctggaaaagtaaatgaaggtcagaagaaaaaaatactggaggaaatggagaaatcagatgccaacaacttcttaatcttgttccgggattcaggatgccagttcagatctttatacacttattgcccagaaactgaagaaatcaataaactgactgggataggccctaaatctatcactaaaaaaatgattgaaggactttacaaatataattctgacaggaaacagtttagccacatacccgctaaaactttatctgccagtgttgatgcaattaccattcatagccatttatggcagaccaaaagaccagtaacacccaaaaaacttttacccactaaggcatagaagttgggaaatacttgcttcagaacattcatggtaaatttgcacttcatctttcctgcctatagaaaatctttctaattgccaacaagacttttattaattaaaactggacattaagctctgttgtcatgaacaactggaatgtaaaccacagtattttggagtgcagaacattctcaattaagtgataagtccaaatgatgaaggaaatgttttaattcacaaatggagatttgtatgtgttatcaggttcacctgcttgatattagatacattaaagcactgaattttcatggatattagttggatttatcattgaaatatggttaagattacaaattatgtgttttatttgttgcttttttttaaccttttaatgtatattcttgtcttcagatggtttgctatttttctctcctgggggtttattctaagatacctttgtattttatttcatgtggagatcatgaaagtaggaaatatacctttagaagtaactcgcacctttcttatgatgttaagagaaacactagtgtttagttttacagtaaccctcatattttaatggtgttacagcatttgcaaaaattattctgctaagtatttacaactctatttattattcactcaagtattaacattctctattaaataagaggaggtgttgtaaagagctgctagtaggttcgctttaaaccacatgagcttaaccaagaatatgttatgagaagttgctgattaaatcagtgctgtttttacaccacttctggccaactcagaataatttagattgttcttttaacaaaaaaggctttctatctcttttaaagtaagtcactttataagttggcagaagtgaatgacactttgagagtagtctttcaatctgaagatgtaagacttcctgaaacaagttctcaagaagtctttacattatatttataactcatataaaaattatatttagaatttttaaacatgtacaaagggctacattttaattttaaaatagcttcacattattttacttatattgggtttttcttcattttaatccttttcaagtggaatggcttagaataagtatacacttgaaatctcctctacatgatctttgttctttaacagtgtataccagagggttagttggggaaaaacttcattctcaggaaaagacttgaatgattatgtgaccctgttatatttcagtgttgtgacaaatgtgtaaactagcgggggaagacagtattgtatcataaatgagatgcgtagtttgttttctttcatgggaagtagagataaaaatatatacatttctctaattgagttgtttagagaaagaactaatgtctcatatgatgtatttacttattttaaaaaaaagaataggaatgagatgtccctgagctgtacttttctattattataaggcctttaggcatcagtgcatctgggttatcaacattttctcaaatgctgtcaatattttactgtaatttatgttcttatatttatgtatatttgttaaaactgtaaaaaaatttcacagatttttttccaatacctgtgcaagatacatgtgtagctcaaaactatttgtgatctactgtttgcatgtaagagaccaggatatgtaactcttatattttaagtgtatacatattgtgtatataacatatggatattaaaaatggggaattgcacattttaccttttggacagtaatttctatcacagttagaaggaaatgatagtcaaatacacgtttagattaaaactagtttaaaaaattataaatgaatctaatcaaaatgtgaatagtagtcaaaaggataatttaataagcattttacgttactaaatttgttcatttcaatattaactaaatttccctcatcaaagcaatctttgtgatattacttcgctattaaataaagaaaattggatgcaagacaatggagaaactttaaaactaaacaggaccaccctttattcttaaatttgtgtgtgtccaacagttgaattgaatgtctataaggtctaaaggtagaatgtgaatattgccacagagttcattgctctcagtataagattttactttattaatgcagaaggaatatggatatatttctttaagtctgcagatttttttattatggtgcagcttttttttaattatgtttttaaaattatacagttgaaaaatatgccatttcataaagtctgaggattttcgtcaaccttactgaaacacactggtgctttcatcatcagaggtcaaattattatgataactattccattaagtttgccaaacatttgtcgtggttaccagtgcagcctgtcaaattctgctatttgacacagctttggaaagatttagttcttggtttttccgttttgtattagaatgactgttacagttttatttggctgtttaaagccaaattcagctatttaattatggtttcatggacactgttgagcaatgtacagtgtatggtgtgcttacctgtccactctagagcattgcttacaggttttttgttttttaagatgctgtgctgtaaaatactgtcatacttgctatttcctggtacagtgtagtttttcccctttcatttgaataaaagcatggcaccaaa

SEQ ID NO: 4315 - DNA, 4498 bp, Homo sapiens
cgccatgtgaaggttagggccgggacatcccgaggagccgcggtgaaagatgggggatgctgcagaccccagggagatgagaaagacgttcattgttccagccatcaagccttttgaccactatgatttctccagggccaaaatcgcctgcaatctggcctggctggtggccaaagcctttgggacagaaaatgtgccagaggaacttcaagaaccattttacacagatcagtatgaccaggaacacatcaaaccacctgttgttaatttgcttctatcggctgaactatactgtcgtgctgggagtctcattctcaagagtgatgctgcaaaaccccttttgggccatgatgctgtaatccaggctttagcacagaaaggtctttatgtcactgaccaggaaaaattggtaactgaacgagatctccacaagaaacccatacagatgagtgcacatttggccatgatcgataccctcatgatggcttatactgtagaaatggtcagtatagaaaaagtaattgcgtgtgctcagcagtattcagctttttttcaagccacagatctgccctatgatattgaggacgctgtcatgtactggataaataaggtaaatgaacatttgaaagacataatggaacaagaacaaaaactgaaagaacatcacacagttgaagctccaggaggtcaaaaggctcgttatcggaaagagcaaacattgcttaagcaactgccttgcattccattggtagaaaatttgttgaaggatgggacagatggctgtgcattagctgcccttattcatttttactgtcctgatgttgtcagattagaggatatttgtttgaaagaaactatgtctttggctgatagcctgtataatctgcagctgattcaagaattttgccaagaatacttgaaccagtgttgccatttcactctggaagatatgctctatgctgcttcatccataaagagtaattatttggtgttcatggcggaactgttctggtggtttgaagtggtgaagccgtcttttgtacagcctcgtgttgttcgtccacaaggagctgaacctgtaaaagatatgccttcaattcctgtcttgaatgctgccaaaagaaatgtcttagatagtagttctgacttcccttcaaggtattcacgtccccaggctcattcttcagcctcaggaggaattagaaggtcttcatctatgtcttatgttgatggcttcatagggacatggcccaaagagaaaagatcatcagtgcatggcgtatcatttgatatttcttttgataaagaagatagtgtacagagatccactccaaaccgaggaatcactcgttctattagtaatgaaggacttactctgaacaacagtcatgtatctaaacacattaggaaaaatttgtccttcaagccaataaatggagaagaggaagcagagagcattgaagaagaacttaatatagattctcacagtgacctcaaatcttgtgtgccccttaacacaaatgaactaaattctaatgagaatattcattacaagcttccaaatggagctttacaaaatagaatacttcttgacgagtttggcaatcagatcgagacaccaagcattgaagaagcattacaaataattcatgatactgaaaaatctcctcatacacctcagccagaccaaattgctaatggcttctttcttcatagtcaagaaatgagtatcttaaattcaaatatcaagttaaatcaatctagtcctgataatgtaactgatacgaaaggtgccttgagtcccataactgacaatactgaagtagacactggaattcacgttccttcagaagatattcctgaaactatggacgaagattcttcgttgagagattatactgtaagcttggactctgacatggatgatgcatctaaatttcttcaggattatgatattcgaactggcaacaccagggaagctttgagtccttgtccaagtactgtaagtaccaagtctcagccaggcagcagtgcttcttctagttctggagttaaaatgaccagctttgctgaacaaaaattcaggaaactgaatcataccgatggaaaaagtagtggaagcagttctcaaaaaactacaccagaaggctctgaacttaatattcctcatgtggttgcttgggcacaaattccagaagaaacagggcttccacagggacgggacactacccagctgttggcctctgaaatggtgcatcttaggatgaaactagaagaaaagaggcgtgctatagaagcccagaaaaagaaaatggaagctgcttttaccaaacagagacagaaaatgggaaggacagcattccttactgtagtgaaaaagaaaggggatgggatatctcctctacgagaggaagcggcgggtgcagaagatgagaaagtatatactgatcgagcaaaagaaaaggaatcacaaaaaactgatggacaaaggagcaagtcactggcagatataaaagagagcatggagaatcctcaagccaaatggctaaagtctccaactacacctattgatcctgagaagcagtggaacctggcaagcccctcagaagaaactttaaatgaaggagagattttagaatataccaaatccattgaaaagttaaattcatccctgcattttctacaacaagaaatgcaacgcttgtcacttcagcaggagatgttaatgcagatgagagagcaacaatcttgggtgatttcacctccacaaccctctccacagaaacagattcgagattttaagccttctaagcaggcaggcctgtcatcagccattgcaccattctcctcagactcccctcgtcctactcacccatctccacagtcttctaacaggaaaagtgcatctttttctgttaaaagtcaaaggactcctaggccaaatgagttaaaaataacacctttgaatcgaaccttgacacctcctcggtctgtggatagccttcctcggttaaggaggttttcaccaagtcaagttcctattcaaactaggtcatttgtatgttttggggatgatggagaacctcagttaaaggaatccaaacctaaagaggaagttaaaaaggaggaattggaatccaaagggactttggaacagcgtggacataatccagaagaaaaggaaatcaaaccttttgagtcaacagtctctgaagtcctatcactgcctgtcacagagactgtatgtctgacaccaaatgaggaccaattgaatcaacccacagaaccccctcctaaacccgttttcccacccactgctccaaaaaatgttaatctgattgaagtttccctctcagatttgaaaccccctgaaaaggctgatgtacctgttgaaaaatatgatggagaaagtgataaagaacaatttgatgatgaccagaaagtatgctgtggattcttttttaaggatgatcaaaaagcagaaaatgatatggcaatgaaacgggcagctttgttggagaaaagattaagaagggaaaaggaaactcagctccggaaacaacagttggaagcagaaatggagcataagaaggaggaaacaaggcgtaaaactgaggaagaacgtcagaagaaagaagatgagagagcacgcagagaatttattaggcaagaatatatgaggcggaaacaactgaaactaatggaagatatggatacagtaattaaaccccgtcctcaagtagtaaaacaaaaaaaacagcgaccaaaatctattcacagagatcatattgaatcccccaaaacaccaataaagggtcctccagtctctagcctttctttggcatcgctgaacacgggtgataacgagagtgtacattcaggcaagaggacgccaagatcagagtctgtagaaggcttcttatctccaagtcgttgtggcagtcgaaatggagaaaaagactgggagaatgcatcaacaacttcttcagtggcttctggaacagaatatacaggaccaaagctctacaaagaacccagtgcaaaatccaataagcacataatacaaaatgctttagctcattgctgtttggctggaaaagtaaatgaaggtcagaagaaaaaaatactggaggaaatggagaaatcagatgccaacaacttcttaatcttgttccgggattcaggatgccagttcagatctttatacacttattgcccagaaactgaagaaatcaataaactgactgggataggccctaaatctatcactaaaaaaatgattgaaggactttacaaatataattctgacaggaaacagtttagccacatacccgctaaaactttatctgccagtgttgatgcaattaccattcatagccatttatggcagaccaaaagaccagtaacacccaaaaaacttttacccactaaggcatagaagttgggaaatacttgcttcagaacattcatggtaaatttgcacttcatctttcctgcc

SEQ ID NO: 4316 - DNA, 1302 bp, Homo sapiens
gagacagcccgccggccgcccggatctccacctgccaccccagagctgggacagcagccgggctgcggcactgggagggagaccccacagtggcctcttctgccacccacgcccccacccctggcatggccgaccagctgactgaggagcaggtcacagaattcaaggaggccttctccctgtttgacaaggatggggacggctgcatcaccacccgcgagctgggcacggtcatgcggtccctgggccagaaccccacggaggccgagctgcgggacatgatgagtgagatcgaccgggacggcaacggcaccgtggacttccccgagttcctgggcatgatggccaggaagatgaaggacacggacaacgaggaggagatccgcgaggccttccgcgtgttcgacaaggacggcaacggcttcgtcagcgccgccgagctgcgacacgtcatgacccggctgggggagaagctgagtgacgaggaggtggacgagatgatccgggccgcggacacggacggagacggacaggtgaactacgaggagtttgtccgtgtgctggtgtccaagtgaggccggcgcccaccatgctcctgggcgcccacgcggcccacagggcaagaacccggggcctcccgcctcctcccccatccccctgcctcccctgggcactgtggcttcctcctgcgcctggttgattcagcccacctctctgcatcccgcttcccgcgtctcttctctgcactcctgccgaccttcccacctgctcgtctgaatgacacggaacgctcccactgcaggcaaaccgtgacgccctccccactcgggagaagcagagctgaccttaggaccgagcaccagggcaggttgcgctgactctgcggccctccaggacggacaccgggtgaccccttagggcacccaggcaagatccctaagaggcacccaatgcccaggccaggggggctgcagccctcagcccccgccaggattcccgcaggctcctggactggaagctccctccgcggtcggattctggagggtgggaggcatcttggcctgcagtaagcggtgctgacggggactctggccacagaggtcaggcctcctgaaaacagcactgccttccgcgctgccccagcttgccccattccttgtccgccaacccaccgtgattcatcttctgaagctgggagtgaaactgggtcagctgtaacctgttcctattcatctggaaggagggaggcttggatgagcaggggatgagagctgcagggaaataaatgagatattcgtcctt

SEQ ID NO: 4317 - DNA, 1101 bp, Homo sapiens
ggtaattagacccagacagggagggctcagtgcgggtctgaggagggaacacacgtgtgcaggcgtgtgctccacggtggcatgttgatacggaccagcctgggcaccaggccccctcgggagccagctttgctgttctgagtggaagggagatcaggtttccctgagaaaccccaaaatagcccccaactgtgcctggcttccagcgggcagcccagcccccaggccctgttttgctccctttcccccttcacccccagcccatgtcctgctgtctcctccctgaatggtggaccctcagcccctcctgtacaagatggtcaagcggtgcctcatgcatttgttcattcgacctgtcctgagagtttgtgacatgctggcacggggccaatgttgagtccaccaggatgggagggtggccaggctctgagccactgagcaccagctggccaggatgggtcttcaacaagaaatctcactgcagccctggtgtcaccaccctgcagaatcctgtcagacaaccaccgacatgacagagcgcctgtcggctgagcagatcaaggagtacaagggagtctttgagatgttcgacgaagagggcaacggggaggtgaagacgggggagctggagtggctcatgagcctgctgggtatcaaccccaccaagagtgagctggcctcaatggccaaggatgtggacagagacaacaaagggttcttcaactgcgatggtttcctggcactaatgggagtttaccatgagaaggcccagaaccaggagagcgagctgagggcggcattccgtgtctttgacaaagagggcaagggctacattgactggaacacactcaagtacgtgctaatgaacgcaggggagcccctcaacgaggtggaggcggagcagatgatgaaggaggccgacaaggatggggacaggaccatcgactatgaggagtttgtggccatgatgacgggggagtccttcaagctgatccagtaggtgcagctgccgcagccgggggaggcctgcccgggaaggctgctgcccctgccccctggcccccactcccccggctccgtgtaaaataaatgttccagccc

SEQ ID NO: 4318 - DNA, 769 bp, Homo sapiens
cctgaatggtggaccctcagcccctcctgtacaagatggtcaagcggtgcctcatgcatttgttcattcgacctgtcctgagagtttgtgacatgctggcacggggccaatgttgagtccaccaggatgggagggtggccaggctctgagccactgagcaccagctggccaggatgggtcttcaacaagaaatctcactgacagagcgcctgtcggctgagcagatcaaggagtacaagggagtctttgagatgttcgacgaagagggcaacggggaggtgaagacgggggagctggagtggctcatgagcctgctgggtatcaaccccaccaagagtgagctggcctcaatggccaaggatgtggacagagacaacaaagggttcttcaactgcgatggtttcctggcactaatgggagtttaccatgagaaggcccagaaccaggagagcgagctgagggcggcattccgtgtctttgacaaagagggcaagggctacattgactggaacacactcaagtacgtgctaatgaacgcaggggagcccctcaacgaggtggaggcggagcagatgatgaaggaggccgacaaggatggggacaggaccatcgactatgaggagtttgtggccatgatgacgggggagtccttcaagctgatccagtaggtgcagctgccgcagccgggggaggcctgcccgggaaggctgctgcccctgccccctggcccccactcccccggctccgtgtaaaataaatgttccagccc

SEQ ID NO: 4319 - DNA, 4260 bp, Homo sapiens
actcaggggccaggggcgggcacagggccgggcttcgtgcggtggggctcgctcgcgcggcagcggtggccgaggcctcttggttctgcggcacgtgacggtcgggccgcctccgcctctctctttactgcggcgcggggcaaggtgtgcgggcgggaaggggcacgggcacccccgcggtccccgggaggctagagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggtggattttatccaaagccaagaaagacgataccgatgatgaaattgccaaatatgatggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtatgaggttaatttccaaaatggaatagaatgtggtggtgcctatgtgaaactgctttctaaaacaccagaactcaacctggatcagttccatgacaagaccccttatacgattatgtttggtccagataaatgtggagaggactataaactgcacttcatcttccgacacaaaaaccccaaaacgggtatctatgaagaaaaacatgctaagaggccagatgcagatctgaagacctattttactgataagaaaacacatctttacacactaatcttgaatccagataatagttttgaaatactggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactgggatgaagatgcccctgctaagattccagatgaagaggccacaaaacccgaaggctggttagatgatgagcctgagtacgtacctgatccagacgcagagaaacctgaggattgggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccagggaatctggaaacccaggaaaataccaaatccagatttctttgaagatctggaacctttcagaatgactccttttagtgctattggtttggagctgtggtccatgacctctgacattttttttgacaactttatcatttgtgctgatcgaagaatagttgatgattgggccaatgatggatggggcctgaagaaagctgctgatggggctgctgagccaggcgttgtggggcagatgatcgaggcagctgaagagcgcccgtggctgtgggtagtctatattctaactgtagcccttcctgtgttcctggttatcctcttctgctgttctggaaagaaacagaccagtggtatggagtataagaaaactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaaattctttcacttgatgtttgttagaccagaaagtgtgtgtgttctgtagctcagttcccagacagctttttaggtagtggaggaggtggcttcatgtggcacttgggcatttatattccacttgggagggtcaggctgtggccttctggagcaggtggcttgttaaggaatgctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgatttttatccatttcttttactctgtgtaaagacttgagaagtctaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtagaatttttaaaaaagtgatcttaggtttgttttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaagtttgttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaagacctgaaaatatgtctgcaggtttctccttgaagcaaatgtgtgggatcattgcatttccagaaatctgcctccttcaccctccgttgacagtatatgtcatgcctcactttcttctagctgagctttaaatcattagagcttaaattgtcagatcgttcattgcctttccagggttatttagtaaagtttgttgaaaacaaaaacgccttttcttggttcttttttcagttattttgaaggtccagcatcctgattaaatgtctgacacattaatgaatgaccagcagcagctttcagctcttaaaaagacacttatattttgattttacatgctggttacctgttccattgttgtcaaatgcccactctccatcagatgtgttcctccattttcttatccacaaagtactcctcacttttcaatttgtcatgttactaaatggtgttacattaaagccctgtgttaagtgtc

SEQ ID NO: 4320 - DNA, 984 bp, Homo sapiens
ggcacgtgacggtcgggccgcctccgcctctctctttactgcggcgcggggcaaggtgtgcgggcgggaaggggcacgggcacccccgcggtccccgggaggctagagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggtggattttatccaaagccaagaaagacgataccgatgatgaaattgccaaatatgatggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtatgaggttaatttccaaaatggaatagaatgtggtggtgcctataactgctttctaaaacaccagaactcaacctgggatcagttccatgacaagaccccttatacgattatgtttggtccagataaatgtggagaggactataaactgcacttcatcttccgacacaaaaaccccaaaacgggtatctatgaagaaaaacatgctaagaggccagatgcagatctgaagacctattttactgataagaaaacacatctttacacactaatcttgaatccagataatagttttgaaatactggttgaccaatctgtgcctcctgtaaatccttcacgtgaaattgaggacccagaagaccggaagcccgaggattgggatgaaagaccaaaaatcccagatccagaagctgtcaagccagatgac

SEQ ID NO: 4321 - DNA, 984 bp, Homo sapiens
atggaagggaagtggttgctgtgtatgttactggtgcttggaactgctattgttgaggctcatgatggacatgatgatgatgtgattgatattgaggatgaccttgacgatgtcattgaagaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtatgaggttaatttccaaaatggaatagaatgtggtggtgcctatgtgaaactgctttctaaaacaccagaactcaacctggatcagttccatgacaagaccccttatacgattatgtttggtccagataaatgtggagaggactataaactgcacttcatcttccgacacaaaaaccccaaaacgggtatctatgaagaaaaacatgctaagaggccagatgcagatctgaagacctattttactgataagaaaacacatctttacacactaatcttgaatccagataatagttttgaaatactggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactgggatgaagatgcccctgctaagattccagatgaagaggccacaaaacccgaaggctggttagatgatgagcctgagtacgtacctgatccagacgcagagaaacctgaggattgggatgaagacatggatggagaatgggaggctcctcagattgccaaccctagatgtgagtcagctcctggatgtggtgtctggcagcgacctgtggttgacattcagaaaacttcaagacatcaccatcagcaggctccagttgaacactag

SEQ ID NO: 4322 - DNA, 2222 bp, Homo sapiens
aatccggccaggcgctcgcgctgggttctgctcacgcccgtaggggcccgcgttcgctgcaacgggcccttcctgatggccgatcgtcggactcctaccccttttgccggctgccgtttgccccgtcagcgaagggcgcgcgatgcgtcccaagtctcggctccaggaaccagacggatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggtggattttatccaaagccaagaaagacgataccgatgatgaaattgccaaatatgatggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtatgaggttaatttccaaaatggaatagaatgtggtggtgcctatgtgaaactgctttctaaaacaccagaactcaacctggatcagttccatgacaagaccccttatacgattatgtttggtccagataaatgtggagaggactataaactgcacttcatcttccgacacaaaaaccccaaaacgggtatctatgaagaaaaacatgctaagaggccagatgcagatctgaagacctattttactgataagaaaacacatctttacacactaatcttgaatccagataatagttttgaaatactggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactgggatgaagatgcccctgctaagattccagatgaagaggccacaaaacccgaaggctggttagatgatgagcctgagtacgtacctgatccagacgcagagaaacctgaggattgggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccagggaatctggaaacccaggaaaataccaaatccagatttctttgaagatctggaacctttcagaatgactccttttagtgctattggtttggagctgtggtccatgacctctgacattttttttgacaactttatcatttgtgctgatcgaagaatagttgatgattgggccaatgatggatggggcctgaagaaagctgctgatggggctgctgagccaggcgttgtggggcagatgatcgaggcagctgaagagcgcccgtggctgtgggtagtctatattctaactgtagcccttcctgtgttcctggttatcctcttctgctgttctggaaagaaacagaccagtggtatggagtataagaaaactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaact

SEQ ID NO: 4323 - DNA, 4207 bp, Homo sapiens
actcaggggccaggggcgggcacagggccgggcttcgtgcggtggggctcgctcgcgcggcagcggtggccgaggcctcttggttctgcggcacgtgacggtcgggccgcctccgcctctctctttactgcggcgcggggcaagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggtggattttatccaaagccaagaaagacgataccgatgatgaaattgccaaatatgatggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtatgaggttaatttccaaaatggaatagaatgtggtggtgcctatgtgaaactgctttctaaaacaccagaactcaacctggatcagttccatgacaagaccccttatacgattatgtttggtccagataaatgtggagaggactataaactgcacttcatcttccgacacaaaaaccccaaaacgggtatctatgaagaaaaacatgctaagaggccagatgcagatctgaagacctattttactgataagaaaacacatctttacacactaatcttgaatccagataatagttttgaaatactggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactgggatgaagatgcccctgctaagattccagatgaagaggccacaaaacccgaaggctggttagatgatgagcctgagtacgtacctgatccagacgcagagaaacctgaggattgggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccagggaatctggaaacccaggaaaataccaaatccagatttctttgaagatctggaacctttcagaatgactccttttagtgctattggtttggagctgtggtccatgacctctgacattttttttgacaactttatcatttgtgctgatcgaagaatagttgatgattgggccaatgatggatggggcctgaagaaagctgctgatggggctgctgagccaggcgttgtggggcagatgatcgaggcagctgaagagcgcccgtggctgtgggtagtctatattctaactgtagcccttcctgtgttcctggttatcctcttctgctgttctggaaagaaacagaccagtggtatggagtataagaaaactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaaattctttcacttgatgtttgttagaccagaaagtgtgtgtgttctgtagctcagttcccagacagctttttaggtagtggaggaggtggcttcatgtggcacttgggcatttatattccacttgggagggtcaggctgtggccttctggagcaggtggcttgttaaggaatgctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgatttttatccatttcttttactctgtgtaaagacttgagaagtctaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtagaatttttaaaaaagtgatcttaggtttgttttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaagtttgttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaagacctgaaaatatgtctgcaggtttctccttgaagcaaatgtgtgggatcattgcatttccagaaatctgcctccttcaccctccgttgacagtatatgtcatgcctcactttcttctagctgagctttaaatcattagagcttaaattgtcagatcgttcattgcctttccagggttatttagtaaagtttgttgaaaacaaaaacgccttttcttggttcttttttcagttattttgaaggtccagcatcctgattaaatgtctgacacattaatgaatgaccagcagcagctttcagctcttaaaaagacacttatattttgattttacatgctggttacctgttccattgttgtcaaatgcccactctccatcagatgtgttcctccattttcttatccacaaagtactcctcacttttcaatttgtcatgttactaaatggtgttacattaaagccctgtgttaagtgtc

SEQ ID NO: 4324 - DNA, 825 bp, Homo sapiens
cagcgcggagcagtgcacgccaatccggccaggcgctcgcgctgggttctgctcacgcccgtaggggcccgcgttcgctgcaacgggcccttcctgatggccgatcgtcggactcctaccccttttgccggctgccgtttgccccgtcagcgaagggcgcgcgatgcgtcccaagtctcggctccaggaaccagacgggtgagggctactgggggttgggttggaacgccccgaaggcaccacagcaaccgacgcgggaacgcctgttaaaccagccccgccccgagacgcgcgcgcccggcggtctcgatccagcgtggcccgcccctcacctcccgcccaaccaacagccacttcctgcctcactcccggccaatcttcacactccacgaagaatagccgtagggggcgtatgggacgatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggtggattttatccaaagccaagaaagacgataccgatgatgaaattgccaaatatgatggaaagtgggaggtagaggaaatgaaggagtcaaagcttccaggtgataaaggacttgtgttgatgtctcgggccaagcatcatgccatctctgctaaa

SEQ ID NO: 4325 - DNA, 570 bp, Homo sapiens
gcggtggggctcgctcgcgcggcagcggtggccgaggcctcttggttctgcggcacgtgacgatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggtggattttatccaaagccaagaaagacgataccgatgatgaaattgccaaatatgatggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtatgaggttaatttccaaaatggaatagaatgtggtggtgcctatgtgaaactgcttt

SEQ ID NO: 4326 - DNA, 2232 bp, Homo sapiens
agtgcacgccaatccggccaggcgctcgcgctgggttctgctcacgcccgtaggggcccgcgttcgctgcaacgggcccttcctgatggccgatcgtcggactcctaccccttttgccggctgccgtttgccccgtcagcgaagggcgcgcgatgcgtcccaagtctcggctccaggaaccagacggatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggtggattttatccaaagccaagaaagacgataccgatgatgaaattgccaaatatgatggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtatgaggttaatttccaaaatggaatagaatgtggtggtgcctatgtgaaactgctttctaaaacaccagaactcaacctggatcagttccatgacaagaccccttatacgattatgtttggtccagataaatgtggagaggactataaactgcacttcatcttccgacacaaaaaccccaaaacgggtatctatgaagaaaaacatgctaagaggccagatgcagatctgaagacctattttactgataagaaaacacatctttacacactaatcttgaatccagataatagttttgaaatactggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactgggatgaagatgcccctgctaagattccagatgaagaggccacaaaacccgaaggctggttagatgatgagcctgagtacgtacctgatccagacgcagagaaacctgaggattgggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccagggaatctggaaacccaggaaaataccaaatccagatttctttgaagatctggaacctttcagaatgactccttttagtgctattggtttggagctgtggtccatgacctctgacattttttttgacaactttatcatttgtgctgatcgaagaatagttgatgattgggccaatgatggatggggcctgaagaaagctgctgatggggctgctgagccaggcgttgtggggcagatgatcgaggcagctgaagagcgcccgtggctgtgggtagtctatattctaactgtagcccttcctgtgttcctggttatcctcttctgctgttctggaaagaaacagaccagtggtatggagtataagaaaactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaact

SEQ ID NO: 4327 - DNA, 582 bp, Homo sapiens
gctcgcgcggcagcggtggccgaggcctcttggttctgcggcacgtgacggtcgggccgcctccgcctctctctttactgcggcgcggggcaaggtgtgcgggcgggaaggggcacgggcacccccgcggtccccgggaggctagagcggagactggaccctagttccctgaagagaaaggggaatgtaccagaaggagaacacgcagtggttgagaaacttagcagttacagcacctattctggaggcgagtaatccagttggagagggacagggcgttaaaagcaggaaagcccccgaaagctcatctaagtgcatctctttccacaccggaggcctggagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaac

SEQ ID NO: 4328 - DNA, 569 bp, Homo sapiens
gggcatgacacaagtgattgctggttgagggaagttaaactgagcttaatattaaaagattgagaggacaagattaaccatagttaagtctttttacctctgatttaggaaatggaagattttgcttaattttttaataagtagatttttttaagggggaagaattttattgatctttaaaatcattctgtatctcagtcttttcccaacattgtttgagggtcatgaatagaagcaactgccatatggatcaactgttgtacatttggtataattatacttagagcagaggtaaaggactatgtgggagttctcctgtgcatcagccagggtgcacacacaagccagacggagtctcgctctgtcactcaggctggagtgcagtggcgcgatctcggctcactgcaagctccgcctcccgggttcacgccattctcctgcctcagcctcccttgtagctgggactacagatcatggaagggaagtggttgctgtgtatgttactggtgcttggaactgctattgttgaggctcatgatggacatgatgatgatgtgattgatattgag

SEQ ID NO: 4329 - DNA, 1876 bp, Homo sapiens
gttctgcggcacgtgacggtcgggccgcctccgcctctctctttactgcggcgcggggcaaggtgtgcgggcgggaaggggcacgggcacccccgcggtccccgggaggctagagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtatgaggttaatttccaaaatggaatagaatgtggtggtgcctatgtgaaactgctttctaaaacaccagaactcaacctggatcagttccatgacaagaccccttatacgattatgtttggtccagataaatgtggagaggactataaactgcacttcatcttccgacacaaaaaccccaaaacgggtatctatgaagaaaaacatgctaagaggccagatgcagatctgaagacctattttactgataagaaaacacatctttacacactaatcttgaatccagataatagttttgaaatactggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactgggatgaagatgcccctgctaagattccagatgaagaggccacaaaacccgaaggctggttagatgatgagcctgagtacgtacctgatccagacgcagagaaacctgaggattgggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccagggaatctggaaacccaggaaaataccaaatccagatttctttgaagatctggaacctttcagaatgactccttttagtgctattggtttggagctgtggtccatgacctctgacattttttttgacaactttatcatttgtgctgatcgaagaatagttgatgattgggccaatgatggatggggcctgaagaaagctgctgatggggctgctgagccaggcgttgtggggcagatgatcgaggcagctgaagagcgcccgtggctgtgggtagtctatattctaactgtagcccttcctgtgttcctggttatcctcttctgctgttctggaaagaaacagaccagtggtatggagtataagaaaactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccct

SEQ ID NO: 4330 - DNA, 727 bp, Homo sapiens
gaggcctcttggttctgcggcacgtgacggtcgggccgcctccgcctctctctttactgcggcgcggggcaaggtgtgcgggcgggaaggggcacgggcacccccgcggtccccgggaggctagagatctgtggtcctccgtggaaagagagccactaccccaagacacatctaatataatacacagggcgcttacgtggttagaaaagaagagataagccgggtgcggtggctcactcctgtaatcccagcactttggaaggccgaggcgggcagatcacgacgtcaagagattgagactatcctggccaacacggtgaaaccctgtctctattaaaaataacaaaaattagctggatgtggtggtgcacacctgtcatcccacctacttgggaggctgagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggtggattttatccaaagccaagaaagacgataccgatgatgaaattgccaaatatgatggaaagtgggaggtagagg

SEQ ID NO: 4331 - DNA, 585 bp, Homo sapiens
gctggcgcctgcgcgcttgcgcatcttcctctgcccggcgcgcgccgcagccgtcgggatcacctcggggttgcgctgcttctccagcaagtgcatgcgcgccatggtctcagtcagcatgtctatgagcagttcctgctgcagcttcagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggtggattttatccaaagccaagaaagacgataccgatgatgaaattgccaaatatgatggaaagtgggaggtagaggaaatgaaggagtcaaagcttccaggtgataaaggacttgtgttgatgtctcgggccaagcatcatgccatctctgctaaactgaacaagcccttcctgtttgacaccaag

SEQ ID NO: 4332 - DNA, 1267 bp, Homo sapiens
gcggggccctcgggcttggagggctgggccgggcggggaacgggcggggcgggccggaggcggcggcggctgactcgccttctctccggggctgcgaccccgaggcaaccggctgcagatgggagcccgcggagccgaggatgcgggcgggccggggcgcgacgccggcgagggagctgttccgggacgccgccttccccgccgcggactcctcgctcttctgcgacttgtctacgccgctggcccagttccgcgaggacatcacgtggaggcggccccaggagatttgtgccacaccccggctgtttccagatgacccacgggaagggcaggtgaagcaggggctgctgggggattgctggttcctgtgtgcctgcgccgcgctgcagaagagcaggcacctcctggaccaggtctcttgccctgtgcagcttcctgcagactggacttgcaaagtccagcctgtatggctggagttcccatgcctgccaatctcctgtcgactgcgagtcagctccgatacttcaccagattcagccacctgggggagctggaagtgaatctcatcttagctgagccttctgatgagactgcagccccagctgacacctggattgcagactcatgaaagacctgaaactctaccaacagccacctgggggagctggaagtgaatctcctcgtagctgagccttctgatgagactgcagccccggctgacacctggattgcagactcatgaaagacctgaaactctaccaacagccacctgggggagctggaagtgaatctcctcgtagctgagccttctgatgagactgcagccccggctgacacctggattgcagactcatgaaagaccctgagcagaggacccagtttggcagagcccgaattcctgacccacaggaactgggagataaaactctgtggttttaatcttctcattttagaggtaatttttttgtgtagcaataggtagctgacaatgcacagctaaaataatagataattaaccctaatgctagtttcattcatccatcagggtttgcaaagtagtgatattctacttctgtcttccttcattatttattagcagaaatgtatctataaaaagaagtgttccttcattaactctttggtcatgttgaggtacagtttgcataggaaaggcagggcaaatgcttgattctttcccttcctttcctcatttataaaataatgaactgttttcctggcatctttcaacaatgactaatgagttttt

SEQ ID NO: 4333 - DNA, 862 bp, Homo sapiens
ccgaggcaaccggctgcagatgggagcccgcggagccgaggatgcgggcgggccggggcgcgacgccggcgagggagctgttccgggacgccgccttccccgccgcggactcctcgctcttctgcgacttgtctacgccgctggcccagttccgcgaggacatcacgtggaggcggccccaggtcccagagggtggaaggagccaggacgcacccccactgctgctgcaggagccgctgctgagctgcgtgccacatcgctacgcccaggaggtgagccggctctgcctcctgcctgcgggcacctacaaggttgtgccctccacctacctgccggacacagagggggccttcacagtgaccatcgcaaccaggattgacaggccatccattcacagccaggagatgctgggccagttcctccaagaggtctccatcatggcagtgatgaaaacctaacagggtggccccctgtgccagctcaggtgactggagcccgagggcctgacaggttcccagcagctgggccggccagccttgcactgtgggggctggtcctgagtcttggcctgcctcccagccctgccaggaggctgcggcctaggggtccacgggaagcctccgtcaggagagacgcagccctgggggccagctggtgctgcaaggaagggtgggaagcttgctggcttctgttgcgccactgagacggcagagaccccaggatcccagagcttcccaggatccctcccagatcctctgctgactccatatggaggcctcacacccagagggtagggcagcagatcttctttataactatttattgttcgaatcacttttaggatgtaactttataaataaac

SEQ ID NO: 4334 - DNA, 1999 bp, Homo sapiens
ccgaggcaaccggctgcagatgggagcccgcggagccgaggatgcgggcgggccggggcgcgacgccggcgagggagctgttccgggacgccgccttccccgccgcggactcctcgctcttctgcgacttgtctacgccgctggcccagttccgcgaggacatcacgtggaggcggccccaggagatttgtgccacaccccggctgtttccagatgacccacgggaagggcaggtgaagcaggggctgctgggggattgctggttcctgtgtgcctgcgccgcgctgcagaagagcaggcacctcctggaccaggtcattcctccgggacagccgagctgggccgaccaggagtaccggggctccttcacctgtcgcatttggcagtttggacgctgggtggaggtgaccacagatgaccgcctgccgtgccttgcagggagactctgtttctcccgctgccagagggaggatgtgttctggctccccttactggaaaaggtctacgccaaggtccatgggtcctacgagcacctgtgggccgggcaggtggcggatgccctggtggacctgaccggcggcctggcagaaagatggaacctgaagggcgtagcaggaagcggaggccagcaggacaggccaggccgctgggagcacaggacttgtcggcagctgctccacctgaaggaccagtgtctgatcagctgctgcgtgctcagccccagagcaggtgcccgggagctgggggagttccatgccttcattgtctcggacctgcgggagctccagggtcaggcgggccagtgcatcctgctgctgcggatccagaacccctggggccggcggtgctggcaggggctctggagagaggggggtgaagggtggagccaggtagatgcagcggtagcatctgagctcctgtcccagctccaggaaggggagttctgggtggaggaggaggagttcctcagggagtttgacgagctcaccgttggctacccggtcacggaggccggccacctgcagagcctctacacagagaggctgctctgccatacgcgggcgctgcctggggcctgggtcaagggccagtcagcaggaggctgccggaacaacagcggctttcccagcaaccccaaattctggctgcgggtctcagaaccgagtgaggtgtacattgccgtcctgcagagatccaggctgcacgcggcggactgggcaggccgggcccgggcactggtgggtgacagtcatacttcgtggagcccagcgagcatcccgggcaagcactaccaggctgtgggtctgcacctctggaaggtcccagagggtggaaggagccaggacgcacccccactgctgctgcaggagccgctgctgagctgcgtgccacatcgctacgcccaggaggtgagccggctctgcctcctgcctgcgggcacctacaaggttgtgccctccacctacctgccggacacagagggggccttcacagtgaccatcgcaaccaggattgacaggccatccattcacagccaggagatgctgggccagttcctccaagaggtctccatcatggcagtgatgaaaacctaacagggtggccccctgtgccagctcaggtgactggagcccgagggcctgacaggttcccagcagctgggccggccagccttgcactgtgggggctggtcctgagtcttggcctgcctcccagccctgccaggaggctgcggcctaggggtccacgggaagcctccgtcaggagagacgcagccctgggggccagctggtgctgcaaggaagggtgggaagcttgctggcttctgttgcgccactgagacggcagagaccccaggatcccagagcttcccaggatccctcccagatcctctgctgactccatatggaggcctcacacccagagggtagggcagcagatcttctttataactatttattgttcgaatcacttttaggatgtaactttataaataaac

SEQ ID NO: 4335 - DNA, 1512 bp, Homo sapiens
gactagcgggccggcgtactggcctggtccagcacctgcggggccctcgggcttggagggctgggccgggcggggaacgggcggggcgggccggaggcggcggcggctgactcgccttctctccggggctgcgaccccgaggcaaccggctgcagatgggagcccgcggagccgaggatgcgggcgggccggggcgcgacgccggcgagggagctgttccgggacgccgccttccccgccgcggactcctcgctcttctgcgacttgtctacgccgctggcccagttccgcgaggacatcacgtggaggcggccccaggagatttgtgccacaccccggctgtttccagatgacccacgggaagggcaggtgaagcaggggctgctgggggattgctggttcctgtgtgcctgcgccgcgctgcagaagagcaggcacctcctggaccaggtcattcctccgggacagccgagctgggccgaccaggagtaccggggctccttcacctgtcgcatttggcagtttggacgctgggtggaggtgaccacagatgaccgcctgccgtgccttgcagggagactctgtttctcccgctgccagagggaggatgtgttctggctccccttactggaaaaggtctacgccaaggtccatgggtcctacgagcacctgtgggccgggcaggtggcggatgccctggtggacctgaccggcggcctggcagaaagatggaacctgaagggcgtagcaggaagcggaggccagcaggacaggccaggccgctgggagcacaggacttgtcggcagctgctccacctgaaggaccagtgtctgatcagctgctgcgtgctcagccccagagcaggtgcccgggagctgggggagttccatgccttcattgtctcggacctgcgggagctccagggtcaggcgggccagtgcatcctgctgctgcggatccagaacccctggggccggcggtgctggcaggggctctggagagaggggggtgaagggtggagccaggtagatgcagcggtagcatctgagctcctgtcccagctccaggaaggggagttctgggtggaggaggaggagttcctcagggagtttgacgagctcaccgttggctacccggtcacggaggccggccacctgcagagcctctacacagagaggctgctctgccatacgcgggcgctgcctggggcctgggtcaagggccagtcagcaggaggctgccggaacaacagcggctttcccagcaaccccaaattctggctgcgggtctcagaaccgagtgaggtgtacattgccgtcctgcagagatccaggctgcacgcggcggactgggcaggccgggcccgggcactggtgggtgacagtcatacttcgtggagcccagcgagcatcccgggcaagcactaccaggctgtgggtctgcacctctggaagggtgtgacacttggcaccacactgttccctgtcccttcatggatgtggcccacatga

SEQ ID NO: 4336 - DNA, 2644 bp, Homo sapiens
cgcctggttaccaatgggagactagcgggccggcgtactggcctggtccagcacctgcggggccctcgggcttggagggctgggccgggcggggaacgggcggggcgggccggaggcggcggcggctgactcgccttctctccggggctgcgaccccgaggcaaccggctgcagatgggagcccgcggagccgaggatgcgggcgggccggggcgcgacgccggcgagggagctgttccgggacgccgccttccccgccgcggactcctcgctcttctgcgacttgtctacgccgctggcccagttccgcgaggacatcacgtggaggcggccccaggagatttgtgccacaccccggctgtttccagatgacccacgggaagggcaggtgaagcaggggctgctgggggattgctggttcctgtgtgcctgcgccgcgctgcagaagagcaggcacctcctggaccaggtcattcctccgggacagccgagctgggccgaccaggagtaccggggctccttcacctgtcgcatttggcagtttggacgctgggtggaggtgaccacagatgaccgcctgccgtgccttgcagggagactctgtttctcccgctgccagagggaggatgtgttctggctccccttactggaaaaggtctacgccaaggtccatgggtcctacgagcacctgtgggccgggcaggtggcggatgccctggtggacctgaccggcggcctggcagaaagatggaacctgaagggcgtagcaggaagcggaggccagcaggacaggccaggccgctgggagcacaggacttgtcggcagctgctccacctgaaggaccagtgtctgatcagctgctgcgtgctcagccccagagcaggtgcccgggagctgggggagttccatgccttcattgtctcggacctgcgggagctccagggtcaggcgggccagtgcatcctgctgctgcggatccagaacccctggggccggcggtgctggcaggggctctggagagaggggggtgaagggtggagccaggtagatgcagcggtagcatctgagctcctgtcccagctccaggaaggggagttctgggtggaggaggaggagttcctcagggagtttgacgagctcaccgttggctacccggtcacggaggccggccacctgcagagcctctacacagagaggctgctctgccatacgcgggcgctgcctggggcctgggtcaagggccagtcagcaggaggctgccggaacaacagcggctttcccagcaaccccaaattctggctgcgggtctcagaaccgagtgaggtgtacattgccgtcctgcagagatccaggctgcacgcggcggactgggcaggccgggcccgggcactggtgggtgacagtcatacttcgtggagcccagcgagcatcccgggcaagcactaccaggctgtgggtctgcacctctggaaggtagagaagcggcgggtcaatctgcctagggtcctgtccatgccccccgtggctggcaccgcgtgccatgcatacgaccgggaggtccacctgcgttgtgagctctcaccgggctactacctggctgtccccagcaccttcctgaaggacgcgccaggggagttcctgctccgagtcttctctaccgggcgagtctcccttagcgccatcagggcagtggccaagaacaccacccccggggcagccctgcctgcgggggagtgggggaccgtgcagctacggggttcttggagagtcggccagacggcggggggcagcaggaactttgcctcataccccaccaacccctgcttccccttctcggtccccgagggccctggcccccgctgcgtccgcatcactctgcatcagcactgccggcccagtgacaccgagttccaccccatcggcttccatatcttccaggtcccagagggtggaaggagccaggacgcacccccactgctgctgcaggagccgctgctgagctgcgtgccacatcgctacgcccaggaggtgagccggctctgcctcctgcctgcgggcacctacaaggttgtgccctccacctacctgccggacacagagggggccttcacagtgaccatcgcaaccaggattgacaggccatccattcacagccaggagatgctgggccagttcctccaagaggtctccatcatggcagtgatgaaaacctaacagggtggccccctgtgccagctcaggtgactggagcccgagggcctgacaggttcccagcagctgggccggccagccttgcactgtgggggctggtcctgagtcttggcctgcctcccagccctgccaggaggctgcggcctaggggtccacgggaagcctccgtcaggagagacgcagccctgggggccagctggtgctgcaaggaagggtgggaagcttgctggcttctgttgcgccactgagacggcagagaccccaggatcccagagcttcccaggatccctcccagatcctctgctgactccatatggaggcctcacacccagagggtagggcagcagatcttctttataactatttattgttcgaatcacttttaggatgtaactttataaataaacatgagcgctgatgatttgcagatca

SEQ ID NO: 4337 - DNA, 2728 bp, Homo sapiens
agaaccttcaactgtcaagcaccgagctagccaccagcatgctgtactccccagggccgagtcttccggagtcagcagagagcctggatggatcacaggaggataagcctcggggctcatgtgcggagcccacttttactgatacgggaatggtggctcacataaacaacagccggctcaaggccaagggcgtgggccagcacgacaacgcccagaactttggtaaccagagctttgaggagctgcgagcagcctgtctaagaaagggggagctcttcgaggaccccttattccctgctgaacccagctcactgggcttcaaggacctgggccccaactccaaaaatgtgcagaacatctcctggcagcggcccaaggatatcataaacaaccctctattcatcatggatgggatttctccaacagacatctgccaggggatcctcggggactgctggctgctggctgccatcggctcccttaccacctgccccaaactgctataccgcgtggtgcccagaggacagagcttcaagaaaaactatgctggcatcttccattttcagatttggcagtttggacagtgggtgaacgtggtggtagatgaccggctgcccacaaagaatgacaagctggtgtttgtgcactcaaccgaacgcagtgagttctggagtgccctgctggagaaggcgtatgccaagctgagtgggtcctatgaagcattgtcagggggcagtaccatggagggccttgaggacttcacaggaggcgtggcccagagcttccaactccagaggccccctcagaacctgctcaggctccttaggaaggccgtggagcgatcctccctcatgggttgctccattgaagtcaccagtgatagtgaactggaatccatgactgacaagatgctggtgagagggcacgcttactctgtgactggccttcaggatgtccactacagaggcaaaatggaaacactgattcgggtccggaatccctggggccggattgagtggaatggagcttggagtgacagtgccagggagtgggaagaggtggcctcagacatccagatgcagctgctgcacaagacggaggacggggagttctggatgtcctaccaagatttcctgaacaacttcacgctcctggagatctgcaacctcacgcctgatacactctctggggactacaagagctactggcacaccaccttctacgagggcagctggcgcagaggcagctccgcagggggctgcaggaaccaccctggcacgttctggaccaacccccagtttaagatctctcttcctgagggggatgacccagaggatgacgcagagggcaatgttgtggtctgcacctgcctggtggccctaatgcagaagaactggcggcatgcacggcagcagggagcccagctgcagaccattggctttgtcctctacgcggtcccaaaagagtttcagaacattcaggatgtccacttgaagaaggaattcttcacgaagtatcaggaccacggcttctcagagatcttcaccaactcacgggaggtgagcagccaactccggctgcctccgggggaatatatcattattccctccacctttgagccacacagagatgctgacttcctgcttcgggtcttcaccgagaagcacagcgagtcatgggaattggatgaagtcaactatgctgagcaactccaagaggaaaaggtctctgaggatgacatggaccaggacttcctacatttgtttaagatagtggcaggagagggcaaggagataggggtgtatgagctccagaggctgctcaacaggatggccatcaaattcaaaagcttcaagaccaagggctttggcctggatgcttgccgctgcatgatcaacctcatggataaagatggctctggcaagctggggcttctagagttcaagatcctgtggaaaaaactcaagaaatggatggacatcttcagagagtgtgaccaggaccattcaggcaccttgaactcctatgagatgcgcctggttattgagaaagcaggcatcaagctgaacaacaaggtaatgcaggtcctggtggccaggtatgcagatgatgacctgatcatagactttgacagcttcatcagctgtttcctgaggctaaagaccatgttcacattctttctaaccatggaccccaagaatactggccatatttgcttgagcctggaacagtggctgcagatgaccatgtggggatagaggcgctgtaggagcctggtcatctctaccagcagcagcagcagcgaggttctagcccaggagggtggggtgcttcttgtagccctcagctctccggtctctgctgatgaaatgggctccaggtggcagtgcccgggtcccaggtgccgtgtttactgcagcagtgggacctccgtgcccactcccccagctcagaggctttctcttttttccccaacccggcttctgatggctggctttcccccaccatcgctctctcagagtatattttactaaagagtagttgatgcttccccagggtccccctggctggggaggccaagaatagggaagggacttgtagcccgtttcttaccctccatgcttgctgtcctgctcacacctacctgctgaccacccatcctggcacagcctctgttttcctccccatctgtggatactattctaataaatagcacatgccattggct

SEQ ID NO: 4338 - DNA, 2728 bp, Homo sapiens
agaaccttcaactgtcaagcaccgagctagccaccagcatgctgtactccccagggccgagtcttccggagtcagcagagagcctggatggatcacaggaggataagcctcggggctcatgtgcggagcccacttttactgatacgggaatggtggctcacataaacaacagccggctcaaggccaagggcgtgggccagcacgacaacgcccagaactttggtaaccagagctttgaggagctgcgagcagcctgtctaagaaagggggagctcttcgaggaccccttattccctgctgaacccagctcactgggcttcaaggacctgggccccaactccaaaaatgtgcagaacatctcctggcagcggcccaaggatatcataaacaaccctctattcatcatggatgggatttctccaacagacatctgccaggggatcctcggggactgctggctgctggctgccatcggctcccttaccacctgccccaaactgctataccgcgtggtgcccagaggacagagcttcaagaaaaactatgctggcatcttccattttcagatttggcagtttggacagtgggtgaacgtggtggtagatgaccggctgcccacaaagaatgacaagctggtgtttgtgcactcaaccgaacgcagtgagttctggagtgccctgctggagaaggcgtatgccaagctgagtgggtcctatgaagcattgtcagggggcagtaccatggagggccttgaggacttcacaggaggcgtggcccagagcttccaactccagaggccccctcagaacctgctcaggctccttaggaaggccgtggagcgatcctccctcatgggttgctccattgaagtcaccagtgatagtgaactggaatccatgactgacaagatgctggtgagagggcacgcttactctgtgactggccttcaggatgtccactacagaggcaaaatggaaacactgattcgggtccggaatccctggggccggattgagtggaatggagcttggagtgacagtgccagggagtgggaagaggtggcctcagacatccagatgcagctgctgcacaagacggaggacggggagttctggatgtcctaccaagatttcctgaacaacttcacgctcctggagatctgcaacctcacgcctgatacactctctggggactacaagagctactggcacaccaccttctacgagggcagctggcgcagaggcagctccgcagggggctgcaggaaccaccctggcacgttctggaccaacccccagtttaagatctctcttcctgagggggatgacccagaggatgacgcagagggcaatgttgtggtctgcacctgcctggtggccctaatgcagaagaactggcggcatgcacggcagcagggagcccagctgcagaccattggctttgtcctctacgcggtggcctccccatttcagaacattcaggatgtccacttgaagaaggaattcttcacgaagtatcaggaccacggcttctcagagatcttcaccaactcacgggaggtgagcagccaactccggctgcctccgggggaatatatcattattccctccacctttgagccacacagagatgctgacttcctgcttcgggtcttcaccgagaagcacagcgagtcatgggaattggatgaagtcaactatgctgagcaactccaagaggaaaaggtctctgaggatgacatggaccaggacttcctacatttgtttaagatagtggcaggagagggcaaggagataggggtgtatgagctccagaggctgctcaacaggatggccatcaaattcaaaagcttcaagaccaagggctttggcctggatgcttgccgctgcatgatcaacctcatggataaagatggctctggcaagctggggcttctagagttcaagatcctgtggaaaaaactcaagaaatggatggacatcttcagagagtgtgaccaggaccattcaggcaccttgaactcctatgagatgcgcctggttattgagaaagcaggcatcaagctgaacaacaaggtaatgcaggtcctggtggccaggtatgcagatgatgacctgatcatagactttgacagcttcatcagctgtttcctgaggctaaagaccatgttcacattctttctaaccatggaccccaagaatactggccatatttgcttgagcctggaacagtggctgcagatgaccatgtggggatagaggcgctgtaggagcctggtcatctctaccagcagcagcagcagcgaggttctagcccaggagggtggggtgcttcttgtagccctcagctctccggtctctgctgatgaaatgggctccaggtggcagtgcccgggtcccaggtgccgtgtttactgcagcagtgggacctccgtgcccactcccccagctcagaggctttctcttttttccccaacccggcttctgatggctggctttcccccaccatcgctctctcagagtatattttactaaagagtagttgatgcttccccagggtccccctggctggggaggccaagaatagggaagggacttgtagcccgtttcttaccctccatgcttgctgtcctgctcacacctacctgctgaccacccatcctggcacagcctctgttttcctccccatctgtggatactattctaataaatagcacatgccattggct

SEQ ID NO: 4339 - DNA, 3129 bp, Homo sapiens
actgacctccttcttggtgctctgacagcggcagccggtcctccctcagctctgcccgccttctctcctgctgctggccaagcccattaagctgctaccttggccacaactgaaggccccacgccctgggaagaaagctactgaagaggcgtccctgctccccagcaccccaaaccatcaattaatattaacgagggaaggctcctcattgcctaaagaccccactggggctccaatggaagagaggccccgcccccgtgactcaggaggttaaagggcctggtgccggcttgtgaggccagtgtccagatggcatccagcagtgggagggtcaccatccagctcgtggatgaggaggctggggtcggagccgggcgcctgcagctttttcggggccagagctatgaggcaattcgggcagcctgcctggattcggggatcctgttccgcgacccttacttccctgctggccctgatgcccttggctatgaccagctggggccggactcggagaaggccaaaggcgtgaaatggatgaggccccatgagttctgtgctgagccgaagttcatctgtgaagacatgagccgcacagacgtgtgtcaggggagcctgggtaactgctggttccttgcagctgccgcctcccttactctgtatccccggctcctgcgccgggtggtccctcctggacaggatttccagcatggctacgcaggcgtcttccacttccagctctggcagtttggccgctggatggacgtcgtggtggatgacaggctgcccgtgcgtgaggggaagctgatgttcgtgcgctcggaacagcggaatgagttctgggccccactcctggagaaggcctacgccaagctccacggctcctatgaggtgatgcggggcggccacatgaatgaggcttttgtggatttcacaggcggcgtgggcgaggtgctctatctgagacaaaacagcatggggctgttctctgccctgcgccatgccctggccaaggagtccctcgtgggcgccactgccctgagtgatcggggtgagtaccgcacagaagagggcctggtaaagggacacgcgtattccatcacgggcacacacaaggtgttcctgggcttcaccaaggtgcggctgctgcggctgcggaacccatggggctgcgtggagtggacgggggcctggagcgacagctgcccacgctgggacacactccccaccgagtgccgcgatgccctgctggtgaaaaaggaggatggcgagttctggatggagctgcgggacttcctcctccatttcgacaccgtgcagatctgctcgctgagcccggaggtgctgggccccagcccggaggggggcggctggcacgtccacaccttccaaggccgctgggtgcgtggcttcaactccggcgggagccagcctaatgctgaaaccttctggaccaatcctcagttccgtttaacgctgctggagcctgatgaggaggatgacgaggatgaggaagggccctgggggggctggggggctgcaggggcacggggcccagcgcgggggggccgcacgcccaagtgcacggtccttctgtccctcatccagcgcaaccggcggcgcctgagagccaagggcctcacttacctcaccgttggcttccacgtgttccagattccagaggagctgctgggcctctgggattccccgcgcagccatgcgctcctgccccggctgctgcgcgccgaccgctcgcccctcagcgcccgccgcgacgtgacccgccgctgctgcctgcgtccaggccactacctggtggtgccgagcaccgcccacgccggcgacgaggctgacttcactctgcgtgtcttctccgagcgccgccacacggccgtggagatcgacgacgtgatcagcgcagacctgcagtctctccagggcccctacctgcccctggagctggggttggagcagctgtttcaggagctggctggagaggaggaagaactcaatgcctctcagctccaggccttactaagcattgccctggagcctgccagggcccatacctccacccccagagagatcgggctcaggacctgtgagcagctgctgcagtgtttcgggcatgggcaaagcctggccttacaccacttccagcagctctggggctacctcctggagtggcaggccatatttaacaagttcgatgaggacacctctggaaccatgaactcctacgagctgaggctggcactgaatgcagcaggcttccacctgaacaaccagctgacccagaccctcaccagccgctaccgggatagccgtctgcgtgtggacttcgagcggttcgtgtcctgtgtggcccacctcacctgcatcttctgccactgcagccagcacctggatgggggtgagggggtcatctgcctgacccacagacagtggatggaggtggccaccttctcctaggatctccggatgggcgcacctgctgctcagggcagggttgctgagcaagaccacctccctaggccttgcctggcatgggtgccactctctctggcatccacctgtctggggctagtctctggccctcactgctcacggccgggtgaccactctggcctgcgtactcctcactcagaaacaagaacagcgacagcccttctcgagcagatgacacgagctagtccacgttgacagcttaagacagtgctagctctgccctggctctcctagaaggtggaggacagacacaggagaaataaaaaaagatgatgctgcaggaatccttcttaaaaatattacatgttttattatcctgtccccagagggtggtttatccagaaaccaagaaaaaaaatcaatcagaataaactcaaaaaaaaaaggtagggggagcaaaaccatcaaccaccaggcagccaggccatcagcccacctccacctctggagggtccccagagacccacgcccgacgcagacccggaggagcatcagcaaggggcccgggcagagaatcggctatgtcttcattatgagagcaggagagacggcagagatatgttgctaggtgaatatatatttatataataaatccgtaagttaataaagtaaatagtaattctc

SEQ ID NO: 4340 - DNA, 2669 bp, Homo sapiens
atttctcaggagaacttatggcttcagaatcacagctcggtttttaagatggacataacctgtacgaccttctgatgggctttcaactttgaactggatgtggacacttttctctcagatgacagaattactccaacttcccctttgcagttgcttcctttccttgaaggtagctgtatcttattttctttaaaaagctttttcttccaaagccacttgccatgccgaccgtcattagcgcatctgtggctccaaggacagcggctgagccccggtccccagggccagttcctcacccggcccagagcaaggccactgaggctgggggtggaaacccaagtggcatctattcagccatcatcagccgcaattttcctattatcggagtgaaagagaagacattcgagcaacttcacaagaaatgtctagaaaagaaagttctttatgtggaccctgagttcccaccggatgagacctctctcttttatagccagaagttccccatccagttcgtctggaagagacctccggaaatttgcgagaatccccgatttatcattgatggagccaacagaactgacatctgtcaaggagagctaggggactgctggtttctcgcagccattgcctgcctgaccctgaaccagcaccttcttttccgagtcataccccatgatcaaagtttcatcgaaaactacgcagggatcttccacttccagttctggcgctatggagagtgggtggacgtggttatagatgactgcctgccaacgtacaacaatcaactggttttcaccaagtccaaccaccgcaatgagttctggagtgctctgctggagaaggcttatgctaagctccatggttcctacgaagctctgaaaggtgggaacaccacagaggccatggaggacttcacaggaggggtggcagagttttttgagatcagggatgctcctagtgacatgtacaagatcatgaagaaagccatcgagagaggctccctcatgggctgctccattgatgatggcacgaacatgacctatggaacctctccttctggtctgaacatgggggagttgattgcacggatggtaaggaatatggataactcactgctccaggactcagacctcgaccccagaggctcagatgaaagaccgacccggacaatcattccggttcagtatgagacaagaatggcctgcgggctggtcagaggtcacgcctactctgtcacggggctggatgaggtcccgttcaaaggtgagaaagtgaagctggtgcggctgcggaatccgtggggccaggtggagtggaacggttcttggagtgatagatggaaggactggagctttgtggacaaagatgagaaggcccgtctgcagcaccaggtcactgaggatggagagttctggatgtcctatgaggatttcatctaccatttcacaaagttggagatctgcaacctcacggccgatgctctgcagtctgacaagcttcagacctggacagtgtctgtgaacgagggccgctgggtacggggttgctctgccggaggctgccgcaacttcccagatactttctggaccaaccctcagtaccgtctgaagctcctggaggaggacgatgaccctgatgactcggaggtgatttgcagcttcctggtggccctgatgcagaagaaccggcggaaggaccggaagctaggggccagtctcttcaccattggcttcgccatctacgaggttccccatcagatgcacgggaacaagcagcacctgcagaaggacttcttcctgtacaacgcctccaaggccaggagcaaaacctacatcaacatgcgggaggtgtcccagcgcttccgcctgcctcccagcgagtacgtcatcgtgccctccacctacgagccccaccaggagggggaattcatcctccgggtcttctctgaaaagaggaacctctctgaggaagttgaaaataccatctccgtggatcggccagtgcccatcatcttcgtttcggacagagcaaacagcaacaaggagctgggtgtggaccaggagtcagaggagggcaaaggcaaaacaagccctgataagcaaaagcagtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctga

SEQ ID NO: 4341 - DNA, 3241 bp, Homo sapiens
attccagtgtttcagcgaggtggaagtgtgataccaataaagacaactgtaggaaaatccacaggctggatgactgaatcctcctatggactccgggttgctctaagcactaagggttcttcagtgggtgagttatatcttgatgatggccattcattccaatacctccaccagaagcaatttttgcacaggaagttttcattctgttccagtgttctgatcaatagttttgctgaccagaggggtcattatcccagcaagtgtgtggtggagaagatcttggtcttaggcttcaggaaggagccatcttctgtgactacccactcatctgatggtaaagatcagcctgtggcttttacgtattgtgccaaaacatccatcctgagcctggagaagctctcactcaacattgccactgactgggagggttcctaaaaaagctctaaaatgaatgcatagtgtgtctttccttcaagatgtaaatgtcaaggaatgagttggcaaatcagtttaaaaacacaaactacccaacagaaaaatgaaatttgcgagaatccccgatttatcattgatggagccaacagaactgacatctgtcaaggagagctaggggactgctggtttctcgcagccattgcctgcctgaccctgaaccagcaccttcttttccgagtcataccccatgatcaaagtttcatcgaaaactacgcagggatcttccacttccagttctggcgctatggagagtgggtggacgtggttatagatgactgcctgccaacgtacaacaatcaactggttttcaccaagtccaaccaccgcaatgagttctggagtgctctgctggagaaggcttatgctaagctccatggttcctacgaagctctgaaaggtgggaacaccacagaggccatggaggacttcacaggaggggtggcagagttttttgagatcagggatgctcctagtgacatgtacaagatcatgaagaaagccatcgagagaggctccctcatgggctgctccattgatgatggcacgaacatgacctatggaacctctccttctggtctgaacatgggggagttgattgcacggatggtaaggaatatggataactcactgctccaggactcagacctcgaccccagaggctcagatgaaagaccgacccggacaatcattccggttcagtatgagacaagaatggcctgcgggctggtcagaggtcacgcctactctgtcacggggctggatgaggtcccgttcaaaggtgagaaagtgaagctggtgcggctgcggaatccgtggggccaggtggagtggaacggttcttggagtgatagatggaaggactggagctttgtggacaaagatgagaaggcccgtctgcagcaccaggtcactgaggatggagagttctggatgtcctatgaggatttcatctaccatttcacaaagttggagatctgcaacctcacggccgatgctctgcagtctgacaagcttcagacctggacagtgtctgtgaacgagggccgctgggtacggggttgctctgccggaggctgccgcaacttcccagatactttctggaccaaccctcagtaccgtctgaagctcctggaggaggacgatgaccctgatgactcggaggtgatttgcagcttcctggtggccctgatgcagaagaaccggcggaaggaccggaagctaggggccagtctcttcaccattggcttcgccatctacgaggttcccaaagagatgcacgggaacaagcagcacctgcagaaggacttcttcctgtacaacgcctccaaggccaggagcaaaacctacatcaacatgcgggaggtgtcccagcgcttccgcctgcctcccagcgagtacgtcatcgtgccctccacctacgagccccaccaggagggggaattcatcctccgggtcttctctgaaaagaggaacctctctgaggaagttgaaaataccatctccgtggatcggccagtgagaaaagaaacttacaagcccatcatcttcgtttcggacagagcaaacagcaacaaggagctgggtgtggaccaggagtcagaggagggcaaaggcaaaacaagccctgataagcaaaagcagtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgctcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggtc

SEQ ID NO: 4342 - DNA, 1271 bp, Homo sapiens
cataatcctgaccctgagccagtgccaggtctccaagtgccttctgaatgaccacaggcgattggttttagtggtaggtgtgtggggatctgttctggtcatctggatgctggtcatcggtgtgcagtattgatcaggacctgcaaacccaaaagcttatgggagctggcacgtcacccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgctcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctgg

SEQ ID NO: 4343 - DNA, 2955 bp, Homo sapiens
atttctcaggagaacttatggcttcagaatcacagctcggtttttaagatggacataacctgtacgaccttctgatgggctttcaactttgaactggatgtggacacttttctctcagatgacagaattactccaacttcccctttgcagttgcttcctttccttgaaggtagctgtatcttattttctttaaaaagctttttcttccaaagccacttgccatgccgaccgtcattagcgcatctgtggctccaaggacagcggctgagccccggtccccagggccagttcctcacccggcccagagcaaggccactgaggctgggggtggaaacccaagtggcatctattcagccatcatcagccgcaattttcctattatcggagtgaaagagaagacattcgagcaacttcacaagaaatgtctagaaaagaaagttctttatgtggaccctgagttcccaccggatgagacctctctcttttatagccagaagttccccatccagttcgtctggaagagacctccggaaatttgcgagaatccccgatttatcattgatggagccaacagaactgacatctgtcaaggagagctaggggactgctggtttctcgcagccattgcctgcctgaccctgaaccagcaccttcttttccgagtcataccccatgatcaaagtttcatcgaaaactacgcagggatcttccacttccagttctggcgctatggagagtgggtggacgtggttatagatgactgcctgccaacgtacaacaatcaactggttttcaccaagtccaaccaccgcaatgagttctggagtgctctgctggagaaggcttatgctaagctccatggttcctacgaagctctgaaaggtgggaacaccacagaggccatggaggacttcacaggaggggtggcagagttttttgagatcagggatgctcctagtgacatgtacaagatcatgaagaaagccatcgagagaggctccctcatgggctgctccattgatacaatcattccggttcagtatgagacaagaatggcctgcgggctggtcagaggtcacgcctactctgtcacggggctggatgaggtcccgttcaaaggtgagaaagtgaagctggtgcggctgcggaatccgtggggccaggtggagtggaacggttcttggagtgatagatggaaggactggagctttgtggacaaagatgagaaggcccgtctgcagcaccaggtcactgaggatggagagttctggatgtcctatgaggatttcatctaccatttcacaaagttggagatctgcaacctcacggccgatgctctgcagtctgacaagcttcagacctggacagtgtctgtgaacgagggccgctgggtacggggttgctctgccggaggctgccgcaacttcccagatactttctggaccaaccctcagtaccgtctgaagctcctggaggaggacgatgaccctgatgactcggaggtgatttgcagcttcctggtggccctgatgcagaagaaccggcggaaggaccggaagctaggggccagtctcttcaccattggcttcgccatctacgaggttcccaaagagatgcacgggaacaagcagcacctgcagaaggacttcttcctgtacaacgcctccaaggccaggagcaaaacctacatcaacatgcgggaggtgtcccagcgcttccgcctgcctcccagcgagtacgtcatcgtgccctccacctacgagccccaccaggagggggaattcatcctccgggtcttctctgaaaagaggaacctctctgaggaagttgaaaataccatctccgtggatcggccagtgccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgctcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggtc

SEQ ID NO: 4344 - DNA, 3223 bp, Homo sapiens
attccagtgtttcagcgaggtggaagtgtgataccaataaagacaactgtaggaaaatccacaggctggatgactgaatcctcctatggactccgggttgctctaagcactaagggttcttcagtgggtgagttatatcttgatgatggccattcattccaatacctccaccagaagcaatttttgcacaggaagttttcattctgttccagtgttctgatcaatagttttgctgaccagaggggtcattatcccagcaagtgtgtggtggagaagatcttggtcttaggcttcaggaaggagccatcttctgtgactacccactcatctgatggtaaagatcagcctgtggcttttacgtattgtgccaaaacatccatcctgagcctggagaagctctcactcaacattgccactgactgggagggttcctaaaaaagctctaaaatgaatgcatagtgtgtctttccttcaagatgtaaatgtcaaggaatgagttggcaaatcagtttaaaaacacaaactacccaacagaaaaatgaaatttgcgagaatccccgatttatcattgatggagccaacagaactgacatctgtcaaggagagctaggggactgctggtttctcgcagccattgcctgcctgaccctgaaccagcaccttcttttccgagtcataccccatgatcaaagtttcatcgaaaactacgcagggatcttccacttccagttctggcgctatggagagtgggtggacgtggttatagatgactgcctgccaacgtacaacaatcaactggttttcaccaagtccaaccaccgcaatgagttctggagtgctctgctggagaaggcttatgctaagctccatggttcctacgaagctctgaaaggtgggaacaccacagaggccatggaggacttcacaggaggggtggcagagttttttgagatcagggatgctcctagtgacatgtacaagatcatgaagaaagccatcgagagaggctccctcatgggctgctccattgatgatggcacgaacatgacctatggaacctctccttctggtctgaacatgggggagttgattgcacggatggtaaggaatatggataactcactgctccaggactcagacctcgaccccagaggctcagatgaaagaccgacccggacaatcattccggttcagtatgagacaagaatggcctgcgggctggtcagaggtcacgcctactctgtcacggggctggatgaggtcccgttcaaaggtgagaaagtgaagctggtgcggctgcggaatccgtggggccaggtggagtggaacggttcttggagtgatagatggaaggactggagctttgtggacaaagatgagaaggcccgtctgcagcaccaggtcactgaggatggagagttctggatgtcctatgaggatttcatctaccatttcacaaagttggagatctgcaacctcacggccgatgctctgcagtctgacaagcttcagacctggacagtgtctgtgaacgagggccgctgggtacggggttgctctgccggaggctgccgcaacttcccagatactttctggaccaaccctcagtaccgtctgaagctcctggaggaggacgatgaccctgatgactcggaggtgatttgcagcttcctggtggccctgatgcagaagaaccggcggaaggaccggaagctaggggccagtctcttcaccattggcttcgccatctacgaggttcccaaagagatgcacgggaacaagcagcacctgcagaaggacttcttcctgtacaacgcctccaaggccaggagcaaaacctacatcaacatgcgggaggtgtcccagcgcttccgcctgcctcccagcgagtacgtcatcgtgccctccacctacgagccccaccaggagggggaattcatcctccgggtcttctctgaaaagaggaacctctctgaggaagttgaaaataccatctccgtggatcggccagtgcccatcatcttcgtttcggacagagcaaacagcaacaaggagctgggtgtggaccaggagtcagaggagggcaaaggcaaaacaagccctgataagcaaaagcagtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgctcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggtc

SEQ ID NO: 4345 - DNA, 3298 bp, Homo sapiens
cactctctttctctctccctctggcatgcatgctgctggtaggagacccccaagtcaacattgcttcagaaatcctttagcactcatttctcaggagaacttatggcttcagaatcacagctcggtttttaagatggacataacctgtacgaccttctgatgggctttcaactttgaactggatgtggacacttttctctcagatgacagaattactccaacttcccctttgcagttgcttcctttccttgaaggtagctgtatcttattttctttaaaaagctttttcttccaaagccacttgccatgccgaccgtcattagcgcatctgtggctccaaggacagcggctgagccccggtccccagggccagttcctcacccggcccagagcaaggccactgaggctgggggtggaaacccaagtggcatctattcagccatcatcagccgcaattttcctattatcggagtgaaagagaagacattcgagcaacttcacaagaaatgtctagaaaagaaagttctttatgtggaccctgagttcccaccggatgagacctctctcttttatagccagaagttccccatccagttcgtctggaagagacctccggaaatttgcgagaatccccgatttatcattgatggagccaacagaactgacatctgtcaaggagagctaggggactgctggtttctcgcagccattgcctgcctgaccctgaaccagcaccttcttttccgagtcataccccatgatcaaagtttcatcgaaaactacgcagggatcttccacttccagttctggcgctatggagagtgggtggacgtggttatagatgactgcctgccaacgtacaacaatcaactggttttcaccaagtccaaccaccgcaatgagttctggagtgctctgctggagaaggcttatgctaagctccatggttcctacgaagctctgaaaggtgggaacaccacagaggccatggaggacttcacaggaggggtggcagagttttttgagatcagggatgctcctagtgacatgtacaagatcatgaagaaagccatcgagagaggctccctcatgggctgctccattgatgatggcacgaacatgacctatggaacctctccttctggtctgaacatgggggagttgattgcacggatggtaaggaatatggataactcactgctccaggactcagacctcgaccccagaggctcagatgaaagaccgacccggacaatcattccggttcagtatgagacaagaatggcctgcgggctggtcagaggtcacgcctactctgtcacggggctggatgaggtcccgttcaaaggtgagaaagtgaagctggtgcggctgcggaatccgtggggccaggtggagtggaacggttcttggagtgatagatggaaggactggagctttgtggacaaagatgagaaggcccgtctgcagcaccaggtcactgaggatggagagttctggatgtcctatgaggatttcatctaccatttcacaaagttggagatctgcaacctcacggccgatgctctgcagtctgacaagcttcagacctggacagtgtctgtgaacgagggccgctgggtacggggttgctctgccggaggctgccgcaacttcccagatactttctggaccaaccctcagtaccgtctgaagctcctggaggaggacgatgaccctgatgactcggaggtgatttgcagcttcctggtggccctgatgcagaagaaccggcggaaggaccggaagctaggggccagtctcttcaccattggcttcgccatctacgaggttcccaaagagatgcacgggaacaagcagcacctgcagaaggacttcttcctgtacaacgcctccaaggccaggagcaaaacctacatcaacatgcgggaggtgtcccagcgcttccgcctgcctcccagcgagtacgtcatcgtgccctccacctacgagccccaccaggagggggaattcatcctccgggtcttctctgaaaagaggaacctctctgaggaagttgaaaataccatctccgtggatcggccagtgcccatcatcttcgtttcggacagagcaaacagcaacaaggagctgggtgtggaccaggagtcagaggagggcaaaggcaaaacaagccctgataagcaaaagcagtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgctcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggtc

SEQ ID NO: 4346 - DNA, 3316 bp, Homo sapiens
cactctctttctctctccctctggcatgcatgctgctggtaggagacccccaagtcaacattgcttcagaaatcctttagcactcatttctcaggagaacttatggcttcagaatcacagctcggtttttaagatggacataacctgtacgaccttctgatgggctttcaactttgaactggatgtggacacttttctctcagatgacagaattactccaacttcccctttgcagttgcttcctttccttgaaggtagctgtatcttattttctttaaaaagctttttcttccaaagccacttgccatgccgaccgtcattagcgcatctgtggctccaaggacagcggctgagccccggtccccagggccagttcctcacccggcccagagcaaggccactgaggctgggggtggaaacccaagtggcatctattcagccatcatcagccgcaattttcctattatcggagtgaaagagaagacattcgagcaacttcacaagaaatgtctagaaaagaaagttctttatgtggaccctgagttcccaccggatgagacctctctcttttatagccagaagttccccatccagttcgtctggaagagacctccggaaatttgcgagaatccccgatttatcattgatggagccaacagaactgacatctgtcaaggagagctaggggactgctggtttctcgcagccattgcctgcctgaccctgaaccagcaccttcttttccgagtcataccccatgatcaaagtttcatcgaaaactacgcagggatcttccacttccagttctggcgctatggagagtgggtggacgtggttatagatgactgcctgccaacgtacaacaatcaactggttttcaccaagtccaaccaccgcaatgagttctggagtgctctgctggagaaggcttatgctaagctccatggttcctacgaagctctgaaaggtgggaacaccacagaggccatggaggacttcacaggaggggtggcagagttttttgagatcagggatgctcctagtgacatgtacaagatcatgaagaaagccatcgagagaggctccctcatgggctgctccattgatgatggcacgaacatgacctatggaacctctccttctggtctgaacatgggggagttgattgcacggatggtaaggaatatggataactcactgctccaggactcagacctcgaccccagaggctcagatgaaagaccgacccggacaatcattccggttcagtatgagacaagaatggcctgcgggctggtcagaggtcacgcctactctgtcacggggctggatgaggtcccgttcaaaggtgagaaagtgaagctggtgcggctgcggaatccgtggggccaggtggagtggaacggttcttggagtgatagatggaaggactggagctttgtggacaaagatgagaaggcccgtctgcagcaccaggtcactgaggatggagagttctggatgtcctatgaggatttcatctaccatttcacaaagttggagatctgcaacctcacggccgatgctctgcagtctgacaagcttcagacctggacagtgtctgtgaacgagggccgctgggtacggggttgctctgccggaggctgccgcaacttcccagatactttctggaccaaccctcagtaccgtctgaagctcctggaggaggacgatgaccctgatgactcggaggtgatttgcagcttcctggtggccctgatgcagaagaaccggcggaaggaccggaagctaggggccagtctcttcaccattggcttcgccatctacgaggttcccaaagagatgcacgggaacaagcagcacctgcagaaggacttcttcctgtacaacgcctccaaggccaggagcaaaacctacatcaacatgcgggaggtgtcccagcgcttccgcctgcctcccagcgagtacgtcatcgtgccctccacctacgagccccaccaggagggggaattcatcctccgggtcttctctgaaaagaggaacctctctgaggaagttgaaaataccatctccgtggatcggccagtgaaaaagaaaaaaaccaagcccatcatcttcgtttcggacagagcaaacagcaacaaggagctgggtgtggaccaggagtcagaggagggcaaaggcaaaacaagccctgataagcaaaagcagtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgctcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggtc

SEQ ID NO: 4347 - DNA, 1643 bp, Homo sapiens
ccctcctccacgcttacagccacacacacagtcacacagacgcgttctgagggtggctgcccgcttgggatggaggaatcacttccctcagaacccagccaagtcctctaggcctccttgggggtccttccagcctgaggggcttcggagctgaggagcagctgttctgatgcacgggaacaagcagcacctgcagaaggacttcttcctgtacaacgcctccaaggccaggagcaaaacctacatcaacatgcgggaggtgtcccagcgcttccgcctgcctcccagcgagtacgtcatcgtgccctccacctacgagccccaccaggagggggaattcatcctccgggtcttctctgaaaagaggaacctctctgaggaagttgaaaataccatctccgtggatcggccagtgaaaaagaaaaaaaccaagcccatcatcttcgtttcggacagagcaaacagcaacaaggagctgggtgtggaccaggagtcagaggagggcaaaggcaaaacaagccctgataagcaaaagcagtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgctcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggtc

SEQ ID NO: 4348 - DNA, 1291 bp, Homo sapiens
cataatcctgaccctgagccagtgccaggtctccaagtgccttctgaatgaccacaggcgattggttttagtggtaggtgtgtggggatctgttctggtcatctggatgctggtcatcggtgtgcagtattgatcaggacctgcaaacccaaaagcttatgggagctggcacgtcacaaaaagaaaaaaaccaagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgctcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggtc

SEQ ID NO: 4349 - DNA, 4397 bp, Homo sapiens
gaatgcgagcgccagcccccgccgcaggccagtcccagctggatctccggccagagcccgaggctgctgcgccgggcggctgcagcctccgctccagcgcccgcgccgtgccctgcatcccgggagcccggctggacccgcggcggctcggccggtgttccccctcccctccctggggcagcagccaccatgttctcgtgtgtgaagccctatgaggaccagaactactcagccctgaggcgggactgccggcgcaggaaggtgctcttcgaggaccccctcttccccgccactgacgactcactctactataagggcacgccggggcccgccgtcaggtggaagcgacccaagggcatctgcgaggacccccgcctctttgtggatggcatcagctcccacgacctgcaccagggccaggtgggcaactgctggtttgtggcagcctgctcgtcacttgcctcccgggagtcgctgtggcaaaaggtcatcccagactggaaggagcaggaatgggaccccgaaaagcccaacgcctacgcgggcatcttccacttccacttctggcgcttcggggaatgggtggacgtggtcatcgatgaccggctgcccacagtcaacaaccagctcatctactgccactccaactcccgcaatgagttttggtgcgccctagtggagaaggcctatgccaaactggcaggctgttaccaggccctggatggaggcaacacagcagacgcactggtggacttcacgggtggtgtttctgagcccatcgacctgaccgagggtgactttgccaacgatgagactaagaggaaccagctctttgagcgcatgttaaaggtgcacagccggggcggcctcatcagtgcctccatcaaggcagtgacagcagctgacatggaggcccgcctggcgtgcggcctggtaaagggccacgcatacgccgtcactgatgtgcgcaaggtgcgcctgggccacggcctactggccttcttcaagtcagagaagttggacatgatccgcctgcgcaacccctggggcgagcgggagtggaacgggccctggagtgacacctcggaggagtggcagaaagtgagcaagagtgagcgggagaagatgggtgtgaccgtgcaggacgacggtgagttctggatgaccttcgaggacgtgtgccggtacttcacggacatcatcaagtgccgcgtgatcaacacatcccacctgagcatccacaagacgtgggaggaggcccggctgcatggcgcctggacgctgcatgaggacccgcgacagaaccgcggtggcggctgcatcaaccacaaggacaccttcttccagaacccacagtacatcttcgaagtcaagaagccagaagatgaagtcctgatctgcatccagcagcggccaaagcggtctacgcgccgggagggcaagggtgagaacctggccattggctttgacatctacaaggtggaggagaaccgccagtaccgcatgcacagcctgcagcacaaggccgccagctccatctacatcaactcacgcagcgtcttcctgcgcaccgaccagcccgagggccgctatgtcatcatccccacaaccttcgagccaggccacactggcgagttcctgctccgagtcttcactgatgtgccctccaactgccgggagctgcgcctggatgagcccccacacacctgctggagctccctctgtggctacccccagctggtgacccaggtacatgtcctgggagctgctggcctcaaggactccccaacaggggctaactcttatgtgatcatcaagtgtgagggagacaaagtccgctcggctgtgcagaagggcacctccacaccagagtacaatgtgaaaggcatcttctaccgcaagaagctgagccagcccatcactgtacaggtctggaaccaccgagtgctgaaggatgaatttctgggccaggtgcacctaaaggctgacccggacaacctccaggccctgcataccctccacctccgggaccgaaatagccggcagcccagcaacctgccaggcactgtggccgtgcacattctcagcagcacctccctcatggctgtctgacacctgcccacctacctggctctgaccgttcccaccaccatctgcatgtccccactgggcctgagtctagcctgggagccaggatactggggtccttttcccactcttccactgacttgctgtgtgaccttaggaagtctctgcccctctctcagcctcagtgtcccgagggccccgaagcattccattctcgtggaggagtttccttgctgagatttcaaatagtcctccccacctcaactgtcaccactgctaagggactctatccattgagcacattttcctaaggccctgctgtctgccgaggagcgccaagaagatgtcacttgtttacacacgaactgccacatccccaagctccgttcttgcccctcgtgtcctaggcccaacccagcctcccagacctcactttccccatcagcaatacctggtgttctcccaccttgaaaggactcttggctcctgccgggttcctgctcaggctggaattgggaaaatatgcaggtgacatttgttcattctctaatcccatcctctcacccatccatttcctcactcagtggagatttgccaaatgaataaacgacacctttgaggccccaggtgaagcggggccctactccggcctctgccttgggcctcgcctctgtcctcaggtcctctcagaggcagatacctaggggagctgctgctgcctgctcattctagcttccgattccattcccagcccctgcgttaaggtccctggagaggtggcgtcagtgggggtgaggaagggcatcttcctgactcctctgcccagtgctggaaggagcatgcctgggttagtgggccaggggccaggcagctgggggcctttggggaccagaaggggagatgtgctcccagagcctctctgctgtaagaccccagcttttcctggaagatgggactctggggtgtgtggtgctcaccagagtcaggccacccactgggctcggcaggagatagggagccccatcacctgaccacagccccccaccaacattcccccaaaatgcagcctaggaggccgcagtgctcttcttcctgcccagaccaaaatgttccttttagtcctcaatgttttatattctttttgttttgaaaatctcaattttaatcaggggttttaaaagaaaattgaaagcctgaacctccatttttcttcttggctccagttttgctggtcctctggagaactcttcgtgagcactggtgccgtgacccacttgggatctctgctgtgcccttctcgggcttccagaccaggtgtagcaaatgaaaaagtgcagttaattcaagaacaggaatccctgtgtccttgctgggatttccttttgggaacctgactttccgactccagatcctgctgtctggatcagtgttctggctggaggtgctggattctctgattttgcctcctcactctgtgtctggctttgctcctgggtcttggccctgggccatatgaggggccaggaaatgaacgacaaggaggataagagtgttctttcttgaaagccgggacttcccctcaagaacctgggcctggggccgggactctgcatgactgggagcaagtcacttaaacctcctgtgcctcgatttcccccttctacaaagtggggccaatgattcttgtgtgtcagcactgttactaccgagtgctgagtaagggcaaaataatacccctttctctatgtatctctgtatgcacacgcactatatatatatatatatatatatatacattcatgtaatcaccacttctcgatgtctatttcaaatcaaggctcctgagtagggggtgaagtgagccagcttgcacctcaggctaacacataggactttgctcagccatgtcccctgggatacaggggcacaccaggaccaagtggcagacctgtgggcttcagcctcggggccggggcatgcctgccaccccctgacaaaaacaggttccacagtgctacccttgcttcctgccccttgaggtgggccaggctggctcctggctatgcagggatctctggtccccaggagaccttgggggccaggcaggtaaggatcaggggtgataggggagagcaattactttgttcactgtatgcacccgcgggggcctgggagtccccatttgcaggtgggtagggcctccagcccacaccacccagacctaggcttccctcttctcaggatccaccacagggttaggggacaggaagcctgttctattctcaataaatcttacaaaattccaaaaa

SEQ ID NO: 4350 - DNA, 3397 bp, Homo sapiens
agtcccagctggatctccggccagagcccgaggctgctgcgccgggcggctgcagcctccgctccagcgcccgcgccgtgccctgcatcccgggagcccggctggacccgcggcggctcggccggttgtctctccggtggggagtgagcgagcacacagcccccaccccaccccgggtgagagagaatgtcctgcacagggacgcccagctgtatctacctgctgtcagcactttctctgcaggacctggtgctggactgggagccccgaggtgttccccctcccctccctggggcagcagccaccatgttctcgtgtgtgaagccctatgaggaccagaactactcagccctgaggcgggactgccggcgcaggaaggtgctcttcgaggaccccctcttccccgccactgacgactcactctactataagggcacgccggggcccgccgtcaggtggaagcgacccaagggcatctgcgaggacccccgcctctttgtggatggcatcagctcccacgacctgcaccagggccaggtgggcaactgctggtttgtggcagcctgctcgtcacttgcctcccgggagtcgctgtggcaaaaggtcatcccagactggaaggagcaggaatgggaccccgaaaagcccaacgcctacgcgggcatcttccacttccacttctggcgcttcggggaatgggtggacgtggtcatcgatgaccggctgcccacagtcaacaaccagctcatctactgccactccaactcccgcaatgagttttggtgcgccctagtggagaaggcctatgccaaactggcaggctgttaccaggccctggatggaggcaacacagcagacgcactggtggacttcacgggtggtgtttctgagcccatcgacctgaccgagggtgactttgccaacgatgagactaagaggaaccagctctttgagcgcatgttaaaggtgcacagccggggcggcctcatcagtgcctccatcaaggcagtgacagcagctgacatggaggcccgcctggcgtgcggcctggtaaagggccacgcatacgccgtcactgatgtgcgcaaggtgcgcctgggccacggcctactggccttcttcaagtcagagaagttggacatgatccgcctgcgcaacccctggggcgagcgggagtggaacgggccctggagtgacacctcggaggagtggcagaaagtgagcaagagtgagcgggagaagatgggtgtgaccgtgcaggacgacggtgagttctggatgaccttcgaggacgtgtgccggtacttcacggacatcatcaagtgccgcgtgatcaacacatcccacctgagcatccacaagacgtgggaggaggcccggctgcatggcgcctggacgctgcatgaggacccgcgacagaaccgcggtggcggctgcatcaaccacaaggacaccttcttccagaacccacagtacatcttcgaagtcaagaagccagaagatgaagtcctgatctgcatccagcagcggccaaagcggtctacgcgccgggagggcaagggtgagaacctggccattggctttgacatctacaaggtggaggagaaccgccagtaccgcatgcacagcctgcagcacaaggccgccagctccatctacatcaactcacgcagcgtcttcctgcgcaccgaccagcccgagggccgctatgtcatcatccccacaaccttcgagccaggccacactggcgagttcctgctccgagtcttcactgatgtgccctccaactgccgggagctgcgcctggatgagcccccacacacctgctggagctccctctgtggctacccccagctggtgacccaggtacatgtcctgggagctgctggcctcaaggactccccaacaggggctaactcttatgtgatcatcaagtgtgagggagacaaagtccgctcggctgtgcagaagggcacctccacaccagagtacaatgtgaaaggcatcttctaccgcaagaagctgagccagcccatcactgtacaggtctggaaccaccgagtgctgaaggatgaatttctgggccaggtgcacctaaaggctgacccggacaacctccaggccctgcataccctccacctccgggaccgaaatagccggcagcccagcaacctgccaggcactgtggccgtgcacattctcagcagcacctccctcatggctgtctgacacctgcccacctacctggctctgaccgttcccaccaccatctgcatgtccccactgggcctgagtctagcctgggagccaggatactggggtccttttcccactcttccactgacttgctgtgtgaccttaggaagtctctgcccctctctcagcctcagtgtcccgagggccccgaagcattccattctcgtggaggagtttccttgctgagatttcaaatagtcctccccacctcaactgtcaccactgctaagggactctatccattgagcacattttcctaaggccctgctgtctgccgaggagcgccaagaagatgtcacttgtttacacacgaactgccacatccccaagctccgttcttgcccctcgtgtcctaggcccaacccagcctcccagacctcactttccccatcagcaatacctggtgttctcccaccttgaaaggactcttggctcctgccgggttcctgctcaggctggaattgggaaaatatgcaggtgacatttgttcattctctaatcccatcctctcacccatccatttcctcactcagtggagatttgccaaatgaataaacgacacctttgaggccccaggtgaagcggggccctactccggcctctgccttgggcctcgcctctgtcctcaggtcctctcagaggcagatacctaggggagctgctgctgcctgctcattctagcttccgattccattcccagcccctgcgttaaggtccctggagaggtggcgtcagtgggggtgaggaagggcatcttcctgactcctctgcccagtgctggaaggagcatgcctgggttagtgggccaggggccaggcagctgggggcctttggggaccagaaggggagatgtgctcccagagcctctctgctgtaagaccccagcttttcctggaagatgggactctggggtgtgtggtgctcaccagagtcaggccacccactgggctcggcaggagataggggagagcaattactttgttcactgtatgcacccgcgggggcctgggagtccccatttgcaggtgggtagggcctccagcccacaccacccagacctaggcttccctcttctcaggatccaccacagggttaggggacaggaagcctgttctattctcaataaatcttacaaaattcc

SEQ ID NO: 4351 - DNA, 597 bp, Homo sapiens
agtcccagctggatctccggccagagcccgaggctgctgcgccgggcggctgcagcctccgctccagcgcccgcgccgtgccctgcatcccgggagcccggctggacccgcggcggctcggccggttgtctctccggtggggagtgagcgagcacacagcccccaccccaccccgggtgagagagaatgtcctgcacagggacgcccagctgtatctacctgctgtcagcactttctctgcaggacctggtgctggactgggagccccgaggtgttccccctcccctccctggggcagcagccaccatgttctcgtgtgtgaagccctatgaggaccagaactactcagccctgaggcgggactgccggcgcaggaaggtgctcttcgaggaccccctcttccccgccactgacgactcactctactataagggcacgccggggcccgccgtcaggtggaagcgacccaagggcatctgcgaggacccccgcctctttgtggatggcatcagctcccacgacctgcaccagggccaggtgggcaactgctggtttgtggcagcctgctcgtcacttgcctcccgggagtcgctgtgg

SEQ ID NO: 4352 - DNA, 2333 bp, Homo sapiens
agctggatctccggccagagcccgaggctgctgcgccgggcggctgcagcctccgctccagcgcccgcgccgtgccctgcatcccgggagcccggctggacccgcggcggctcggccgatgagaattctgaagcacaaagaggttaactgctttgcacctcgctggcctcagtctccccatctgaggacgggtgttccccctcccctccctggggcagcagccaccatgttctcgtgtgtgaagccctatgaggaccagaactactcagccctgaggcgggactgccggcgcaggaaggtgctcttcgaggaccccctcttccccgccactgacgactcactctactataagggcacgccggggcccgccgtcaggtggaagcgacccaagggcatctgcgaggacccccgcctctttgtggatggcatcagctcccacgacctgcaccagggccaggtgggcaactgctggtttgtggcagcctgctcgtcacttgcctcccgggagtcgctgtggcaaaaggtcatcccagactggaaggagcaggaatgggaccccgaaaagcccaacgcctacgcgggcatcttccacttccacttctggcgcttcggggaatgggtggacgtggtcatcgatgaccggctgcccacagtcaacaaccagctcatctactgccactccaactcccgcaatgagttttggtgcgccctagtggagaaggcctatgccaaactggcaggctgttaccaggccctggatggaggcaacacagcagacgcactggtggacttcacgggtggtgtttctgagcccatcgacctgaccgagggtgactttgccaacgatgagactaagaggaaccagctctttgagcgcatgttaaaggtgcacagccggggcggcctcatcagtgcctccatcaaggcagtgacagcagctgacatggaggcccgcctggcgtgcggcctggtaaagggccacgcatacgccgtcactgatgtgcgcaaggtgcgcctgggccacggcctactggccttcttcaagtcagagaagttggacatgatccgcctgcgcaacccctggggcgagcgggagtggaacgggccctggagtgacacctcggaggagtggcagaaagtgagcaagagtgagcgggagaagatgggtgtgaccgtgcaggacgacggtgagttctggatgaccttcgaggacgtgtgccggtacttcacggacatcatcaagtgccgcgtgatcaacacatcccacctgagcatccacaagacgtgggaggaggcccggctgcatggcgcctggacgctgcatgaggacccgcgacagaaccgcggtggcggctgcatcaaccacaaggacaccttcttccagaacccacagtacatcttcgaagtcaagaagccagaagatgaagtcctgatctgcatccagcagcggccaaagcggtctacgcgccgggagggcaagggtgagaacctggccattggctttgacatctacaaggtggaggagaaccgccagtaccgcatgcacagcctgcagcacaaggccgccagctccatctacatcaactcacgcagcgtcttcctgcgcaccgaccagcccgagggccgctatgtcatcatccccacaaccttcgagccaggccacactggcgagttcctgctccgagtcttcactgatgtgccctccaactgccgggagctgcgcctggatgagcccccacacacctgctggagctccctctgtggctacccccagctggtgacccaggtacatgtcctgggagctgctggcctcaaggactccccaacaggggctaactcttatgtgatcatcaagtgtgagggagacaaagtccgctcggctgtgcagaagggcacctccacaccagagtacaatgtgaaaggcatcttctaccgcaagaagctgagccagcccatcactgtacaggtctggaaccaccgagtgctgaaggatgaatttctgggccaggtgcacctaaaggctgacccggacaacctccaggccctgcataccctccacctccgggaccgaaatagccggcagcccagcaacctgccaggcactgtggccgtgcacattctcagcagcacctccctcatggctgtctgacacctgcccacctacctggctctgaccgttcccaccaccatctgcatgtccccactgggcctgagtctagcctgggagccaggatactggggtccttttcccactcttccactgacttgctgtgtgaccttaggaagtctctgcccctctctcagcctcagtgtcccgagggccccgaagcatt

SEQ ID NO: 4353 - DNA, 2804 bp, Homo sapiens
agagcccgaggctgctgcgccgggcggctgcagcctccgctccagcgcccgcgccgtgccctgcatcccgggagcccggctggacccgcggcggctcggccggtgttccccctcccctccctggggcagcagccaccatgttctcgtgtgtgaagccctatgaggaccagaactactcagccctgaggcgggactgccggcgcaggaaggtgctcttcgaggaccccctcttccccgccactgacgactcactctactataagggcacgccggggcccgccgtcaggtggaagcgacccaagtacagtggccattcgctggcccctcacaggcctggctggggagatgcacggagaatggagaatgtccccaggcctgggagctcagggtgtccgtcctcctcgctcagggcccgggacctgggcatctgcgaggacccccgcctctttgtggatggcatcagctcccacgacctgcaccagggccaggtgggcaactgctggtttgtggcagcctgctcgtcacttgcctcccgggagtcgctgtggcaaaaggtcatcccagactggaaggagcaggaatgggaccccgaaaagcccaacgcctacgcgggcatcttccacttccacttctggcgcttcggggaatgggtggacgtggtcatcgatgaccggctgcccacagtcaacaaccagctcatctactgccactccaactcccgcaatgagttttggtgcgccctagtggagaaggcctatgccaaactggcaggctgttaccaggccctggatggaggcaacacagcagacgcactggtggacttcacgggtggtgtttctgagcccatcgacctgaccgagggtgactttgccaacgatgagactaagaggaaccagctctttgagcgcatgttaaaggtgcacagccggggcggcctcatcagtgcctccatcaaggcagtgacagcagctgacatggaggcccgcctggcgtgcggcctggtaaagggccacgcatacgccgtcactgatgtgcgcaaggtgcgcctgggccacggcctactggccttcttcaagtcagagaagttggacatgatccgcctgcgcaacccctggggcgagcgggagtggaacgggccctggagtgacacctcggaggagtggcagaaagtgagcaagagtgagcgggagaagatgggtgtgaccgtgcaggacgacggtgagttctggatgaccttcgaggacgtgtgccggtacttcacggacatcatcaagtgccgcgtgatcaacacatcccacctgagcatccacaagacgtgggaggaggcccggctgcatggcgcctggacgctgcatgaggacccgcgacagaaccgcggtggcggctgcatcaaccacaaggacaccttcttccagaacccacagtacatcttcgaagtcaagaagccagaagatgaagtcctgatctgcatccagcagcggccaaagcggtctacgcgccgggagggcaagggtgagaacctggccattggctttgacatctacaaggtggaggagaaccgccagtaccgcatgcacagcctgcagcacaaggccgccagctccatctacatcaactcacgcagcgtcttcctgcgcaccgaccagcccgagggccgctatgtcatcatccccacaaccttcgagccaggccacactggcgagttcctgctccgagtcttcactgatgtgccctccaactgccgggagctgcgcctggatgagcccccacacacctgctggagctccctctgtggctacccccagtggtgacccaggtacatgtcctgggagctgctggcctcaaggactccccaacaggggctaactcttatgtgatcatcaagtgtgagggagacaaagtccgctcggctgtgcagaagggcacctccacaccagagtacaatgtgaaaggcatcttctaccgcaagaagctgagccagcccatcactgtacaggtctggaaccaccgagtgctgaaggatgaatttctgggccaggtgcacctaaaggctgacccggacaacctccaggccctgcataccctccacctccgggaccgaaatagccggcagcccagcaacctgccaggcactgtggccgtgcacattctcagcagcacctccctcatggctgtctgacacctgcccacctacctggctctgaccgttcccaccaccatctgcatgtccccactgggcctgagtctagcctgggagccaggatactggggtccttttcccactcttccactgacttgctgtgtgaccttaggaagtctctgcccctctctcagcctcagtgtcccgagggccccgaagcattccattctcgtggaggagtttccttgctgagatttcaaatagtcctccccacctcaactgtcaccactgctaagggactctatccattgagcacattttcctaaggccctgctgtctgccgaggagcgccaagaagatgtcacttgtttacacacgaactgccacatccccaagctccgttcttgcccctcgtgtcctaggcccaacccagcctcccagacctcactttccccatcagcaatacctggtgttctcccaccttgaaaggactcttggctcctgccgggttcctgctcaggctggaattgggaaaatatgcaggtgacatttgttcattctctaatcccatcctctcacccatccatttcctcactcagtggagatttgccaaatgaataaacgacacctttgaggccccaggtgaagcggggccctactccgg

SEQ ID NO: 4354 - DNA, 4353 bp, Homo sapiens
ggcgagggccgctggggccgcgaagtggggcggccgggtgggctacaagccgggtctgggctgaggggcgcggcttcgcggtggaccccagcccggcaacgggaaggcgagctctcctccaccgtccaaagtaaactttgccgctccttccgcggcgctcccgagtcctcgccgccgccgggccgccgcagtccgcgaagagccgtcctgcgtcagggcctccttccctgccccggcgcggggccactgcgccatggacgccacagcactggagcgggacgctgtgcagttcgcccgtctggcggttcagcgcgaccacgaaggccgctactccgaggcggtgttttattacaaggaagctgcacaagccttaatttatgctgagatggcaggatcaagcctagaaaatattcaagaaaaaataactgagtatctggaaagagttcaagctctacattcagcagttcagtcaaagagtgctgatcctttgaagtcaaaacatcagttggacttagagcgtgctcatttccttgttacacaagcttttgatgaagatgaaaaagagaatgttgaagatgctatagaattgtacacagaagctgtggatctctgtctgaaaacatcttatgaaactgctgataaagtcctgcaaaataaactgaaacagttggctcgacaggcactagacagagcagaagcgctgagtgagcctttgaccaagccagttggcaaaatcagttcaacaagtgttaagccaaagccacctccagtgagagcacattttccactgggcgctaatcccttccttgaaagacctcagtcatttataagtcctcagtcatgtgatgcacaaggacagagatacacagcagaagaaatagaagtactcaggacaacatcaaaaataaatggtatagaatatgttcctttcatgaatgttgacctgagagaacgttttgcctatccaatgcctttctgtgatagatggggcaagctaccattatcacctaaacaaaaaactacattttccaagtgggtacgaccagaagacctcaccaacaatcctacaatgatatatactgtgtccagttttagcataaagcagacaatagtatcggattgctcctttgtggcatcactggccatcagtgcagcttatgaaagacgttttaataagaagttaattaccggcataatttaccctcaaaacaaggatggtgaaccagaatacaatccatgtgggaagtatatggtaaaacttcacctcaatggtgtcccaagaaaggtgataattgatgaccagttacctgttgatcacaagggagaattgctctgttcttattccaacaacaaaagtgaattatgggtttctctcatagaaaaagcatacatgaaagtcatgggaggatatgattttccaggatccaactccaatattgatcttcatgcactgactggctggataccagaaagaattgctatgcattcagatagccaaactttcagtaaggataattctttcagaatgctttatcaaagatttcacaaaggagatgtcctcatcactgcgtcaactggaatgatgacagaagctgaaggagagaagtggggtctggttcccacacacgcatatgctgttttggatattagagagttcaaggggctgcgatttatccagttgaaaaatccttggagtcatttacgttggaaaggaagatacagtgaaaatgatgtaaaaaactggactccagagttgcaaaagtatttaaactttgatccccgaacagctcagaaaatagacaacggaatattttggatttcctgggatgatctctgccagtattatgatgtgatttatttgagttggaatccaggtctttttaaagaatcaacatgtattcacagtacttgggatgctaagcaaggacctgtgaaagatgcctatagcctggccaacaacccccagtacaaactggaggtgcagtgtccacaggggggtgctgcagtttgggttttgcttagtagacacataacagacaaggatgattttgcgaataatcgagaatttatcacaatggttgtatacaagactgatgggaaaaaagtttattacccagctgacccacctccatacattgatggaattcgaattaacagccctcattatttgactaagataaagctgaccacacctggcacccatacctttacattagtggtttctcaatatgaaaaacagaacacaatccattacacggttcgggtatattcagcatgcagctttactttttcaaagattccttcaccatacaccttatcaaaacggattaatggaaagtggagtggtcagagtgctggaggatgtggaaatttccaagagactcacaaaaataaccccatctaccaattccatatagaaaagactgggccgttactgattgagctacgaggaccaaggcaatatagcgttggatttgaggttgtaacagtttctactctaggagatcctggtccccatggctttctgaggaaatctagtggtgactataggtgtgggttttgctacctggaattagaaaatataccttctgggatcttcaatatcattcctagtacctttttgcctaaacaagaaggaccttttttcttggactttaatagtattatccccatcaagatcacacaacttcagtgatggagaaatctcaagttactggcttttatacttaccaaacatcagttcttcaaataaggacgcaaatcttcaggacagtaagcagaacaatcagaatggaattaaatctctaaaaacgtgttacagtggaatctggtgcttgtcagggtgtttggtaagaactgtatatagtcagaattacctaaatcacctagaggtaccgtttacatggttttgtgtatatagagttggcttgcattttaggggccattttgtataaaaagtgcatatgattaaaattagactcagtcatcactgtgagatgcctttgctaagaggataaaggaactgagaccagatgagaaaaagaaaggatatagattccttgagtggaatagtgggctagattaatataccgaaatatttccattgtttcccttttttgcagagcatgtggaagttaaacctgcttgattctactatacatcttgggcaactagttaccaaatgaattgtgccaccataactgattttaattttgcattatttatgattttaaaatatttgttgcccaggtgttatgaaagaataaagcttttaagtatagactaccttagcatgaagatgctcatgcctaagaatgaaaattgttgaggttatctcccattcaatcatgtagcaagaacttaaagaaattcactactgcagtttttatttttaaaaaacagtaattgagatattgaagacattacaatttagtttgtgtggtctttttttaaattgctgtatcgttcagtctcttgtggcaatagcactttgaagaaaatagagaatttaatatatggtgattgggatatgtagcattcaaaaaaagtgaattgccaagatactggtgtcatgtaaattcccactttacataaaaacccatcaggacagaatgatgctcaatattttaaaattctaaaaatagggtgggatttttcattgtctctactttataattatcaaaacttattttgtattgctactaccttaaattgaaataaaatgtttatacttacggatattgcatagtttaagttagatttattgaaagatttcatctgtcgtgtttcatgtaaatgagaacagattatttgcatgaaaatatatacttcaacaaaaatctgttctttaacagagtagtggtagattattacactaatgagatttcactttggtaaatacttcatgctttcagttttagcctattaattttaggtggacaaatttaacaagttttctgttactttttaaaaagaaaaaatccagaacataagaactatattatgaacacatgatttgaacctgttgtggtaaagatcttgtacaggatgcaaactaaaaacctaatccctgccatcaaatttattagaagagacctatatatgaacaacttaaaggcactgatttctataatagagctctaaaaacatgccaccagtgtatgaataagggaaagattaattttggctggaccaatataaaaaattgtatttgaagaattgatactttaacttggaccttgaaggtaaagcttcaaaagacaggttactgaccattgagtgtttactatgtacccaatgtgtatatttttctttttaatcttcccaatagctgaataaagtatagatactatt

SEQ ID NO: 4355 - DNA, 2362 bp, Homo sapiens
actcagcccagtggccctctgagctgttccttcttgaccggcacacacagctcgcttcttcactttcttttccatccactgccggacccaagccagccttccagggagcagccatgccttacctctaccgggccccagggcctcaggcacacccggttcccaaggacgcccggatcacccactcctcaggccagagctttgagcaaatgaggcaggagtgcctgcagagaggcaccctgtttgaggatgcagacttcccagccagcaattcctccctgttctacagtgagaggccgcagatcccctttgtgtggaaacgaccaggggaaatcgtgaaaaacccagaattcattcttggaggggccaccaggactgatatctgccagggagagctgggagactgctggctattagccgccatcgcctcccttacgcttaatcaaaaagcactggccagagtcatcccccaggaccaaagctttggccctggttatgccgggatattccatttccagttctggcagcacagtgagtggctggacgtggtgatcgatgaccgcctgcccaccttcagggaccgcttggttttcctccactctgccgaccacaacgagttctggagcgccttgctggaaaaagcctacgccaagctaaatgggagctatgaagctctgaagggaggcagcgccatcgaggccatggaagacttcactgggggtgtggcagagaccttccaaactaaagaggcccccgagaacttctatgagattctagagaaggctttgaagagaggctccctgctgggctgcttcattgataccagaagtgctgcagaatctgaggcccggacgccgtttggtcttattaagggtcatgcctacagtgtaacgggaattgaccaggtaagcttccgaggccagagaatcgagctcatccgaatccggaacccttggggccaggttgagtggaacgggtcgtggagcgacagttctccggagtggcgttctgttggtccagctgagcagaagcgtctgtgtcacactgctctggatgatggggaattctggatggcatttaaggacttcaaggcccactttgataaagtggagatctgcaacctcactcccgatgccctggaggaagacgcgatccacaaatgggaggtgacggtccatcagggaagctgggttcgcggctccacggctgggggctgccgcaatttcctggataccttttggaccaatccacaaataaaattgtctctgactgagaaagatgaggggcaggaggagtgtagtttccttgtagccctgatgcagaaagatagaaggaaactcaagagatttggtgccaatgtgctgacaatcggctatgccatttatgagtgccctgacaaagacgaacacctgaacaaagacttcttcagataccacgcttctcgggccagaagcaagacgttcatcaacctgagagaagtctccgaccggttcaagctgccccctggggagtacatcctgattcccagcacttttgagccccaccaggaagctgatttctgtctgagaatcttttcagagaaaaaagccattacccgggatatggatggaaatgtagacattgaccttcctgagcctccaaagccaactccacctgaccaggagacagaggaggagcagcggtttcgggctctgtttgaacaagtcgctggtgaggacatggaggtgacagcagaggaacttgagtatgttttaaatgctgtgctgcaaaagaaaaaggacatcaaattcaagaagctaagcctgatctcctgtaaaaacatcatttccctgatggacaccagcggcaatgggaagctggagtttgatgaattcaaagtgttctgggacaagctgaagcagtggattaaccttttccttcggtttgatgctgacaagtccggcaccatgtctacctatgaactacggactgcactgaaagctgcaggctttcagctgagcagccacctcctgcagctgattgtgctcaggtatgcggatgaggagctccagctggacttcgatgacttcctcaactgcctggtccggctggagaatgcgagccgggtgttccaggctctcagtacaaagaacaaggagttcattcatctcaatataaatgagttcatccatttgacaatgaacatctgaggctgccttgtagagatgcagcctgcccagctgaatcttggcttctggaccttgaccttcagaacttctcttggtgtggaaccattacgcccagggttcactcccctctcatcgtccggccttctcccttcatcttgatctgggaagaatgaaatgaactcagctacactctctga

SEQ ID NO: 4356 - DNA, 2484 bp, Homo sapiens
tcttgaccggcacacacagctcgcttcttcactttcttttccatccactgccggacccaagccagccttccagggagcagccatgccttacctctaccgggccccagggcctcaggcacacccggttcccaaggacgcccggatcacccactcctcaggccagagctttgagcaaatgaggcaggagtgcctgcagagaggcaccctgtttgaggatgcagacttcccagccagcaattcctccctgttctacagtgagaggccgcagatcccctttgtgtggaaacgaccaggggaaatcgtgaaaaacccagaattcattcttggaggggccaccaggactgatatctgccagggagagctgggagactgctggctattagccgccatcgcctcccttacgcttaatcaaaaagcactggccagagtcatcccccaggaccaaagctttggccctggttatgccgggatattccatttccagttctggcagcacagtgagtggctggacgtggtgatcgatgaccgcctgcccaccttcagggaccgcttggttttcctccactctgccgaccacaacgagttctggagcgccttgctggaaaaagcctacgccaagctaaatgggagctatgaagctctgaagggaggcagcgccatcgaggccatggaagacttcactgggggtgtggcagagaccttccaaactaaagaggcccccgagaacttctatgagattctagagaaggctttgaagagaggctccctgctgggctgcttcattgataccagaagtgctgcagaatctgaggcccggacgccgtttggtcttattaagggtcatgcctacagtgtaacgggaattgaccaggtaagcttccgaggccagagaatcgagctcatccgaatccggaacccttggggccaggttgagtggaacgggtcgtggagcgacaggatggcatttaaggacttcaaggcccactttgataaagtggagatctgcaacctcactcccgatgccctggaggaagacgcgatccacaaatgggaggtgacggtccatcagggaagctgggttcgcggctccacggctgggggctgccgcaatttcctggataccttttggaccaatccacaaataaaattgtctctgactgagaaagatgaggggcaggaggagtgtagtttccttgtagccctgatgcagaaagatagaaggaaactcaagagatttggtgccaatgtgctgacaatcggctatgccatttatgagtgccctgacaaagacgaacacctgaacaaagacttcttcagataccacgcttctcgggccagaagcaagacgttcatcaacctgagagaagtctccgaccggttcaagctgccccctggggagtacatcctgattcccagcacttttgagccccaccaggaagctgatttctgtctgagaatcttttcagagaaaaaagccattacccgggatatggatggaaatgtagacattgaccttcctgagcctccaaagccaactccacctgaccaggagacagaggaggagcagcggtttcgggctctgtttgaacaagtcgctggtgaggacatggaggtgacagcagaggaacttgagtatgttttaaatgctgtgctgcaaaagaaaaaggacatcaaattcaagaagctaagcctgatctcctgtaaaaacatcatttccctgatggacaccagcggcaatgggaagctggagtttgatgaattcaaagtgttctgggacaagctgaagcagtggattaaccttttccttcggtttgatgctgacaagtccggcaccatgtctacctatgaactacggactgcactgaaagctgcaggctttcagctgagcagccacctcctgcagctgattgtgctcaggtatgcggatgaggagctccagctggacttcgatgacttcctcaactgcctggtccggctggagaatgcgagccgggtgttccaggctctcagtacaaagaacaaggagttcattcatctcaatataaatgagttcatccatttgacaatgaacatctgaggctgccttgtagagatgcagcctgcccagctgaatcttggcttctggaccttgaccttcagaacttctcttggtgtggaaccattacgcccagggttcactcccctctcatcgtccggccttctcccttcatcttgatctgggaagaatgaaatgaactcagctacactctctgattttgtgctactcctttgtaaagtcactgccttaagggggctgatggcgccacctgtgccttacatccaggttcaggcatcactagctttcccacactctactttccttatttccttccattaagaattactcagagttctaacgcacagaatcctgacttccatgtagctccagtcattgtgatcagacatcctttataaaacatgtttttataaatgtgtatgtggaat

SEQ ID NO: 4357 - DNA, 2123 bp, Homo sapiens
gctcgcttcttcactttcttttccatccactgccggacccaagccagccttccagggagcagccatgccttacctctaccgggccccagggcctcaggcacacccggttcccaaggacgcccggatcacccactcctcaggccagagctttgagcaaatgaggcaggagtgcctgcagagaggcaccctgtttgaggatgcagacttcccagccagcaattcctccctgttctacagtgagaggccgcagatcccctttgtgtggaaacgaccagggttctggcagcacagtgagtggctggacgtggtgatcgatgaccgcctgcccaccttcagggaccgcttggttttcctccactctgccgaccacaacgagttctggagcgccttgctggaaaaagcctacgccaagctaaatgggagctatgaagctctgaagggaggcagcgccatcgaggccatggaagacttcactgggggtgtggcagagaccttccaaactaaagaggcccccgagaacttctatgagattctagagaaggctttgaagagaggctccctgctgggctgcttcattgataccagaagtgctgcagaatctgaggcccggacgccgtttggtcttattaagggtcatgcctacagtgtaacgggaattgaccaggtaagcttccgaggccagagaatcgagctcatccgaatccggaacccttggggccaggttgagtggaacgggtcgtggagcgacagttctccggagtggcgttctgttggtccagctgagcagaagcgtctgtgtcacactgctctggatgatggggaattctggatggcatttaaggacttcaaggcccactttgataaagtggagatctgcaacctcactcccgatgccctggaggaagacgcgatccacaaatgggaggtgacggtccatcagggaagctgggttcgcggctccacggctgggggctgccgcaatttcctggataccttttggaccaatccacaaataaaattgtctctgactgagaaagatgaggggcaggaggagtgtagtttccttgtagccctgatgcagaaagatagaaggaaactcaagagatttggtgccaatgtgctgacaatcggctatgccatttatgagtgccctgacaaagacgaacacctgaacaaagacttcttcagataccacgcttctcgggccagaagcaagacgttcatcaacctgagagaagtctccgaccggttcaagctgccccctggggagtacatcctgattcccagcacttttgagccccaccaggaagctgatttctgtctgagaatcttttcagagaaaaaagccattacccgggatatggatggaaatgtagacattgaccttcctgagcctccaaagccaactccacctgaccaggagacagaggaggagcagcggtttcgggctctgtttgaacaagtcgctggtgaggacatggaggtgacagcagaggaacttgagtatgttttaaatgctgtgctgcaaaagaaaaaggacatcaaattcaagaagctaagcctgatctcctgtaaaaacatcatttccctgatggacaccagcggcaatgggaagctggagtttgatgaattcaaagtgttctgggacaagctgaagcagtggattaaccttttccttcggtttgatgctgacaagtccggcaccatgtctacctatgaactacggactgcactgaaagctgcaggctttcagctgagcagccacctcctgcagctgattgtgctcaggtatgcggatgaggagctccagctggacttcgatgacttcctcaactgcctggtccggctggagaatgcgagccgggtgttccaggctctcagtacaaagaacaaggagttcattcatctcaatataaatgagttcatccatttgacaatgaacatctgaggctgccttgtagagatgcagcctgcccagctgaatcttggcttctggaccttgaccttcagaacttctcttggtgtggaaccattacgcccagggttcactcccctctcatcgtccggccttctcccttcatcttgatctgggaagaatgaaatgaactcagctacactctctg

SEQ ID NO: 4358 - DNA, 1477 bp, Homo sapiens
cgggcgacagcagggccgcggtgcagtgtccgacccgagagttgcggcctgagtcaccggccccgccctccggagccggacgctgcgggaggcccgggagcggcagtggaaccgactcccagaactccggacgtgtgcggcgcagtgagtcgcagccatgttcctggttaactcgttcttgaagggcggcggcggcggcggcgggggaggcgggggcctgggtgggggcctgggaaatgtgcttggaggcctgatcagcggggccgggggcggcggcggcggcggcggcggcggcggcggtggtggaggcggcggtggcggtggaacggccatgcgcatcctaggcggagtcatcagcgccatcagcgaggcggctgcgcagtacaacccggagcccccgcccccacgcacacattactccaacattgaggccaacgagagtgaggaggtccggcagttccggagactctttgcccagctggctggagatgacatggaggtcagcgccacagaactcatgaacattctcaataaggttgtgacacgacaccctgatctgaagactgatggttttggcattgacacatgtcgcagcatggtggccgtgatggatagcgacaccacaggcaagctgggctttgaggaattcaagtacttgtggaacaacatcaaaaggtggcaggccatatacaaacagttcgacactgaccgatcagggaccatttgcagtagtgaactcccaggtgcctttgaggcagcagggttccacctgaatgagcatctctataacatgatcatccgacgctactcagatgaaagtgggaacatggattttgacaacttcatcagctgcttggtcaggctggacgccatgttccgtgccttcaaatctcttgacaaagatggcactggacaaatccaggtgaacatccaggagtggctgcagctgactatgtattcctgaactggagccccagacccgccccctcactgccttgctataggagtcacctggagcctcggtctctcccagggccgatcctgtctgcagtcacatctttgtggggcctgctgacccacaagcttttgttctctcagtacttgttacccagcttctcaacatccagggcccaatttgccctgcctggagttccccctggctctaggacactctaacaagctctgtccacgggtctccccattcccaccaggccctgcacacacccactccgtaacctctcccctgtacctgtgccaagcctagcacttgtgatgcctccatgccccgagggccctctctcagttctgggaggatgactccagtccctgcacgccctggcacacccttcacggttgctacccaggcggccaagctccagaccgtgccagacccaggtgccccagtgcctttgtctatattctgctcccagcctgccaggcccaggaggaaataaacatgccccagttgctgatctct

SEQ ID NO: 4359 - DNA, 4282 bp, Homo sapiens
cactcagagagctgggctggagctccaagcggaaaccgcgggagccgagcccagctaggaatgcagacctcctgaaaaccaagccgaggactgcggggtccggtgtccacgcagagtgtcagcttcctctggtgcaaccagcaagtcttccagtatgaatcccacagaaaccaaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcgtctggctttatggaacttaagtttaccaaatataaaaagaaacttctgcttttaaaaaaattatatatatatattaaatttgaaacctgcatttctcccacagcaatgtaagaagtaggctctgatgtcctaccactttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggcttcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacattaaaa

SEQ ID NO: 4360 - DNA, 4524 bp, Homo sapiens
ggcccatcggggctaggggaaccccggcgcagacctggggtggggtcggaaaagctgtttcatcgcccgctcccgggccctccgctccctccctccctccctctctccctggcaggactccccgccaggcctccccgccactctccgcggcgcattccgggaggcagcggccgcagcggcctcgccatgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcgtctggctttatggaacttaagtttaccaaatataaaaagaaacttctgcttttaaaaaaattatatatatatattaaatttgaaacctgcatttctcccacagcaatgtaagaagtaggctctgatgtcctaccactttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggcttcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacattaaaa

SEQ ID NO: 4361 - DNA, 2972 bp, Homo sapiens
tctgggcatcgaaggaggaacgctgcaacctccaaccccttctttctgaccaaccgggaccagagcagtgctggggccggggcgggtcaccggcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggccattccagtcagccaacagatggaaggaccacatcttcctaacaagaaaaaacacaaaaaacaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcacc

SEQ ID NO: 4362 - DNA, 2487 bp, Homo sapiens
acattggtaaggtgttttcccccattgaaactaatattttctattttcaagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggccattccagtcagccaacagatggaaggaccacatcttcctaacaagaaaaaacacaaaaaacaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttc

SEQ ID NO: 4363 - DNA, 4572 bp, Homo sapiens
ggcccatcggggctaggggaaccccggcgcagacctggggtggggtcggaaaagctgtttcatcgcccgctcccgggccctccgctccctccctccctccctctctccctggcaggactccccgccaggcctccccgccactctccgcggcgcattccgggaggcagcggccgcagcggcctcgccatgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggccattccagtcagccaacagatggaaggaccacatcttcctaacaagaaaaaacacaaaaaacaggctgtaaaaacagaacctgagaagaagtcacagtcaaccaagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcgtctggctttatggaacttaagtttaccaaatataaaaagaaacttctgcttttaaaaaaattatatatatatattaaatttgaaacctgcatttctcccacagcaatgtaagaagtaggctctgatgtcctaccactttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggcttcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacattaaaa

SEQ ID NO: 4364 - DNA, 4629 bp, Homo sapiens
ggcccatcggggctaggggaaccccggcgcagacctggggtggggtcggaaaagctgtttcatcgcccgctcccgggccctccgctccctccctccctccctctctccctggcaggactccccgccaggcctccccgccactctccgcggcgcattccgggaggcagcggccgcagcggcctcgccatgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggccattccagtcagccaacagatggaaggaccacatcttcctaacaagaaaaaacacaaaaaacaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcgtctggctttatggaacttaagtttaccaaatataaaaagaaacttctgcttttaaaaaaattatatatatatattaaatttgaaacctgcatttctcccacagcaatgtaagaagtaggctctgatgtcctaccactttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggcttcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacattaaaa

SEQ ID NO: 4365 - DNA, 2425 bp, Homo sapiens
gtgtgagcccggcgcctccaacgcaacaccccgcgccctcgccggctcccccgccgtgcggatcggagccagccggttgttgccatggcattcgccagctggtggtacaagacgcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaa

SEQ ID NO: 4366 - DNA, 2539 bp, Homo sapiens
ctgggcatcgaaggaggaacgctgcaacctccaaccccttctttctgaccaaccgggaccagagcagtgctggggccggggcgggtcaccgggactccccgccaggcctccccgccactctccgcggcgcattccgggaggcagcggccgcagcggcctcgccatgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggccattccagtcagccaacagatggaaggaccacatcttcctaacaagaaaaaacacaaaaaacaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaa

SEQ ID NO: 4367 - DNA, 2079 bp, Homo sapiens
actcagagagctgggctggagctccaagcggaaaccgcgggagccgagcccagctaggaatgcagacctcctgaaaaccaagccgaggactgcggggtccggtgtccacgcagagtgtcagcttcctctggtgcaaccagcaagtcttccagtatgaatcccacagaaaccaaggccattccagtcagccaacagatggaaggaccacatcttcctaacaagaaaaaacacaaaaaacaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaag

SEQ ID NO: 4368 - DNA, 2466 bp, Homo sapiens
agagagctgggctggagctccaagcggaaaccgcgggagccgagcccagctaggaatgcagacctcctgaaaaccaagccgaggactgcggggtccggtgtccacgcagagtgtcagcttcctctggtgcaaccagcaagtcttccagtatgaatcccacagaaaccaaggtatgaagaatgctaattgagccattccagtcagccaacagatggaaggaccacatcttcctaacaagaaaaaacacaaaaaacaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattctttt

SEQ ID NO: 4369 - DNA, 4506 bp, Homo sapiens
ggcccatcggggctaggggaaccccggcgcagacctggggtggggtcggaaaagctgtttcatcgcccgctcccgggccctccgctccctccctccctccctctctccctggcaggactccccgccaggcctccccgccactctccgcggcgcattccgggaggcagcggccgcagcggcctcgccatgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggctgtaaaaacagaacctgagaagaagtcacagtcaaccaagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcgtctggctttatggaacttaagtttaccaaatataaaaagaaacttctgcttttaaaaaaattatatatatatattaaatttgaaacctgcatttctcccacagcaatgtaagaagtaggctctgatgtcctaccactttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggcttcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacattaaaa

SEQ ID NO: 4370 - DNA, 1911 bp, Homo sapiens
gcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 4371 - DNA, 1763 bp, Homo sapiens
gtccgtactgcagagccgctgccggagggtcgttttaaagggcccgcgcgttgccgccccctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactggg

SEQ ID NO: 4372 - DNA, 1285 bp, Homo sapiens
agagccgcagagagagctgggagctaaggggtggcggcgaccggaagcgcagtgcacacccccatggcccgggctttggtccagctctgggccatatgcatgctgcgagtggcgctggctaccgtctatttccaagaggaatttctagacggagagcattggagaaaccgatggttgcagtccaccaatgactcccgatttgggcattttagactttcgtcgggcaagttttatggtcataaagagaaagataaaggtctgcaaaccactcagaatggccgattctatgccatctctgcacgcttcaaaccgttcagcaataaagggaaaactctggttattcagtacacagtaaaacatgagcagaagatggactgtggagggggctacattaaggtctttcctgcagacattgaccagaagaacctgaatggaaaatcgcagtactatattatgtttggacccgatatttgtggatttgatatcaagaaagttcatgttattttacatttcaagaataagtatcacgaaaacaagaaactgatcaggtgtaaggttgatggcttcacacacctgtacactctaattttaagaccagatctttcttatgatgtgaaaattgatggtcagtcaattgaatccggcagcatagagtacgactggaacttaacatcactcaagaaggaaacgtccccggcagaatcgaaggattgggaacagactaaagacaacaaagcccaggactgggagaagcattttctggacgccagcaccagcaagcagagcgactggaacggtgacctggatggggactggccagcgccgatgctccagaagcccccgtaccaggatggcctgaaaccagaaggtattcataaagacgtctggctccaccgtaagatgaagaataccgactatttgacgcagtatgacctctcagaatttgagaacattggtgccattggcctggagctttggcaggtgagatctggaaccatttttgataactttctgatcacagatgatgaagagtacgcagataattttggcaaggccacctggggcgaaaccaagggtccagaaagggagatggatgccatacaggccaaggaggaaatgaagaaggcccgcgaggaagaggaggaagagctgctgtcgggaaaaattaacaggcacgaacattacttcaatcaatttcacagaaggaatgaactttagtgatccccattggatataaggatgactggtaaaatctcattgctactttaatctatgtttcaaactc

SEQ ID NO: 4373 - DNA, 1897 bp, Homo sapiens
acctgaccctttttcccttggctctgtcggcagtttctccaggacccagcagtgccctctgtccactgctctgggccattccccaatcccccctcccacttgagcccctaactcagaatctgggacccaggggcccctccctaccccagctaacctcttctggaccaggagagccaacccagatcccactacctccatgagtgctacagacaggatggggcccagagctgtgccgggtctgcggctggcactgctgttgctgctggtgctagggacacccaagtcaggggtacaggggcaggaagggctggacttccctgagtacgatggtgtggaccgtgtgatcaatgtcaatgcaaagaactacaagaatgtgttcaagaagtatgaggtgctggcactcctctaccatgaaccccccgaggatgacaaggcctcacaaagacaatttgagatggaggagctgatcctggagttagcagcccaagtcctagaagacaagggtgttggcttcgggctggtagactctgagaaggatgcagctgtggccaagaaactaggcctaactgaagtggacagcatgtatgtattcaagggagatgaagtcattgagtacgatggcgagttttctgctgacaccatcgtggagtttctgcttgatgtcctagaggaccctgtggaattgattgaaggtgaacgagagctgcaggcgtttgagaatattgaggatgagatcaaactcattggctacttcaagagcaaagactcagagcattacaaagccttcgaggatgcagctgaggagtttcatccctacatccccttcttcgccaccttcgacagcaaggtggcaaagaagctgaccctgaagctgaatgagattgatttctacgaggccttcatggaagagcctgtgaccatcccagacaagcccaatagcgaagaggagattgtcaacttcgtggaggagcacaggagatcaaccctgaggaaactgaagccggagagtatgtatgagacctgggaggatgatatggatggaatccacattgtggccttcgcagaggaagctgatcctgatggtttcgagttcttagagactctcaaggctgtggcccaagataacactgaaaacccagatcttagcatcatctggattgaccctgatgacttccccctgctggtcccatactgggagaagacgtttgacatcgacttgtcagccccacaaataggagtcgtcaatgttactgatgcggatagcgtatggatggaaatggacgatgaggaggacctgccttctgctgaggagctggaggactggctggaggatgtcctggagggcgagatcaacacagaggacgatgacgatgatgatgatgactagttgctatggcaaccatctttcagccccactggtcttttcatgctctctcctgccttcccttgtccttccctgagttcctccagggagactaggttattctctgccatagagctaactggggtctatatgctgggtgctgagacactgatccccctcatttgatgagcaaatgagctacttttccctagacaccaggccagctctctcttatctgacttctgtttcttatcccataacttacttgtatctattatgtgtctcttccatcactctccatactctttcttgtgattctcctctagccatatatatgggccccatctctgttctgttccctccatctatgcacagctttcccccactctctctaatcctgtatctttctgactgtcctgtccttggccagaaggaagggagaatactgtgtttgggactgtatctcagcaatcacttgttaatgtatttgggtcaaatgagaggcctcaataaagacatctggggcagcatgaa

SEQ ID NO: 4374 - DNA, 1956 bp, Homo sapiens
aggggtgccaatttcagggggcagctccggttccctccccgccccctgctcctattcctccacctgaccctttttcccttggctctgtcggcagtttctccaggacccagcagtgccctctgtccactgctctgggccattccccaatcccccctcccacttgagcccctaactcagaatctgggacccaggggcccctccctaccccagctaacctcttctggaccaggagagccaacccagatcccactacctccatgagtgctacagacaggatggggcccagagctgtgccgggtctgcggctggcactgctgttgctgctggtgctagggacacccaagtcaggggtacaggggcaggaagggctggacttccctgagtacgatggtgtggaccgtgtgatcaatgtcaatgcaaagaactacaagaatgtgttcaagaagtatgaggtgctggcactcctctaccatgaaccccccgaggatgacaaggcctcacaaagacaatttgagatggaggagctgatcctggagttagcagcccaagtcctagaagacaagggtgttggcttcgggctggtagactctgagaaggatgcagctgtggccaagaaactaggcctaactgaagtggacagcatgtatgtattcaagggagatgaagtcattgagtacgatggcgagttttctgctgacaccatcgtggagtttctgcttgatgtcctagaggaccctgtggaattgattgaaggtgaacgagagctgcaggcgtttgagaatattgaggatgagatcaaactcattggctacttcaagagcaaagactcagagcattacaaagccttcgaggatgcagctgaggagtttcatccctacatccccttcttcgccaccttcgacagcaaggtggcaaagaagctgaccctgaagctgaatgagattgatttctacgaggccttcatggaagagcctgtgaccatcccagacaagcccaatagcgaagaggagattgtcaacttcgtggaggagcacaggagatcaaccctgaggaaactgaagccggagagtatgtatgagacctgggaggatgatatggatggaatccacattgtggccttcgcagaggaagctgatcctgatggtttcgagttcttagagactctcaaggctgtggcccaagataacactgaaaacccagatcttagcatcatctggattgaccctgatgacttccccctgctggtcccatactgggagaagacgtttgacatcgacttgtcagccccacaaataggagtcgtcaatgttactgatgcggatagcgtatggatggaaatggacgatgaggaggacctgccttctgctgaggagctggaggactggctggaggatgtcctggagggcgagatcaacacagaggacgatgacgatgatgatgatgactagttgctatggcaaccatctttcagccccactggtcttttcatgctctctcctgccttcccttgtccttccctgagttcctccagggagactaggttattctctgccatagagctaactggggtctatatgctgggtgctgagacactgatccccctcatttgatgagcaaatgagctacttttccctagacaccaggccagctctctcttatctgacttctgtttcttatcccataacttacttgtatctattatgtgtctcttccatcactctccatactctttcttgtgattctcctctagccatatatatgggccccatctctgttctgttccctccatctatgcacagctttcccccactctctctaatcctgtatctttctgactgtcctgtccttggccagaaggaagggagaatactgtgtttgggactgtatctcagcaatcacttgttaatgtatttgggtcaaatgagaggcctcaataaagacatctggggcagcatg

SEQ ID NO: 4375 - DNA, 1444 bp, Homo sapiens
atgtcaatgcaaagaactacaagaatgtgttcaagaagtatgaggtgctggcactcctctaccatgaaccccccgaggatgacaaggcctcacaaagacaattccctaggcctaactgaagtggacagcatgtatgtattcaagggagatgaagtcattgagtacgatggcgagttttctgctgacaccatcgtggagtttctgcttgatgtcctagaggaccctgtggaattgattgaaggtgaacgagagctgcaggcgtttgagaatattgaggatgagatcaaactcattggctacttcaagagcaaagactcagagcattacaaagccttcgaggatgcagctgaggagtttcatccctacatccccttcttcgccaccttcgacagcaaggtggcaaagaagctgaccctgaagctgaatgagattgatttctacgaggccttcatggaagagcctgtgaccatcccagacaagcccaatagcgaagaggagattgtcaacttcgtggaggagcacaggagatcaaccctgaggaaactgaagccggagagtatgtatgagacctgggaggatgatatggatggaatccacattgtggccttcgcagaggaagctgatcctgatggtttcgagttcttagagactctcaaggctgtggcccaagataacactgaaaacccagatcttagcatcatctggattgaccctgatgacttccccctgctggtcccatactgggagaagacgtttgacatcgacttgtcagccccacaaataggagtcgtcaatgttactgatgcggatagcgtatggatggaaatggacgatgaggaggacctgccttctgctgaggagctggaggactggctggaggatgtcctggagggcgagatcaacacagaggacgatgacgatgatgatgatgactagttgctatggcaaccatctttcagccccactggtcttttcatgctctctcctgccttcccttgtccttccctgagttcctccagggagactaggttattctctgccatagagctaactggggtctatatgctgggtgctgagacactgatccccctcatttgatgagcaaatgagctacttttccctagacaccaggccagctctctcttatctgacttctgtttcttatcccataacttacttgtatctattatgtgtctcttccatcactctccatactctttcttgtgattctcctctagccatatatatgggccccatctctgttctgttccctccatctatgcacagctttcccccactctctctaatcctgtatctttctgactgtcctgtccttggccagaaggaagggagaatactgtgtttgggactgtatctcagcaatcacttgttaatgtatttgggtcaaatgagaggcctcaataaagacatctggggcagcatg

SEQ ID NO: 4376 - DNA, 2674 bp, Homo sapiens
tgcgtgcgtgcgtgcgtgcgtgtgtgtgtgtgtgtgcctctgctctttgtcctgagcccacgattccagagctggctggacccaaggaggtgaagagtcacttttcagccccaggaagggcaaagaagagagaaaatcagcctgtctgctctctccttggctcaacaaggcctctaacagtcttctgtcctctattctgcacacagcatatttgggaacgagaaacaaaagttttcccaaatgaagagaactcacttgtttattgtggggatttattttctgtcctcttgcagggcagaagaggggcttaatttccccacatatgatgggaaggaccgagtggtaagtctttccgagaagaacttcaagcaggttttaaagaaatatgacttgctttgcctctactaccatgagccggtgtcttcagataaggtcacgcaaaaacagttccaactgaaagaaatcgtgcttgagcttgtggcccaggtccttgaacataaagctataggctttgtgatggtggatgccaagaaagaagccaagcttgccaagaaactgggttttgatgaagaaggaagcctgtatattcttaagggtgatcgcacaatagagtttgatggcgagtttgcagctgatgtcttggtggagttcctcttggatctaattgaagacccagtggagatcatcagcagcaaactggaagtccaagccttcgaacgcattgaagactacatcaaactcattggctttttcaagagtgaggactcagaatactacaaggcttttgaagaagcagctgaacacttccagccttacatcaaattctttgccacctttgacaaaggggttgcaaagaaattatctttgaagatgaatgaggttgacttctatgagccatttatggatgagcccattgccatccccaacaaaccttacacagaagaggagctggtggagtttgtgaaggaacaccaaagacccactctacgtcgcctgcgcccagaagaaatgtttgaaacatgggaagatgatttgaatgggatccacattgtggcctttgcagagaagagtgatccagatggctacgaattcctggagatcctgaaacaggttgcccgggacaatactgacaaccccgatctgagcatcctgtggatcgacccggacgactttcctctgctcgttgcctactgggagaagactttcaagattgacctattcaggccacagattggggtggtgaatgtcacagatgctgacagtgtctggatggagattccagatgatgacgatcttccaactgctgaggagctggaggactggattgaggatgtgctttctggaaagataaacactgaagatgatgatgaagatgatgatgatgatgataattctgatgaagaggataatgatgacagtgatgacgatgatgatgaatagcccaactccaaacaattctgatgaaaacaaaatcacagcacccactaccatacagacagcacaaggtggcagcaagcaattctgccccacacccagccagctcctttcccttttccatcatctcttttcccactccctttgcgtcaggagcagcatcattcagcaaatgccttttcaaatgcagcaatcccacttagcagggacaggagaaaaattattcccatgttgactgtcttgactgtcacggaacagatcttgttctttgctggaccatcaagggtcatggcagtgcctgaacatggcagtctagggtgaacaatcccctaacacaagtttacttgtctttgattatgacagtaacaaaattgacagctttctaactcacaggcatagagtgaccttttaatcagagcccagggaagacacatgattaatgatttagctccctccatacctcgaacatcagttgggatccctcctccagccaagatgatccttcttagagaaggctcagccttggaagcaaacttataaatcatattctcatggctttgttaaacttatttcaagtgatggtcattcatatcactatgaacttggatattcaagcctttggatggctatggagagggcttgaaatgtgtacaggtgtcaccatcatttctagtatattaggaaactgggatgggaggttgatttgctctctaaacttccctctagttggcaagtctcacatattcatcagcaggagtggagggtgggggaaaactagaaagatgaaaacttttacatttttctgatgggttcatgtctctgattgggtcagctggcttcctagcctaagctgggatctgaataccccttctctgtagctgctagtgagccttcccatttagattaaagattgctttatccagcagtcaattaactctccagttatcagtactcccacaattggccagggcaacaataattggagttcatactgatgccctgaggcactgaaaaaaaaaaaaatcccaaagtgccttctgagctgtctaaaagttacattgtgcttggtagatttagtgttaagtgtgcagtataattttctaatttattttctcaatcttttagcacatgtgtaagacactgtgcaaattttttgaaaatagagcaatactttttgtggaatactagctaactaattctgtcattaaactcatattttgaaaatattcagacaatgttg

SEQ ID NO: 4377 - DNA, 1459 bp, Homo sapiens
agcctccctagcttggctgtttttctactctcatgcgtgcgtgcgtgcgtgcgtgtgtgtgtgtgtgtgcctctgctctttgtcctgagcccacgattccagagctggctggacccaaggaggtgaagagtcacttttcagccccaggaagggcaaagaagagagaaaatcagcctgtctgctctctccttggctcaacaaggcctctaacagtcttctgtcctctattctgcacacagcatatttgggaacgagaaacaaaagttttcccaaatgaagagaactcacttgtttattgtggggatttattttctgtcctcttgcagggcagaagaggggcttaatttccccacatatgatgggaaggaccgagtggtaagtctttccgagaagaacttcaagcaggttttaaagaaatatgacttgctttgcctctactaccatgagccggtgtcttcagataaggtcacgcaaaaacagttccaactgaaagaaatcgtgcttgagcttgtggcccaggtccttgaacataaagctataggctttgtgatggtggatgccaagaaagaagccaagcttgccaagaaactgggttttgatgaagaaggaagcctgtatattcttaagggtgatcgcacaatagagtttgatggcgagtttgcagctgatgtcttggtggagttcctcttggatctaattgaagacccagtggagatcatcagcagcaaactggaagtccaagccttcgaacgcattgaagactacatcaaactcattggctttttcaagagtgaggactcagaatactacaaggcttttgaagaagcagctgaacacttccagccttacatcaaattctttgccacctttgacaaaggggttgcaaagaaattatctttgaagatgaatgaggttgacttctatgagccatttatggatgagcccattgccatccccaacaaaccttacacagatggctacgaattcctggagatcctgaaacaggttgcccgggacaatactgacaaccccgatctgagcatcctgtggatcgacccggacgactttcctctgctcgttgcctactgggagaagactttcaagattgacctattcaggccacagattggggtggtgaatgtcacagatgctgacagtgtctggatggagattccagatgatgacgatcttccaactgctgaggagctggaggactggattgaggatgtgctttctggaaagataaacactgaagatgatgatgaagatgatgatgatgatgataattctgatgaagaggataatgatgacagtgatgacgatgatgatgaatagcccaactccaaacaattctgatgaaaacaaaatcacagcacccactaccatacagacagcacaaggtggcagcaagcaattctgccccacacccagccagctcctttcccttttccatcatctc

SEQ ID NO: 4378 - DNA, 1369 bp, Homo sapiens
agagctggctggacccaaggaggtgaagagtcacttttcagccccaggaagggcaaagaagagagaaaatcagcctgtctgctctctccttggctcaacaaggcctctaacagtcttctgtcctctattctgcacacagcatatttgggaacgagaaacaaaagttttcccaaatgaagagaactcacttgtttattgtggggatttattttctgtcctcttgcagggcagaagaggggcttaatttccccacatatgatgggaaggaccgagtggtaagtctttccgagaagaacttcaagcaggttttaaagaaatatgacttgctttgcctctactaccatgagccggtgtcttcagataaggtcacgcaaaaacagttccaactgaaagaaatcgtgcttgagcttgtggcccaggtccttgaacataaagctataggctttgtgatggtggatgccaagaaagaagccaagcttgccaagaaactggactacaaggcttttgaagaagcagctgaacacttccagccttacatcaaattctttgccacctttgacaaaggggttgcaaagaaattatctttgaagatgaatgaggttgacttctatgagccatttatggatgagcccattgccatccccaacaaaccttacacagaagaggagctggtggagtttgtgaaggaacaccaaagacccactctacgtcgcctgcgcccagaagaaatgtttgaaacatgggaagatgatttgaatgggatccacattgtggcctttgcagagaagagtgatccagatggctacgaattcctggagatcctgaaacaggttgcccgggacaatactgacaaccccgatctgagcatcctgtggatcgacccggacgactttcctctgctcgttgcctactgggagaagactttcaagattgacctattcaggccacagattggggtggtgaatgtcacagatgctgacagtgtctggatggagattccagatgatgacgatcttccaactgctgaggagctggaggactggattgaggatgtgctttctggaaagataaacactgaagatgatgatgaagatgatgatgatgatgataattctgatgaagaggataatgatgacagtgatgacgatgatgatgaatagcccaactccaaacaattctgatgaaaacaaaatcacagcacccactaccatacagacagcacaaggtggcagcaagcaattctgccccacacccagccagctcctttcccttttccatcatctcttttcccactccctttgcgtcaggagcagcatcattcagcaaatgccttttcaaatgcagcaatcccacttagcagggacaggag

SEQ ID NO: 4379 - DNA, 3357 bp, Homo sapiens
gcttccggttgggcggtgcttgcgcgcgtgagctgagccggtgggtgagcggcggccacggcatcctgtgctgtgggggctacgaggaaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttagatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctacggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttgtttgtttgtttaaatcaagcctgaggctggtgaacagtagctacacacccatattgtgtgttctgtgaatgctagctctcttgaatttggatattggttattttttatagagtgtaaaccaagttttatattctgcaatgcgaacaggtacctatctgtttctaaataaaactgtttacattca

SEQ ID NO: 4380 - DNA, 1955 bp, Homo sapiens
gcgcgcgtgagctgagccggtgggtgagcggcggccacggcatcctgtgctgtgggggctacgaggaaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaaagattgtaagtaaaatagatggcgacaaggacgggtttgtcactgtggatgagctcaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctacggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgcc

SEQ ID NO: 4381 - DNA, 2438 bp, Homo sapiens
gcgcgcgtgagctgagccggtgggtgagcggcggccacggcatcctgtgctgtgggggctacgaggaaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaatgattgtagataaaatagacgcggataaagatgggtttgtgacggagggggagctgaaatcctggattaagcacgcccagaagaaatacatatatgacaatgttgaaaaccaatggcaggagtttgatatgaatcaagacggcttaatctcctgggatgagtacagaaacgtgacttatggcacttacctggatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctacggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgcc

SEQ ID NO: 4382 - DNA, 2572 bp, Homo sapiens
atcctgtgctgtgggggctacgaggaaaggacctcccaccctcccccactgagctgccttcccagtgatgaaagaaaaaatgtaaaagcctgaaaacccttcttcttgatttttaatttttttttttccctctaagaccttaaccactctggatagtatcacggggtatcagtagagtgtgctaaacagatgtgtactctgcagcttctttgcaggttttttgtcacatttttcagtcaagtgttccagctttgtgcttgttcattagagtcacctgtgactacagagattctgaaagtttgaatcagggcctgggaatctgtactttgaacagtactacaggtggtatttatgcctaggcaagtatgggaaacaactgtgcagaaggataaagacgttcttatctatgactagaccatctgaatgatttggcctttgaaggtgactcaaggttgagcctggatgttggagacttggtgctatagaccaaggaagctgccaagtatttcgctggttcctaatctcatgaacatcagaatcacctgaaaaacatttaaagctacgaatgtctgaattcagcttcagagactctaaatcaataggagaaacttaaagcttcctagatgattctaataaccagccatgtttgaagaccagaccaccaatgcgtacaagaagtaaaggatttggagtcaacatttaaaccttggttctttcacttttaattcttatgaacttgggcaaaaggattaaaattctactttggtatcttttgaaagaaaacagaaagtggacattttaactataagtttcttatcagcctacaatcagatgaaggaaactgatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttagatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctacggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctgg

SEQ ID NO: 4383 - DNA, 589 bp, Homo sapiens
cattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctacggaggaaccctcatttcctcaaaagccgtataactggagagacctgctgctcgttatataattatctgataccaaacacaagcgattctgaatgtacacacacgtttatctatagagcataaggtaaaacaattttgtttaa

SEQ ID NO: 4384 - DNA, 3209 bp, Homo sapiens
gattggtcgggaggccgccggcgaggcggatgagggcggggtgcggacccgcttccggttgggcggtgcttgcgcgcgtgagctgagccggtgggtgagcggcggccacggcatcctgtgctgtgggggctacgaggaaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttagatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggatggcaagcttaccaaggaggagatcgttgacaagtatgacttatttgttggcagccaggccacagattttggggaggccttagtacggcatgatgagttctgagctacggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttgtttgtttgtttaaatcaagcctgaggctggtgaacagtagctacacacccatattgtgtgttctgtgaatgctagctctcttgaatttggatattggttattttttatagagtgtaaaccaagttttatattctgcaatgcgaacaggtacctatctgtttctaaataaaactgtttacattcatt

SEQ ID NO: 4385 - DNA, 4418 bp, Homo sapiens
gattggtcgggaggccgccggcgaggcggatgagggcggggtgcggacccgcttccggttgggcggtgcttgcgcgcgtgagctgagccggtgggtgagcggcggccacggcatcctgtgctgtgggggctacgaggaaaggacctcccaccctcccccactgagctgccttcccagtgatgaaagaaaaaatgtaaaagcctgaaaacccttcttcttgatttttaatttttttttttccctctaagaccttaaccactctggatagtatcacggggtatcagtagagtgtgctaaacagatgtgtactctgcagcttctttgcaggttttttgtcacatttttcagtcaagtgttccagctttgtgcttgttcattagagtcacctgtgactacagagattctgaaagtttgaatcagggcctgggaatctgtactttgaacagtactacaggtggtatttatgcctaggcaagtatgggaaacaactgtgcagaaggataaagacgttcttatctatgactagaccatctgaatgatttggcctttgaaggtgactcaaggttgagcctggatgttggagacttggtgctatagaccaaggaagctgccaagtatttcgctggttcctaatctcatgaacatcagaatcacctgaaaaacatttaaagctacgaatgtctgaattcagcttcagagactctaaatcaataggagaaacttaaagcttcctagatgattctaataaccagccatgtttgaagaccagaccaccaatgcgtacaagaagtaaaggatttggagtcaacatttaaaccttggttctttcacttttaattcttatgaacttgggcaaaaggattaaaattctactttggtatcttttgaaagaaaacagaaagtggacattttaactataagtttcttatcagcctacaatcagatgaaggaaactgatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttagaatgattgtagataaaatagacgcggataaagatgggtttgtgacggagggggagctgaaatcctggattaagcacgcccagaagaaatacatatatgacaatgttgaaaaccaatggcaggagtttgatatgaatcaagacggcttaatctcctgggatgagtacagaaacgtgacttatggcacttacctggatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctacggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttgtttgtttgtttaaatcaagcctgaggctggtgaacagtagctacacacccatattgtgtgttctgtgaatgctagctctcttgaatttggatattggttattttttatagagtgtaaaccaagttttatattctgcaatgcgaacaggtacctatctgtttctaaataaaactgtttacattcatt

SEQ ID NO: 4386 - DNA, 3206 bp, Homo sapiens
gattggtcgggaggccgccggcgaggcggatgagggcggggtgcggacccgcttccggttgggcggtgcttgcgcgcgtgagctgagccggtgggtgagcggcggccacggcatcctgtgctgtgggggctacgaggaaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaatgattgtagataaaatagacgcggataaagatgggtttgtgacggagggggagctgaaatcctggattaagcacgcccagaagaaatacatatatgacaatgttgaaaaccaatggcaggagtttgatatgaatcaagacggcttaatctcctgggatgagtacagaaacgtgacttatggcacttacctggatgatccagatcctgatgatggatttaactataaacagatgatggttagagatgagcggaggtttaaaatggcagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctacggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttgtttgtttgtttaaatcaagcctgaggctggtgaacagtagctacacacccatattgtgtgttctgtgaatgctagctctcttgaatttggatattggttattttttatagagtgtaaaccaagttttatattctgcaatgcgaacaggtacctatctgtttctaaataaaactgtttacattcatt

SEQ ID NO: 4387 - DNA, 3067 bp, Homo sapiens
gattggtcgggaggccgccggcgaggcggatgagggcggggtgcggacccgcttccggttgggcggtgcttgcgcgcgtgagctgagccggtgggtgagcggcggccacggcatcctgtgctgtgggggctacgaggaaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaatgattgtagataaaatagacgcggataaagatgggtttgtgacggagggggagctgaaatcctggattaagcacgcccagaagaaatacatatatgacaatgttgaaaaccaatggcaggagtttgatatgaatcaagacggcttaatctcctgggatgagtacagaaacgtgacttatggcacttacctggatgatccagatcctgatgatggatttaactataaacagatgatggttagagatgagcggaggtttaaaatggcagacaaggatggagacctcattgccaccaaggaggagatcgttgacaagtatgacttatttgttggcagccaggccacagattttggggaggccttagtacggcatgatgagttctgagctacggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttgtttgtttgtttaaatcaagcctgaggctggtgaacagtagctacacacccatattgtgtgttctgtgaatgctagctctcttgaatttggatattggttattttttatagagtgtaaaccaagttttatattctgcaatgcgaacaggtacctatctgtttctaaataaaactgtttacattcatt

SEQ ID NO: 4388 - DNA, 3259 bp, Homo sapiens
gattggtcgggaggccgccggcgaggcggatgagggcggggtgcggacccgcttccggttgggcggtgcttgcgcgcgtgagctgagccggtgggtgagcggcggccacggcatcctgtgctgtgggggctacgaggaaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttagatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgaatcagaccaaaacaaggatggcaagcttaccaaggaggagatcgttgacaagtatgacttatttgttggcagccaggccacagattttggggaggccttagtacggcatgatgagttctgagctacggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttgtttgtttgtttaaatcaagcctgaggctggtgaacagtagctacacacccatattgtgtgttctgtgaatgctagctctcttgaatttggatattggttattttttatagagtgtaaaccaagttttatattctgcaatgcgaacaggtacctatctgtttctaaataaaactgtttacattcatt

SEQ ID NO: 4389 - DNA, 2983 bp, Homo sapiens
gattggtcgggaggccgccggcgaggcggatgagggcggggtgcggacccgcttccggttgggcggtgcttgcgcgcgtgagctgagccggtgggtgagcggcggccacggcatcctgtgctgtgggggctacgaggaaagatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctacggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttgtttgtttgtttaaatcaagcctgaggctggtgaacagtagctacacacccatattgtgtgttctgtgaatgctagctctcttgaatttggatattggttattttttatagagtgtaaaccaagttttatattctgcaatgcgaacaggtacctatctgtttctaaataaaactgtttacattcatt

SEQ ID NO: 4390 - DNA, 4224 bp, Homo sapiens
gattggtcgggaggccgccggcgaggcggatgagggcggggtgcggacccgcttccggttgggcggtgcttgcgcgcgtgagctgagccggtgggtgagcggcggccacggcatcctgtgctgtgggggctacgaggaaaggacctcccaccctcccccactgagctgccttcccagtgatgaaagaaaaaatgtaaaagcctgaaaacccttcttcttgatttttaatttttttttttccctctaagaccttaaccactctggatagtatcacggggtatcagtagagtgtgctaaacagatgtgtactctgcagcttctttgcaggttttttgtcacatttttcagtcaagtgttccagctttgtgcttgttcattagagtcacctgtgactacagagattctgaaagtttgaatcagggcctgggaatctgtactttgaacagtactacaggtggtatttatgcctaggcaagtatgggaaacaactgtgcagaaggataaagacgttcttatctatgactagaccatctgaatgatttggcctttgaaggtgactcaaggttgagcctggatgttggagacttggtgctatagaccaaggaagctgccaagtatttcgctggttcctaatctcatgaacatcagaatcacctgaaaaacatttaaagctacgaatgtctgaattcagcttcagagactctaaatcaataggagaaacttaaagcttcctagatgattctaataaccagccatgtttgaagaccagaccaccaatgcgtacaagaagtaaaggatttggagtcaacatttaaaccttggttctttcacttttaattcttatgaacttgggcaaaaggattaaaattctactttggtatcttttgaaagaaaacagaaagtggacattttaactataagtttcttatcagcctacaatcagatgaaggaaactgatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaatgattgtagataaaatagacgcggataaagatgggtttgtgacggagggggagctgaaatcctggattaagcacgcccagaagaaatacatatatgacaatgttgaaaaccaatggcaggagtttgatatgaatcaagacggcttaatctcctgggatgagtacagaaacgtgacttatggcacttacctggatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctacggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttgtttgtttgtttaaatcaagcctgaggctggtgaacagtagctacacacccatattgtgtgttctgtgaatgctagctctcttgaatttggatattggttattttttatagagtgtaaaccaagttttatattctgcaatgcgaacaggtacctatctgtttctaaataaaactgtttacattcatt

SEQ ID NO: 4391 - DNA, 1832 bp, Homo sapiens
gcgcaatccggagaggacgccaggacgacgcccgagttccctttcaggctagaactcttcctttttctagcttggggtagaaggcggagccggagccccggaacccccgccctcggggtgcgaggcggcagcagggccgtcccctacatttgcatagcccctgggacgtggcgctgcacccaagcctcttctcagttggagggaactccaagtcccacagtgccacggggtggggtgcgtcactttcgctgcgttggaggctgaggagaattgagcctgggaggcgggtccggagagggctatggaaagccgccggcggggaatcccggccgtagagggacagtggataggtgcccgaggcctacagctggcctggggctcgtgtctgggcttcggacgttggggcccggtggcccaccctttccgtagttgtcccaaatggagctggaattggatgctggtgaccaagacctgctggccttcctgctagaggaaagtggagatttggggacggcacccgatgaggccgtgagggccccactggactgggcgctgccgctttctgaggtaccgagcgactgggaagtagatgatttgctgtgctccctgctgagtcccccagcgtcgttgaacattctcagctcctccaacccctgccttgtccaccatgaccacacctactccctcccacgggaaactgtctctatggatctagagagtgagagctgtagaaaagaggggacccagatgactccacagcatatggaggagctggcagagcaggagattgctaggctagtactgacagatgaggagaagagtctattggagaaggaggggcttattctgcctgagacacttcctctcactaagacagaggaacaaattctgaaacgtgtgcggaggaagattcgaaataaaagatctgctcaagagagccgcaggaaaaagaaggtgtatgttgggggtttagagagcagggtcttgaaatacacagcccagaatatggagcttcagaacaaagtacagcttctggaggaacagaatttgtcccttctagatcaactgaggaaactccaggccatggtgattgagatatcaaacaaaaccagcagcagcagcacctgcatcttggtcctactagtctccttctgcctcctccttgtacctgctatgtactcctctgacacaagggggagcctgccagctgagcatggagtgttgtcccgccagcttcgtgccctccccagtgaggacccttaccagctggagctgcctgccctgcagtcagaagtgccgaaagacagcacacaccagtggttggacggctcagactgtgtactccaggcccctggcaacacttcctgcctgctgcattacatgcctcaggctcccagtgcagagcctcccctggagtggccattccctgacctcttctcagagcctctctgccgaggtcccatcctccccctgcaggcaaatctcacaaggaagggaggatggcttcctactggtagcccctctgtcattttgcaggacagatactcaggctagatatgaggatatgtggggggtctcagcaggagcctggggggctccccatctgtgtccaaataaaaagcggtgggcaagggctggccgcagctcctgtgccctgtcaggacgactgagggctcaaacacaccacacttaatggctttctgggtcttttatttgtacccatgtgtctgtcacaccatgaatgtacctggggaaatcaactgacctccctgaacatttcacgcagtcagggaacaggtgaggaaagaaataaataagtgattctaatgctg

SEQ ID NO: 4392 - DNA, 2586 bp, Homo sapiens
acagagccacagagggctgtgagcttgcccggccccaggtaacgctggcggtgggtgggcctccagcttggagcagagaccccccgaggcatctgcagacagaactggatggacccatgaatacggatttagctgctggaaagatggcttctgctgcctgctccatggaccccatcgacagctttgagctcctggatctcctgtttgaccggcaggacggcatcctgagacacgtggagctgggcgagggctggggtcacgtcaaggaccagcaggtcctgccaaaccccgactctgacgacttcctcagctccatcctgggctctggagactcactgcccagctccccactctggtcccccgaaggcagtgatagtggcatctccgaagacctcccctccgacccccaggacacccctccacgcagcggaccagccacctcccccgccggctgccatcctgcccagcctggcaaggggccctgcctctcctatcatcctggcaactcttgctccaccacaaccccagggccagtgatccaagtacctgaagcctctgtgaccatagacctggaaatgtggagcccaggaggaaggatctgtgctgagaagccggctgatccggtggacctgtccccacgatgcaatctcaccgtgaaagacctcctcctttcgggcagcagtggggacctgcaacagcatcacctgggggcctcctacctcctgcgacctggggctgggcactgtcaggagctggtgctcaccgaggatgagaagaagctgctggctaaagaaggcatcaccctgcccactcagctgcccctcactaagtacgaggagcgagtgctgaaaaaaatccgccggaaaatccggaacaagcagtcggcgcaagaaagcaggaagaagaagaaggaatatatcgatggcctggagactcggatgtcagcttgcactgctcagaatcaggagttacagaggaaagtcttgcatctcgagaagcaaaacctgtccctcttggagcaactgaagaaactccaggccattgtggtgcagtccaccagcaagtcagcccagacaggcacctgtgtcgcagtcctgttgctgtcctttgccctcatcatcctcccctccatcagcccttttggccccaacaaaaccgagagccctggggactttgcgcctgtacgagtgttctccagaactttgcacaacgatgctgcctcccgcgtggctgctgatgctgtgccaggctccgaggccccaggaccccgacccgaggctgacacaacccgagaagagtctccaggaagccccggggcagactggggcttccaggacaccgcgaacctgaccaattcgacggaggagctggacaacgccaccctggtcctgaggaatgcaacagaggggctgggccaggtcgccctgctggactgggtggcgcctgggccgagcactggctcaggacgtgcagggctggaggcggcgggagacgagctgtgagccccgccaggactatgctcccaggcccctctgcccaggggtgccttggggatgctgcactgggcagctacccacctggggatgggacgtgaggccaagaccccagcagagatgccagaatgggggaggcacagctcatagccacacacccagggcctgactgaggcccacgcaggaaccgacactcagacacaaggcaaagagggccacaggacccgggaaatacacacagagccaggagcagaagcaaagagcagacacacatacagcctgaaacagacctggacagacagacacagcctgaaacagacccggacagacagacacagcctgaaacagacccagacaaacagacagacagacacagcctgaaacagacccagacagacagacagacagcctgaaacagacccagacacagcctgaaacagatccggacagacagacagaaacagcctgaaacagacccagacagacagacagacacagcctgaaacagacccggacagacagacagacacagcctgaaacagacccggacagacagacagacacagcctgaaacagacccggacagacagacagacacagcctgaaacagacctagacagacagacacagattgaaacagacccagacaaacagacagacacagcctgaaacagacccagacacagcctgaaacagacccggacagacagacagacacagcctgaaacagacccagacagacagacagacacagcctgaaacagacccagacagacagaccgacgcagcctgaaagagacccagacagagagacaggcagacacagcctaaaacagacctggacagacaggcagacgtagtctgaaacagacctgaacagacagacagacgcacacacacaacagatgcgcagcaactccccgcccagggacccctcccggcctccctcgcacactgggaggaggaagccgccgagactgcagggagcctggccccggagccccgggtgcgccctggtctttggagcagccacggcccacaatcaccccccttttctaagactgcctgatccgaaataaagtattttgacaga

SEQ ID NO: 4393 - DNA, 2279 bp, Homo sapiens
acagagccacagagggctgtgagcttgcccggccccaggtaacgctggcggtgggtgggcctccagcttggagcagagaccccccgaggcatctgcagacagaactggatggacccatgaatacggatttagctgctggaaagatggcttctgctgcctgctccatggaccccatcgacagctttgagctcctggatctcctgtttgaccggcaggacggcatcctgagacacgtggagctgggcgagggctggggtcacgtcaaggaccaggtcctgccaaaccccgactctgacgacttcctcagctccatcctgggctctggagactcactgcccagctccccactctggtcccccgaaggcagtgatagtggcatctccgaagacctcccctccgacccccaggacacccctccacgcagcggaccagccacctcccccgccggctgccatcctgcccagcctggcaaggggccctgcctctcctatcatcctggcaactcttgctccaccacaaccccagggccagtgatccaacaacagcatcacctgggggcctcctacctcctgcgacctggggctgggcactgtcaggagctggtgctcaccgaggatgagaagaagctgctggctaaagaaggcatcaccctgcccactcagctgcccctcactaagtacgaggagcgagtgctgaaaaaaatccgccggaaaatccggaacaagcagtcggcgcaagaaagcaggaagaagaagaaggaatatatcgatggcctggagactcggtcctgttgctgtcctttgccctcatcatcctcccctccatcagcccttttggccccaacaaaaccgagagccctggggactttgcgcctgtacgagtgttctccagaactttgcacaacgatgctgcctcccgcgtggctgctgatgctgtgccaggctccgaggccccaggaccccgacccgaggctgacacaacccgagaagagtctccaggaagccccggggcagactggggcttccaggacaccgcgaacctgaccaattcgacggaggagctggacaacgccaccctggtcctgaggaatgcaacagaggggctgggccaggtcgccctgctggactgggtggcgcctgggccgagcactggctcaggacgtgcagggctggaggcggcgggagacgagctgtgagccccgccaggactatgctcccaggcccctctgcccaggggtgccttggggatgctgcactgggcagctacccacctggggatgggacgtgaggccaagaccccagcagagatgccagaatgggggaggcacagctcatagccacacacccagggcctgactgaggcccacgcaggaaccgacactcagacacaaggcaaagagggccacaggacccgggaaatacacacagagccaggagcagaagcaaagagcagacacacatacagcctgaaacagacctggacagacagacacagcctgaaacagacccggacagacagacacagcctgaaacagacccagacaaacagacagacagacacagcctgaaacagacccagacagacagacagacagcctgaaacagacccagacacagcctgaaacagatccggacagacagacagaaacagcctgaaacagacccagacagacagacagacacagcctgaaacagacccggacagacagacagacacagcctgaaacagacccggacagacagacagacacagcctgaaacagacccggacagacagacagacacagcctgaaacagacctagacagacagacacagattgaaacagacccagacaaacagacagacacagcctgaaacagacccagacacagcctgaaacagacccggacagacagacagacacagcctgaaacagacccagacagacagacagacacagcctgaaacagacccagacagacagaccgacgcagcctgaaagagacccagacagagagacaggcagacacagcctaaaacagacctggacagacaggcagacgtagtctgaaacagacctgaacagacagacagacgcacacacacaacagatgcgcagcaactccccgcccagggacccctcccggcctccctcgcacactgggaggaggaagccgccgagactgcagggagcctggccccggagccccgggtgcgccctggtctttggagcagccacggcccacaatcaccccccttttctaagactgcctgatccgaaataaagtattttgacaga

SEQ ID NO: 4394 - DNA, 2460 bp, Homo sapiens
acagagccacagagggctgtgagcttgcccggccccaggtaacgctggcggtgggtgggcctccagcttggagcagagaccccccgaggcatctgcagacagaactggatggacccatgaatacggatttagctgctggaaagatggcttctgctgcctgctccatggaccccatcgacagctttgagctcctggatctcctgtttgaccggcaggacggcatcctgagacacgtggagctgggcgagggctggggtcacgtcaaggaccagcaggtcctgccaaaccccgactctgacgacttcctcagctccatcctgggctctggagactcactgcccagctccccactctggtcccccgaaggcagtgatagtggcatctccgaagacctcccctccgacccccaggacacccctccacgcagcggaccagccacctcccccgccggctgccatcctgcccagcctggcaaggggccctgcctctcctatcatcctggcaactcttgctccaccacaaccccagggccagtgatccaagtacctgaagcctctgtgaccatagacctggaaatgtggagcccaggaggaaggatctgtgctgagaagccggctgatccggtggacctgtccccacgatgcaatctcaccgtgaaagacctcctcctttcgggcagcagtggggacctgcaacagcatcacctgggggcctcctacctcctgcgacctggggctgggcactgtcaggagctggtgctcaccgaggatgagaagaagctgctggctaaagaaggcatcaccctgcccactcagctgcccctcactaagtacgaggagcgagtgctgaaaaaaatccgccggaaaatccggaacaagcagtcggcgcaagaaagcaggaagaagaagaaggccattgtggtgcagtccaccagcaagtcagcccagacaggcacctgtgtcgcagtcctgttgctgtcctttgccctcatcatcctcccctccatcagcccttttggccccaacaaaaccgagagccctggggactttgcgcctgtacgagtgttctccagaactttgcacaacgatgctgcctcccgcgtggctgctgatgctgtgccaggctccgaggccccaggaccccgacccgaggctgacacaacccgagaagagtctccaggaagccccggggcagactggggcttccaggacaccgcgaacctgaccaattcgacggaggagctggacaacgccaccctggtcctgaggaatgcaacagaggggctgggccaggtcgccctgctggactgggtggcgcctgggccgagcactggctcaggacgtgcagggctggaggcggcgggagacgagctgtgagccccgccaggactatgctcccaggcccctctgcccaggggtgccttggggatgctgcactgggcagctacccacctggggatgggacgtgaggccaagaccccagcagagatgccagaatgggggaggcacagctcatagccacacacccagggcctgactgaggcccacgcaggaaccgacactcagacacaaggcaaagagggccacaggacccgggaaatacacacagagccaggagcagaagcaaagagcagacacacatacagcctgaaacagacctggacagacagacacagcctgaaacagacccggacagacagacacagcctgaaacagacccagacaaacagacagacagacacagcctgaaacagacccagacagacagacagacagcctgaaacagacccagacacagcctgaaacagatccggacagacagacagaaacagcctgaaacagacccagacagacagacagacacagcctgaaacagacccggacagacagacagacacagcctgaaacagacccggacagacagacagacacagcctgaaacagacccggacagacagacagacacagcctgaaacagacctagacagacagacacagattgaaacagacccagacaaacagacagacacagcctgaaacagacccagacacagcctgaaacagacccggacagacagacagacacagcctgaaacagacccagacagacagacagacacagcctgaaacagacccagacagacagaccgacgcagcctgaaagagacccagacagagagacaggcagacacagcctaaaacagacctggacagacaggcagacgtagtctgaaacagacctgaacagacagacagacgcacacacacaacagatgcgcagcaactccccgcccagggacccctcccggcctccctcgcacactgggaggaggaagccgccgagactgcagggagcctggccccggagccccgggtgcgccctggtctttggagcagccacggcccacaatcaccccccttttctaagactgcctgatccgaaataaagtattttgacaga

SEQ ID NO: 4395 - DNA, 1750 bp, Homo sapiens
ccatgatctccctcttgcaaaagcgagggctacagaacaggcattcaggagtcctgtgctccagtcacagccttttctgttcttcagctaggagacaccaaaccctcaggaagatttactatagctaagagaaaactgcagcagaaagggcgcggctacctacttcttaaattccgtttgtggaccctcagactcttagtcccctactcccagatacagcggccctaccgtggctcctggcaaggtggcatccacttttgtagtaagcatggatctcggaatccctgacctgctggacgcgtggctggagcccccagaggatatcttctcgacaggatccgtcctggagctgggactccactgcccccctccagaggttccggtaactaggctacaggaacagggactgcaaggctggaagtccggtggggaccgtggctgtggccttcaagagagtgagcctgaagatttcttgaagcttttcattgatcccaatgaggtgtactgctcagaagcatctcctggcagtgacagtggcatctctgaggacccctgccatccagacagtccccctgcccccagggcaaccagttctcctatgctctatgaggttgtctatgaggcaggggccctggagaggatgcagggggaaactgggccaaatgtaggccttatctccatccagctagatcagtggagcccagcatttatggtgcctgattcctgcatggtcagtgagctgccctttgatgctcatgcccacatcctgcccagagcaggcaccgtagccccagtgccctgtacaaccctgctgccctgtcaaaccctgttcctgaccgatgaggagaagcgtctgctggggcaggaaggggtttccctgccctctcacctgcccctcaccaaggcagaggagagggtcctcaagaaggtcaggaggaaaatccgtaacaagcagtcagctcaggacagtcggcggcggaagaaggagtacattgatgggctggagagcagggtggcagcctgttctgcacagaaccaagaattacagaaaaaagtccaggagctggagaggcacaacatctccttggtagctcagctccgccagctgcagacgctaattgctcaaacttccaacaaagctgcccagaccagcacttgtgttttgattcttcttttttccctggctctcatcatcctgcccagcttcagtccattccagagtcgaccagaagctgggtctgaggattaccagcctcacggagtgacttccagaaatatcctgacccacaaggacgtaacagaaaatctggagacccaagtggtagagtccagactgagggagccacctggagccaaggatgcaaatggctcaacaaggacactgcttgagaagatgggagggaagccaagacccagtgggcgcatccggtccgtgctgcatgcagatgagatgtgagctggaacagaccttcctggcccacttcctgatcacaaggaatcctgggcttccttatggctttgcttcccactgggattcctacttaggtgtctgccctcaggggtccaaatcacttcaggacaccccaagagatgtcctttagtctctgcctgaggcctagtctgcatttgtttgcatatatgagagggtacctcaaatacttctgttatgtatctgtgattttatttcttctttgggtatagggttgaggggaaataagttttgagtgagaaataaacgttttagctgaaa

SEQ ID NO: 4396 - DNA, 1496 bp, Homo sapiens
aaaaggtgtagtgtttggggaggtcaacgggctatgctggcttgacagggctgggctcttcagaacagaagcatggatctcggaatccctgacctgctggacgcgtggctggagcccccagaggatatcttctcgacaggatccgtcctggagctgggactccactgcccccctccagaggttccgggccttcaagagagtgagcctgaagatttcttgaagcttttcattgatcccaatgaggtgtactgctcagaagcatctcctggcagtgacagtggcatctctgaggacccctgccatccagacagtccccctgcccccagggcaaccagttctcctatgctctatgaggttgtctatgaggcaggggccctggagaggatgcagggggaaactgggccaaatgtaggccttatctccatccagctagatcagtggagcccagcatttatggtgcctgattcctgcatggtcagtgagctgccctttgatgctcatgcccacatcctgcccagagcaggcaccgtagccccagtgccctgtacaaccctgctgccctgtcaaaccctgttcctgaccgatgaggagaagcgtctgctggggcaggaaggggtttccctgccctctcacctgcccctcaccaaggcagaggagagggtcctcaagaaggtcaggaggaaaatccgtaacaagcagtcagctcaggacagtcggcggcggaagaaggagtacattgatgggctggagagcagggtggcagcctgttctgcacagaaccaagaattacagaaaaaagtccaggagctggagaggcacaacatctccttggtagctcagctccgccagctgcagacgctaattgctcaaacttccaacaaagctgcccagaccagcacttgtgttttgattcttcttttttccctggctctcatcatcctgcccagcttcagtccattccagagtcgaccagaagctgggtctgaggattaccagcctcacggagtgacttccagaaatatcctgacccacaaggacgtaacagaaaatctggagacccaagtggtagagtccagactgagggagccacctggagccaaggatgcaaatggctcaacaaggacactgcttgagaagatgggagggaagccaagacccagtgggcgcatccggtccgtgctgcatgcagatgagatgtgagctggaacagaccttcctggcccacttcctgatcacaaggaatcctgggcttccttatggctttgcttcccactgggattcctacttaggtgtctgccctcaggggtccaaatcacttcaggacaccccaagagatgtcctttagtctctgcctgaggcctagtctgcatttgtttgcatatatgagagggtacctcaaatacttctgttatgtatctgtgattttatttcttctttgggtatagggttgaggggaaataagttttgagtgagaaataaacgttttagctgaaatt

SEQ ID NO: 4397 - DNA, 950 bp, Homo sapiens
agaaagaaaaggtgtagtgtttggggaggtcaacgggctatgctggcttgacagggctgggctcttcagaacagaagcatggatctcggaatccctgacctgctggacgcgtggctggagcccccagaggatatcttctcgacaggatccgtcctggagctgggactccactgcccccctccagaggttccggtaactaggctacaggaacagggactgcaaggctggaagtccggtggggaccgtggctgtggccttcaagagagtgagcctgaagatttcttgaagcttttcattgatcccaatgaggtgtactgctcagaagcatctcctggcagtgacagtggcatctctgaggacccctgccatccagacagtccccctgcccccagggcaaccagttctcctatgctctatgaggttgtctatgaggcaggggccctggagaggatgcagggggaaactgggccaaatgtaggccttatctccatccagctagatcagtggagcccagcatttatggtgcctgattcctgcatggtcagtgagctgccctttgatgctcatgcccacatcctgcccagagcaggcaccgtagccccagtgccctgtacaaccctgctgccctgtcaaaccctgttcctgaccgatgaggagaagcgtctgctggggcaggaaggggtttccctgccctctcacctgcccctcaccaaggtaacatgcttcccctaagggtatcccaacccaggggcctcaccatgacctctgaggggccaatatcccaggagaagcattggggagttgggggcaggtgaaggacccaggactcacacatcctgggcctccaaggcagaggagagggtcctcaagaaggtcaggaggaaaatccgtaacaagcagtcagctcaggacagtcggcggcggaagaaggagtacattgatgggctgga

SEQ ID NO: 4398 - DNA, 1557 bp, Homo sapiens
agaaagaaaaggtgtagtgtttggggaggtcaacgggctatgctggcttgacagggctgggctcttcagaacagaagcatggatctcggaatccctgacctgctggacgcgtggctggagcccccagaggatatcttctcgacaggatccgtcctggagctgggactccactgcccccctccagaggttccggtaactaggctacaggaacagggactgcaaggctggaagtccggtggggaccgtggctgtggccttcaagagagtgagcctgaagatttcttgaagcttttcattgatcccaatgaggtgtactgctcagaagcatctcctggcagtgacagtggcatctctgaggacccctgccatccagacagtccccctgcccccagggcaaccagttctcctatgctctatgaggttgtctatgaggcaggggccctggagaggatgcagggggaaactgggccaaatgtaggccttatctccatccagctagatcagtggagcccagcatttatggtgcctgattcctgcatggtcagtgagctgccctttgatgctcatgcccacatcctgcccagagcaggcaccgtagccccagtgccctgtacaaccctgctgccctgtcaaaccctgttcctgaccgatgaggagaagcgtctgctggggcaggaaggggtttccctgccctctcacctgcccctcaccaaggcagaggagagggtcctcaagaaggtcaggaggaaaatccgtaacaagcagtcagctcaggacagtcggcggcggaagaaggagtacattgatgggctggagagcagggtggcagcctgttctgcacagaaccaagaattacagaaaaaagtccaggagctggagaggcacaacatctccttggtagctcagctccgccagctgcagacgctaattgctcaaacttccaacaaagctgcccagaccagcacttgtgttttgattcttcttttttccctggctctcatcatcctgcccagcttcagtccattccagagtcgaccagaagctgggtctgaggattaccagcctcacggagtgacttccagaaatatcctgacccacaaggacgtaacagaaaatctggagacccaagtggtagagtccagactgagggagccacctggagccaaggatgcaaatggctcaacaaggacactgcttgagaagatgggagggaagccaagacccagtgggcgcatccggtccgtgctgcatgcagatgagatgtgagctggaacagaccttcctggcccacttcctgatcacaaggaatcctgggcttccttatggctttgcttcccactgggattcctacttaggtgtctgccctcaggggtccaaatcacttcaggacaccccaagagatgtcctttagtctctgcctgaggcctagtctgcatttgtttgcatatatgagagggtacctcaaatacttctgttatgtatctgtgattttatttcttctttgggtatagggttgaggggaaataagttttgagtgagaaataaacgttttagctg

SEQ ID NO: 4399 - DNA, 1752 bp, Homo sapiens
cctttgtttacaaccctgccatgatctccctcttgcaaaagcgagggctacagaacaggcattcaggagtcctgtgctccagtcacagccttttctgttcttcagctaggagacaccaaaccctcaggaagatttactatagctaagagaaaactgcagcagaaagggcgcggctacctacttcttaaattccgtttgtggaccctcagactcttagtcccctactcccagatacagcggccctaccgtggctcctggcaagaagcatggatctcggaatccctgacctgctggacgcgtggctggagcccccagaggatatcttctcgacaggatccgtcctggagctgggactccactgcccccctccagaggttccggtaactaggctacaggaacagggactgcaaggctggaagtccggtggggaccgtggctgtggccttcaagagagtgagcctgaagatttcttgaagcttttcattgatcccaatgaggtgtactgctcagaagcatctcctggcagtgacagtggcatctctgaggacccctgccatccagacagtccccctgcccccagggcaaccagttctcctatgctctatgaggttgtctatgaggcaggggccctggagaggatgcagggggaaactgggccaaatgtaggccttatctccatccagctagatcagtggagcccagcatttatggtgcctgattcctgcatggtcagtgagctgccctttgatgctcatgcccacatcctgcccagagcaggcaccgtagccccagtgccctgtacaaccctgctgccctgtcaaaccctgttcctgaccgatgaggagaagcgtctgctggggcaggaaggggtttccctgccctctcacctgcccctcaccaaggcagaggagagggtcctcaagaaggtcaggaggaaaatccgtaacaagcagtcagctcaggacagtcggcggcggaagaaggagtacattgatgggctggagagcagggtggcagcctgttctgcacagaaccaagaattacagaaaaaagtccaggagctggagaggcacaacatctccttggtagctcagctccgccagctgcagacgctaattgctcaaacttccaacaaagctgcccagaccagcacttgtgttttgattcttcttttttccctggctctcatcatcctgcccagcttcagtccattccagagtcgaccagaagctgggtctgaggattaccagcctcacggagtgacttccagaaatatcctgacccacaaggacgtaacagaaaatctggagacccaagtggtagagtccagactgagggagccacctggagccaaggatgcaaatggctcaacaaggacactgcttgagaagatgggagggaagccaagacccagtgggcgcatccggtccgtgctgcatgcagatgagatgtgagctggaacagaccttcctggcccacttcctgatcacaaggaatcctgggcttccttatggctttgcttcccactgggattcctacttaggtgtctgccctcaggggtccaaatcacttcaggacaccccaagagatgtcctttagtctctgcctgaggcctagtctgcatttgtttgcatatatgagagggtacctcaaatacttctgttatgtatctgtgattttatttcttctttgggtatagggttgaggggaaataagttttgagtgagaaataaacgttttagctgaaattgt

SEQ ID NO: 4400 - DNA, 1531 bp, Homo sapiens
ctagtaaattcgcaggtctcttgactctttccgcctttgtttacaaccctgccatgatctccctcttgcaaaagcgagggctacagaacaggcattcaggagtcctgtgctccagtcacagccttttctgttcttcagctaggagacaccaaaccctcaggaagatttactatagctaagagaaaactgcagcagaaagggcgcggctacctacttcttaaattccgtttgtggaccctcagactcttagtcccctactcccagatacagcggccctaccgtggctcctggcaagaagcatggatctcggaatccctgacctgctggacgcgtggctggagcccccagaggatatcttctcgacaggatccgtcctggagctgggactccactgcccccctccagaggttccggtaactaggctacaggaacagggactgcaaggctggaagtccggtggggaccgtggctgtatcagtggagcccagcatttatggtgcctgattcctgcatggtcagtgagctgccctttgatgctcatgcccacatcctgcccagagcaggcaccgtagccccagtgccctgtacaaccctgctgccctgtcaaaccctgttcctgaccgatgaggagaagcgtctgctggggcaggaaggggtttccctgccctctcacctgcccctcaccaaggcagaggagagggtcctcaagaaggtcaggaggaaaatccgtaacaagcagtcagctcaggacagtcggcggcggaagaaggagtacattgatgggctggagagcagggtggcagcctgttctgcacagaaccaagaattacagaaaaaagtccaggagctggagaggcacaacatctccttggtagctcagctccgccagctgcagacgctaattgctcaaacttccaacaaagctgcccagaccagcacttgtgttttgattcttcttttttccctggctctcatcatcctgcccagcttcagtccattccagagtcgaccagaagctgggtctgaggattaccagcctcacggagtgacttccagaaatatcctgacccacaaggacgtaacagaaaatctggagacccaagtggtagagtccagactgagggagccacctggagccaaggatgcaaatggctcaacaaggacactgcttgagaagatgggagggaagccaagacccagtgggcgcatccggtccgtgctgcatgcagatgagatgtgagctggaacagaccttcctggcccacttcctgatcacaaggaatcctgggcttccttatggctttgcttcccactgggattcctacttaggtgtctgccctcaggggtccaaatcacttcaggacaccccaagagatgtcctttagtctctgcctgaggcctagtctgcatttgtttgcatatatgagagggtacctcaaatacttctgttatgtatctgtgattttatttcttctttgggtatagggttgaggggaaataagttttgagtgagaaataaacgttttagctg

SEQ ID NO: 4401 - DNA, 602 bp, Homo sapiens
ggtaatgcttggggggggcctctttgtctaaacctgagggatagggctgaagaagcatggatctcggaatccctgacctgctggacgcgtggctggagcccccagaggatatcttctcgacaggatccgtcctggagctgggactccactgcccccctccagaggttccggtaactaggctacaggaacagggactgcaaggctggaagtccggtggggaccgtggctgtggccttcaagagagtgagcctgaagatttcttgaagcttttcattgatcccaatgaggtgtactgctcagaagcatctcctggcagtgacagtggcatctctgaggacccctgccatccagacagtccccctgcccccagggcaaccagttctcctatgctctatgaggttgtctatgaggcaggggccctggagaggatgcagggggaaactgggccaaatgtaggccttatctccatccagctagatcagtggagcccagcatttatggtgcctgattcctgcatggtcagtgagctgccctttgatgctcatgcccacatcctgcccagagcaggcaccgtagccccagtgccctgtacaaccctggtg

SEQ ID NO: 4402 - DNA, 982 bp, Homo sapiens
gactctttccgcctttgtttacaaccctgccatgatctccctcttgcaaaagcgagggctacagaacaggcattcaggagtcctgtgctccagtcacagccttttctgttcttcagctaggagacaccaaaccctcaggaagatttactatagctaagagaaaactgcagcagaaagggcgcggctacctacttcttaaattccgtttgtggaccctcagactcttagtcccctactcccagatacagcggccctaccgtggctcctggcaaggtggcatccacttttgtagtaagcatggatctcggaatccctgacctgctggacgcgtggctggagcccccagaggatatcttctcgacaggatccgtcctggagctgggactccactgcccccctccagaggttccgggccttcaagagagtgagcctgaagatttcttgaagcttttcattgatcccaatgaggtgtactgctcagaagcatctcctggcagtgacagtggcatctctgaggacccctgccatccagacagtccccctgcccccagggcaaccagttctcctatgctctatgaggttgtctatgaggcaggggccctggagaggatgcagggggaaactgggccaaatgtaggccttatctccatccagctagatcagtggagcccagcatttatggtgcctgattcctgcatggtcagtgagctgccctttgatgctcatgcccacatcctgcccagagcaggcaccgtagccccagtgccctgtacaaccctgctgccctgtcaaaccctgttcctgaccgatgaggagaagcgtctgctggggcaggaaggggtttccctgccctctcacctgcccctcaccaaggcagaggagagggtcctcaagaaggtcaggaggaaaatccgtaacaagcagtcagctcaggacagtcggcggcggaagaaggagtacattgatgggctggagagcaggt

SEQ ID NO: 4403 - DNA, 2658 bp, Homo sapiens
gataaataaagaaaacaggaaaggaggaaagcattgattacaaatatcttaacaatgagcaaatgtgcaaggaaaaaatatattaagacaaatccaagacaaatgaccatggaaacagttgaatcccagcatgatggaagtataacagcttctttgacagagagcaagtctgctcatgtgcagactcagactggccaaaattcaatccctgctttagctcaggtttctgtggctggatcaggcaccagaagaggctccccagctgtaactctagtgcagttaccttcgggccaaactatacatgtccagggagtaattcagacaccacagccatgggttattcagtcatcagaaatacacaccgttcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacattgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcacc

SEQ ID NO: 4404 - DNA, 900 bp, Homo sapiens
atgagcaaatgtgcaaggaaaaaatatattaagacaaatccaagacaaatgaccatggaaacagttgaatcccagcatgatggaagtataacagcttctttgacagagagcaagtctgctcatgtgcagactcagactggccaaaattcaatccctgctttagctcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacattgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaa

SEQ ID NO: 4405 - DNA, 1541 bp, Homo sapiens
ggaacattcttagccaccgaagtatgggcaccaaaagcgataaggagcatgtgttccttaataaatgtcacatcagaaaatgactgttccaggacagtaaccacctcccgatggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacattgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatg

SEQ ID NO: 4406 - DNA, 1625 bp, Homo sapiens
cagatttagagttaactagctcaccactgcctctgcctccaagctgccttttagactgaatagcttttcttgttagccctactttaacatttcttttgaagtggttgtctgcttgaagagggaaacacgtcatgaaactgtaatgcatgaacagaactcaggagttgtctggccagcttagtggtaagatcgagcctcctactgaggccgtccctgcatgcgcctgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaat

SEQ ID NO: 4407 - DNA, 2220 bp, Homo sapiens
gacccgcctgcctcctcgcgaacttgggacgagttggaaaatcctccctgagagagccgtgcggctcaggggagcggtttaactcggaaaaggaaaaggaatccagaagataaataaagaaaacaggaaaggaggaaagcattgattacaaatatcttaacaatgagcaaatgtgcaaggaaaaaatatattaagacaaatccaagacaaatgaccatggaaacagttgaatcccagcatgatggaagtataacagcttctttgacagagagcaagtctgctcatgtgcagactcagactggccaaaattcaatccctgctttagctcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacattgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccaca

SEQ ID NO: 4408 - DNA, 1821 bp, Homo sapiens
atgaccatggaaacagttgaatcccagcatgatggaagtataacagcttctttgacagagagcaagtctgctcatgtgcagactcagactggccaaaattcaatccctgctttagctcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacactgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccaca

SEQ ID NO: 4409 - DNA, 1589 bp, Homo sapiens
cgaggtccgctacgtaaatccctttgcggcgggataaataaagaaaacaggaaaggaggaaagcattgattacaaatatcttaacaatgagcaaatgtgcaaggaaaaaatatattaagacaaatccaagacaaatgaccatggaaacagttgaatcccagcatgatggaagtataacagcttctttgacagagagcaagtctgctcatgtgcagactcagactggccaaaattcaatccctgctttagctcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacaatgaggaaactgaacttgccccaagtcacatggctgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataa

SEQ ID NO: 4410 - DNA, 1895 bp, Homo sapiens
tgtggtagaggaaacaagacagttctgtctgcagaagcccattatggctgtaactggagatgacacagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaa

SEQ ID NO: 4411 - DNA, 2170 bp, Homo sapiens
taaaccccatcgtgagggaacctagctacgggtcagagctagtccactaggtgctaatcaaatgctgtgttacaacactgtgaggttttcccagttataagtgtcactattagggttttttttaattgcaaagccaaataaggctgtcaattgcatcatcttaccttatttcttcagattaagtactgtttatagtgggatttttggtggatgtggtggcatcagcataatctatgtttcaggcgtcctatagaagaggattattcttcaggggatgtggaagaaaaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacattgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccc

SEQ ID NO: 4412 - DNA, 1425 bp, Homo sapiens
atgaccatggaaacagttgaatcccagcatgatggaagtataacagcttctttgacagagagcaagtctgctcatgtgcagactcagactggccaaaattcaatccctgctttagctcaggtttctgtggctggatcaggcaccagaagaggctccccagctgtaactctagtgcagttaccttcgggccaaactatacatgtccagggagtaattcagacaccacagccatgggttattcagtcatcagaaatacacaccgttcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacattgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactga

SEQ ID NO: 4413 - DNA, 2157 bp, Homo sapiens
atgaccatggaaacagttgaatcccagcatgatggaagtataacagcttctttgacagagagcaagtctgctcatgtgcagactcagactggccaaaattcaatccctgctttagctcaggtttctgtggctggatcaggcaccagaagaggctccccagctgtaactctagtgcagttaccttcgggccaaactatacatgtccagggagtaattcagacaccacagccatgggttattcagtcatcagaaatacacaccgttcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacattgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccaca

SEQ ID NO: 4414 - DNA, 1203 bp, Homo sapiens
gcctcccccgggaggccgtcccggcgtgggggaggggaggacggggcgggaggacgcggttcggtcggctgcagcgctacttttggtccggggtcggcagggaggccgcggctaccgcatcacagctgacgtgaggactacgtggggccgctgccggctccgggttgctgggcggcggcgccgctgctgagcggcggtcgggctcgccgtctccacctcctcgcgtccgtaatcagtgacgaggtccgctacgtaaatccctttgcggcggacaaatgaccatggaaacagttgaatcccagcatgatggaagtataacagcttctttgacagagagcaagtctgctcatgtgcagactcagactggccaaaattcaatccctgctttagctcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacagtatgtatgctgcaattcgatatgatacagtgctagctttaagtcttctctagttatattgaagcaactcaggttttggcattaaattgttccattttaaaatgcatcattaatacctaaactgtatcatagaatgaaagtatatgttaaaaagtgagatctttgtattgacagctgtcatataattttgaaaagtaaaaattttgactgccgaatatagaagaaaattttggggtaaaaaggagaatttttcctatttacatgtttatattaatctctagtaaaacattgtttttgttgtctttatgatgcatgcgaacataaatgtctgtatttcattcttgttggcttttgttacccacaattacatactattcttactaatctgagagttttctaaagtatgttttcaatgtttcactactctctactctgttaatttgtgctacagtttttcctaaaagagaatggaaaaatgatttaattttttaaactgtagcaattggatagataattttatttgaaattttacacactgaaagctctaaataaacagatacattcaca

SEQ ID NO: 4415 - DNA, 1930 bp, Homo sapiens
gacccgcctgcctcctcgcgaacttgggacgagttggaaaatcctccctgagagagccgtgcggctcaggggagcggtttaactcggaaaaggaaaaggaatccagaaacaaatgaccatggaaacagttgaatcccagcatgatggaagtataacagcttctttgacagagagcaagtctgctcatgtgcagactcagactggccaaaattcaatccctgctttagctcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacactgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcacc

SEQ ID NO: 4416 - DNA, 711 bp, Homo sapiens
atgagcaaatgtgcaaggaaaaaatatattaagacaaatccaagacaaatgaccatggaaacagttgaatcccagcatgatggaagtataacagcttctttgacagagagcaagtctgctcatgtgcagactcagactggccaaaattcaatccctgctttagctcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacactgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaa

SEQ ID NO: 4417 - DNA, 849 bp, Homo sapiens
atgtggtggcatcagcataatctatgtttcaggcgtcctatagaagaggattattcttcaggggatgtggaagaaaaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacattgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaagatgaggaaactgaacttgccccaagtcacatggctgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactag

SEQ ID NO: 4418 - DNA, 2400 bp, Homo sapiens
gacccgcctgcctcctcgcgaacttgggacgagttggaaaatcctccctgagagagccgtgcggctcaggggagcggtttaactcggaaaaggaaaaggaatccagaagataaataaagaaaacaggaaaggaggaaagcattgattacaaatatcttaacaatgagcaaatgtgcaaggaaaaaatatattaagacaaatccaagacaaatgaccatggaaacagttgaatcccagcatgatggaagtataacagcttctttgacagagagcaagtctgctcatgtgcagactcagactggccaaaattcaatccctgctttagctcaggtttctgtggctggatcaggcaccagaagaggctccccagctgtaactctagtgcagttaccttcgggccaaactatacatgtccagggagtaattcagacaccacagccatgggttattcagtcatcagaaatacacaccgttcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacattgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaagatgaggaaactgaacttgccccaagtcacatggctgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcacc

SEQ ID NO: 4419 - DNA, 635 bp, Homo sapiens
cgggacccgcctgcctcctcgcgaacttgggacgagttggaaaatcctccctgagagagccgtgcggctcaggggagcggtttaactcggaaaaggaaaaggaatccagaagataaataaagaaaacaggaaaggaggaaagcattgattacaaatatcttaacaatgagcaaatgtgcaaggaaaaaatatattaagacaaatccaagacaaatgaccatggaaacagttgaatcccagcatgatggaagtataacagcttctttgacagagagcaagtctgctcatgtgcagactcagactggccaaaattcaatccctgctttagctcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacattgctatagcccaaggtggaacaatccagatttctaacccaggatctgatggtgttcaggg

SEQ ID NO: 4420 - DNA, 1038 bp, Homo sapiens
atgaccatggaaacagttgaatcccagcatgatggaagtataacagcttctttgacagagagcaagtctgctcatgtgcagactcagactggccaaaattcaatccctgctttagctcaggtttctgtggctggatcaggcaccagaagaggctccccagctgtaactctagtgcagttaccttcgggccaaactatacatgtccagggagtaattcagacaccacagccatgggttattcagtcatcagaaatacacaccgttcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacattgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaagatgaggaaactgaacttgccccaagtcacatggctgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactag

SEQ ID NO: 4421 - DNA, 2469 bp, Homo sapiens
gataaataaagaaaacaggaaaggaggaaagcattgattacaaatatcttaacaatgagcaaatgtgcaaggaaaaaatatattaagacaaatccaagacaaatgaccatggaaacagttgaatcccagcatgatggaagtataacagcttctttgacagagagcaagtctgctcatgtgcagactcagactggccaaaattcaatccctgctttagctcaggtttctgtggctggatcaggcaccagaagaggctccccagctgtaactctagtgcagttaccttcgggccaaactatacatgtccagggagtaattcagacaccacagccatgggttattcagtcatcagaaatacacaccgttcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacactgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcacc

SEQ ID NO: 4422 - DNA, 1416 bp, Homo sapiens
cggtcgggctcgccgtctccacctcctcgcgtccgtaatcagtgacgaggtccgctacgtaaatccctttgcggcggctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaact

SEQ ID NO: 4423 - DNA, 810 bp, Homo sapiens
atgaccatggaaacagttgaatcccagcatgatggaagtataacagcttctttgacagagagcaagtctgctcatgtgcagactcagactggccaaaattcaatccctgctttagctcaggtttctgtggctggatcaggcaccagaagaggctccccagctgtaactctagtgcagttaccttcgggccaaactatacatgtccagggagtaattcagacaccacagccatgggttattcagtcatcagaaatacacaccgttcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacactgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaa

SEQ ID NO: 4424 - DNA, 585 bp, Homo sapiens
atggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacaatgaggaaactgaacttgccccaagtcacatggctgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactag

SEQ ID NO: 4425 - DNA, 1182 bp, Homo sapiens
tggaacactttatgttgaactgtggtagaggaaacaagacagttctgtctgcagaagcccattatggctgtaactggagatgacacagatgaggaaactgaacttgccccaagtcacatggctgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataa

SEQ ID NO: 4426 - DNA, 1030 bp, Homo sapiens
ctaggccccgccccctgacccgcaccttcccgccgcccctccccggttccatttcattgttggattgtggcgcttcactcctgctggcggccggcagggggcggagttcgagcctggatttttttcctcggggcctcccccgggaggccgtcccggcgtgggggaggggaggacggggcgggaggacgcggttcggtcggctgcagcgctacttttggtccggggtcggcagggaggccgcggctaccgcatcacagctgacgtgaggactacgtggggccgctgccggctccgggttgctgggcggcggcgccgctgctgagcggcggtcgggctcgccgtctccacctcctcgcgtccgtaatcagtgacgaggtccgctacgtaaatccctttgcggcggctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaa

SEQ ID NO: 4427 - DNA, 626 bp, Homo sapiens
gtaaaatgctgctgacagatttagagttaactagctcaccactgcctctgcctccaagctgccttttagactgaatagcttttcttgttagccctactttaacatttcttttgaagtggttgtctgcttgaagagggaaacacgtcatgaaactgtaatgcatgaacagaactcaggagttgtctggccagcttagtgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttg

SEQ ID NO: 4428 - DNA, 939 bp, Homo sapiens
atgagcaaatgtgcaaggaaaaaatatattaagacaaatccaagacaaatgaccatggaaacagttgaatcccagcatgatggaagtataacagcttctttgacagagagcaagtctgctcatgtgcagactcagactggccaaaattcaatccctgctttagctcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacattgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaagatgaggaaactgaacttgccccaagtcacatggctgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactag

SEQ ID NO: 4429 - DNA, 660 bp, Homo sapiens
atgtggtggcatcagcataatctatgtttcaggcgtcctatagaagaggattattcttcaggggatgtggaagaaaaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacaatgaggaaactgaacttgccccaagtcacatggctgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactag

SEQ ID NO: 4430 - DNA, 429 bp, Homo sapiens
tggaacactttatgttgaactgtggtagaggaaacaagacagttctgtctgcagaagcccattatggctgtaactggagatgacacagatgaggaaactgaacttgccccaagtcacatggctgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactag

SEQ ID NO: 4431 - DNA, 1049 bp, Homo sapiens
actttatgttgaactgtggtagaggaaacaagacagttctgtctgcagaagcccattatggctgtaactggagatgacacagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaa

SEQ ID NO: 4432 - DNA, 651 bp, Homo sapiens
gagtcatgttgtgatttagtcagttcctttccgctttgtaaaatgctgctgacagatttagagttaactagctcaccactgcctctgcctccaagctgccttttagactgaatagcttttcttgttagccctactttaacatttcttttgaagtggttgtctgcttgaagagggaaacacgtcatgaaactgtaatgcatgaacagaactcaggagttgtctggccagcttagtggtaagatcgagcctcctactgaggccgtccctgcatgcgcctgatgaggaaactgaacttgccccaagtcacatggctgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaa

SEQ ID NO: 4433 - DNA, 731 bp, Homo sapiens
cgccccacgcccgcttcgtgcgctcagctgccccgggacccgcctgcctcctcgcgaacttgggacgagttggaaaatcctccctgagagagccgtgcggctcaggggagcggtttaactcggaaaaggaaaaggaatccagaaacaaatgaccatggaaacagttgaatcccagcatgatggaagtataacagcttctttgacagagagcaagtctgctcatgtgcagactcagactggccaaaattcaatccctgctttagctcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacagtatgtatgctgcaattcgatatgatacagtgctagctttaagtcttctctagttatattgaagcaactcaggttttggcattaaattgttccattttaaaatgcatcattaatacctaaactgtatcatagaatgaaagtatatgttaaaaagtgagatctttgtattgacagctgtcatataattttgaaaagtaaaaattttgactgccgaatatagaa

SEQ ID NO: 4434 - DNA, 618 bp, Homo sapiens
atgaccatggaaacagttgaatcccagcatgatggaagtataacagcttctttgacagagagcaagtctgctcatgtgcagactcagactggccaaaattcaatccctgctttagctcaggtagttgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactag

SEQ ID NO: 4435 - DNA, 813 bp, Homo sapiens
atgaccatggaaacagttgaatcccagcatgatggaagtataacagcttctttgacagagagcaagtctgctcatgtgcagactcagactggccaaaattcaatccctgctttagctcaggtttctgtggctggatcaggcaccagaagaggctccccagctgtaactctagtgcagttaccttcgggccaaactatacatgtccagggagtaattcagacaccacagccatgggttattcagtcatcagaaatacacaccgttcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacactgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactag

SEQ ID NO: 4436 - DNA, 469 bp, Homo sapiens
cttttgaagtggttgtctgcttgaagagggaaacacgtcatgaaactgtaatgcatgaacagaactcaggagttgtctggccagcttagtgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaa

SEQ ID NO: 4437 - DNA, 465 bp, Homo sapiens
atgaccatggaaacagttgaatcccagcatgatggaagtataacagcttctttgacagagagcaagtctgctcatgtgcagactcagactggccaaaattcaatccctgctttagctcaggtagatgaggaaactgaacttgccccaagtcacatggctgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactag

SEQ ID NO: 4438 - DNA, 5162 bp, Homo sapiens
gccattttcgcgggcggaggcggcccggcgggccctgggagagctgggacgggcggcggccgggtggcctcggccacccgctaattgcatcttttcccggcgtctcgtctgcagagggagcactatgtctgcggaagtccccgaggcagcctccgcggaggagcagaaggaaatggaagataaagtgactagtccagagaaagcagaagaagcaaaattaaaagcaagatatcctcatctgggacaaaagcctggaggttcagatttcttaaggaaacggttgcagaaagggcaaaaatattttgattctggggattacaacatggctaaagcaaaaatgaagaacaagcaacttcctactgcagctccggataagacggaggtcactggtgaccacattcccactccgcaagaccttcctcaacggaagccgtcccttgttgctagcaagctggctggctgattaagaggctgaactgcatgaatctgctaaatctcattatttctccttaatatgttacttatctactttttatttcctttcattcactagtcatttgagactgacagctttgcaggtagcagtagtgtgtgctgctattgtggaatatacgtgtgtagagtttttgattagtttaacagtgcactggtgaagaggacatgttagagcaacataagtaaactacttgaaaatagttgtatatattacctaacttctagtgtagtactggttctaacaagtaacaagcaagttttaaaattttaatgttttggctttcattacttcatcttaattatagctttgtatgttactcttatttaatataatctctattgtattgatttcttctgtatttaccttttggattttgtaaaacagaagtttaagaccacaagttagaagaaaggtcacatatttcaaacacaactagatggggctctgaaagatttgtatctctgtgcttgaacttgaatggccttaaacctgtttcagctttaacagtagaattttacttgggcaatatttgcccattctggtgtaacttatgtgactctagtgcttaacagctgccgttgaagctaatattcagttctgtagagttagaataccttttgttgttgaagatgtgaatgaagtatgcatgtgcattaactgttgaattcacttttgtgccatttttgtaaatacagtagttttgcacaacctctcacaaatgtctgtattaatttcacatacttaaaaagtagataatgtgccaaccagaagcacaagagttcctacacaaaactctgtaaatcattatagcttttgtataataagagtagtttacaatctcgggcttatagaataccaaactgaaatcttagttcaatctgccatagacttaagcttttcatttgttactaatatccatgacattcagtggccttgtgcaaatacgatatgttgcttaggcatatcttttgtcctatgcagaacctttcattttgatttttatgaaagttgcaattcatgtaatttatataaactttttaaatgtagaaactttttacttccacactcagttttggagaccctagaataaaaggcttcaatactctgcattccatgccctctgccacctgcttttttttcccctttgttctttgactcaaatggtattgagctgtttgttgtatatggaagcataggtgtctatatccttactcttttatataacacaataatggcgttttccttctaatttctcagttgttaacttctttctcttttttttttaggatagggccttgctctgtcacctgagctctagtgcagtagtgcaatcacagctcactgcaaccttactcctaggctcaagttaactattcttgatcctttattattactaatattctacaattgtttaaataaaaggaactttataatgaaacggttcggaatactggctcaagaacctatgtcaagatgagctgaattttggtaaattattttaggaattatgacaagctaattgaattaggcttgtgacaattagagtaatttacatgacaggtaaaactcctattaaaaatgtttagatgtttgcttctgtagatgtcactttagtaaaataccaatttagttttacttgtggcttatctagttagaacttagcagactttactgggacaagtttactgctcttgtaggagctcctctcacaagtagttgtaatgctgtagcatgatactcaggatcagtagcttgagatgctactatttttctcttcatctttgacttgcagagagcctcccgtttttggatccaggcatcttttctgaatcctggttccatcagtatacctgctctcctatgaccccaaatcatagtcaatggtgcctcaaacatagcaccttaagttaaaggctgcctagtgctctgaggaaagcttgctgattatcttcctgatctactcaccccaaaaggcagaaaagcaacacagtcactgctgtggtcatttgtaatgtaaagatcagttatatatatatatttgtaatgagagcaagtatatactcattatagaatcaatttaagaagtttaaaataacccagagtagaatttctatatctagtcttggtttttttcatgaatatttgcaagtaattaccattaaattcacacatgaaagattaatctgaaagatcagagaccatgttattcctgaccacgatagaactgctcctgtggtttgggacaagtaataaaacaactgcttgagttttgtttgtaaaatacataattaatatttgacctacctcaaaatgtattgaggatctgtgaaatgctaagtgcccaaaataaaatattgctgattgtctttttattaaaagtaaatttcctcattaagccaacctgccttctgtaagtcacagtgcttaaatctcaggatttttcattaggagagacctgtcgttaaggatttgtaggtataattgcttagcctccattattggtgcttgggatagagaggttttagatttttgttttttttttgttctgcctcaaagctcagtttattgaagacatttgtaagctattggatcatcacttgaatcaagattttgactagtgagcttaattgtccatttcttacaatttcaaagttacagtctcagaaatggttaattttaataactgtcctatcataaattaatgttggaataaattgaagttgttgataaatacttcatgaaaactaaagtctgaaataaattacttgttttatgtccaatagctactacatttgatagaacagttttgaggaacatttcattcttgaacgcagcatctgacatggttctcagcaagttggaatagtaaggattattggcttgtttcgatgagtggaagcggcatgtttgtagcatacaagttattcaataatcttgtgctgatgacctaaaaatatgtcttaactattcatcaaggaaagcctggtgaagcctttacttgttactacttcaacagttggaattagttgctctttttacttgatgaaacaaaactatacctctgaatatttatggatactttttactaaatcaggcttgtgttcttaatccaaattagtaaagttttatggaagctgaaatgtaatacagtagtctccccttatctgtaagagatacattccaagacccctagtggatgcctgaaacctcagatagtactgaaccctttatcaactatgttttttcagtctgacaaccaaggcggctactaagtgactaaggggcaggtagtatacagtgtggataagcaggacaaaggggtgattcacatcccaggcaggacagagcaggagatcatgagatttcatcactcaggatggcttgtgatttattttattttattcttttttttttttgagatggagtctcactcttgcccaggctggagtgcagtggtgcgatcttggctcactgcaacctctgcctcctgggttcaagcagttctcctgcctcagcctcccaagtagctgggattacaggcgtccgccaccatgcccagccaatttttgtacttttagtagagatggggtttcaccatgttggccaggctggtctcgaactcctgacctcaggtgatccactcgcctcggcctcccaaagtgctgggattataggcatgtgccaccatgcccggccggcttatgatttaaaacatgaattgtttatttctggaattttccacataatatttttggaccaaggttgcctcaggtaacaaactacagaaagtgaaattgcagataaaggggattactgctcctctgctctaaaattggtgtttgggtgatcagaagcaggtagccaatgggaagagcacttctgagtgataactaaagcagtttggtggccttttcacattctccaatgttcaaacatattttccactttccattttctctttcacctcattttgcctctctatcccccatccctgcttatttcttaagcccattgatggcactcattaaattgtatttagggctaatgagtcattgttccttaatatcgttttcaatatgccacaatttaggacacatttaaaattttctaaaacaatatcctaatcaatattgactaatttgagccacattcccaactctaactcagcacacactgccagtcttccccaatatctgtctcctctcaattccccaccacaccttataaaattgtaatcaaagatatctcactctgtcattgttaatctaagaataaaaacactgactttaatacggttttactaagtttcaaccttctaattaggtaggcctctaggtattctgcagatcactgctggtcttgatagccattaatatatgtttgtattatgttatttttcaactaaatcgcagttggaaaaaaacatatttaatattatgcccttggatctgttactgcatcactagcacttgtgatgcaatagaacacttcgcctgtactgaaagggccaagagtaaatgccttgttttgtttttttgttttgttttgttttgctttttgttaaaacatgtctatagagttggcagttaatgctgaatttgtcaaataccccttccaaaattatacttgtatttaaaaaataaatggatctacctaatttctattg

SEQ ID NO: 4439 - DNA, 2821 bp, Homo sapiens
tggatgttctgtgctctcaggaaggcgtgttgagtagccggcacggcgaggcccgtgctggccgtttcttcccggagttttcgtttctgtaccccactttgtgtttactgcggcaggaggcgccagctagcccacaggctgttcggcctagggggtcgtaccttcctaacttcaccactctctgggaagacaccgcacccacagtagggtcgctcgggcctcgcgggctgcacctgtctctgcggagttcccccggcgcgggcggacgtcacacaggggcgttccagcactccgggagcccgattgcgagtttgtgagagtccttggtggaggaggttggaaagcgttctccctcccacaaaacccggtgcagagggagggagagccaggtccgtagcgtgggtccaagaaactatggatcctggaagtgagcacacttttgtgtcttaaaaagtttggtgtctcgttttgaggtgaaaaatgaatgagataagtgctttttaaaaagaacgaaataaagaattttgaaagggaaaatgagtatgaatccacactttgtgaagatgcttatggcacactagacaatttgttaaatgataacaacattgaaaattactcaacgaatgcactaattcagccagttgacaccatcagcatatcttccttgagacaatttgaaaccgtttgcaaatttcactgggtagaagcatttgatgatgaaatgacagagaagccagaatttcaaagtcaagtgtataattatgcaaaagacaacaatataaagcaagactcatttaaggaagaaaatccaatggaaactagtgtttctgcaaatacagaccaacttggtaacgagtattttagacagcctcctcctagaagcccgcctctaatccactgcagtggagagatgctgaaatttacagaaaagtcactggctaaaagtattgccaaggaatctgccctcaaccctagccaacctccaagcttcttatgtaagactgcagttccttcaaaagaaatacagaattatggggagattcctgagatgtcagtcagttatgaaaaggaagtcacagcagagggtgtggagaggccagaaattgtctcaacttggtcttcggcaggcatttcctggaggagtgaagcatgtcgggagaactgtgagatgcctgactgggagcaaagtgctgaaagcttacaacctgttcaagaggacatggctttaaatgaagtcttgcagaaattaaaacatactaacagaaagcaggaagtgcgaatccaagaactccagtgtagtaacctgtatttagagaagagggttaaagaactacagatgaagattaccaaacagcaagtgttcattgatgtcatcaataagctaaaggagaatgttgaagaattaattgaagacaaatacaaaataatcctagagaagaatgatactaaaaagacattgcagaatttggaagaggttttagctaacacgcaaaaacatcttcaggaatccaggaatgacaaggaaatgttacagcttcaatttaagaagatcaaggctaattatgtgtgtttacaggaaaggtacatgactgaaatgcaacaaaaaaataaatctgtaagtcagtatttagagatggacaaaaccttaagcaagaaagaagaagaggtagagagactacaacaactcaaaaaagaactggaaaaggccacagcttctgctttggacttgttgaaacgggaaaaagaggcccaagaacaagagttcttgtctttacaggaggaattccagaaacttgaaaaggaaaacctggaagaaagacagaaactgaaatctagacttgagaaattgctcactcaagttagaaatttgcaatttatgtctgaaaatgaaagaacgaagaatataaaacttcagcagcaaatcaacgaagtaaaaaatgagaatgcaaaacttaaacagcaggttgcaaggagtgaagagcaaaattatgtccctaaatttgagacagctcagttaaaggatcaattagaggaagtcttgaagtcagatattaccaaggatacaaaaacgacacattctaatctgctcccggattgctcaccttgtgaagagaggctgaatcctgcagatataaaaagagcttctcagctggcctccaaaatgcacagtcttctggctctgatggtgggacttctcacatgccaggacatcatcaattctgatgctgaacatttcaaagagagtgagaaggttagtgatataatgctgcaaaaactgaagagcctccatcttaaaaagaaaactttagataaagaggtcatagactgtgattcagatgaagccaagagtatcagagatgtacctacccttctgggagccaaactggataagtaccacagtctaaatgaggagcttgatttcttggttacatcatatgaagaaatcattgaatgtgctgaccaaaggcttgcaatatcccactcccagattgcacatttggaagagagaaataaacatttagaggatttaattagaaagcccagagaaaaagccagaaaaccaagatcaaaaagcttagaaaatcatccgaagtccatgaccatgatgccagctctttttaaagaaaatagaaatgatttagattaaacaagcctgaagattaaacagtaatcatttttgtcaaccactccaggaagagtcattactacatatgctagccaaatcaatccatgcagatgatatattaaaatctgtataaagggtaaagtcttacattccaaagatgtgattacttttcttctaatttcttcctgtgaataa

SEQ ID NO: 4440 - DNA, 2771 bp, Homo sapiens
ttgcgagtttgtgagagtccttggtggaggaggttggaaagcgttctccctcccacaaaacccggtgcagagggagggagagccaggtccgtagcgtgggtccaagaaactatggatcctggaagtgagcacacttttgtgtcttaaaaagtttggtgtctcgttttgaggtgaaaaatgaatgagataagtgctttttaaaaagaagtcttctattgttcaacagttatgaacaaggactatcaaaaattttggtcatcaccttcagatcctgtacattttgaagtggatacttctcatgaaaaagtagaaagcatgtcagaatcggataccatgaatgtcagcaatctttctcaaggtgtaatgctttcacattctccaatctgtatggaaaccaccggcaccacttgtgacttgcctcagaacgaaataaagaattttgaaagggaaaatgagtatgaatccacactttgtgaagatgcttatggcacactagacaatttgttaaatgataacaacattgaaaattactcaacgaatgcactaattcagccagttgacaccatcagcatatcttccttgagacaatttgaaaccgtttgcaaatttcactgggtagaagcatttgatgatgaaatgacagagaagccagaatttcaaagtcaagtgtataattatgcaaaagacaacaatataaagcaagactcatttaaggaagaaaatccaatggaaactagtgtttctgcaaatacagaccaacttggtaacgagtattttagacagcctcctcctagaagcccgcctctaatccactgcagtggagagatgctgaaatttacagaaaagtcactggctaaaagtattgccaaggaatctgccctcaaccctagccaacctccaagcttcttatgtaagactgcagttccttcaaaagaaatacagaattatggggagattcctgagatgtcagtcagttatgaaaaggaagtcacagcagagggtgtggagaggccagaaattgtctcaacttggtcttcggcaggcatttcctggaggagtgaagcatgtcgggagaactgtgagatgcctgactgggagcaaagtgctgaaagcttacaacctgttcaagaggacatggctttaaatgaagtcttgcagaaattaaaacatactaacagaaagcaggaagtgcgaatccaagaactccagtgtagtaacctgtatttagagaagagggttaaagaactacagatgaagattaccaaacagcaagtgttcattgatgtcatcaataagctaaaggagaatgttgaagaattaattgaagacaaatacaaaataatcctagagaagaatgatactaaaaagacattgcagaatttggaagaggttttagctaacacgcaaaaacatcttcaggaatccaggaatgacaaggaaatgttacagcttcaatttaagaagatcaaggctaattatgtgtgtttacaggaaaggtacatgactgaaatgcaacaaaaaaataaatctgtaagtcagtatttagagatggacaaaaccttaagcaagaaagaagaagaggtagagagactacaacaactcaaaaaagaactggaaaaggccacagcttctgctttggacttgttgaaacgggaaaaagaggcccaagaacaagagttcttgtctttacaggaggaattccagaaacttgaaaaggaaaacctggaagaaagacagaaactgaaatctagacttgagaaattgctcactcaagttagaaatttgcaatttatgtctgaaaatgaaagaacgaagaatataaaacttcagcagcaaatcaacgaagtaaaaaatgagaatgcaaaacttaaacagcaggttgcaaggagtgaagagcaaaattatgtccctaaatttgagacagctcagttaaaggatcaattagaggaagtcttgaagtcagatattaccaaggatacaaaaacgacacattctaatctgctcccggattgctcaccttgtgaagagaggctgaatcctgcagatataaaaagagcttctcagctggcctccaaaatgcacagtcttctggctctgatggtgggacttctcacatgccaggacatcatcaattctgatgctgaacatttcaaagagagtgagaaggttagtgatataatgctgcaaaaactgaagagcctccatcttaaaaagaaaactttagataaagagctactgaaacataaagatagaatcacaacctttagagagttaattgctaaggaaaaagcatttcaagatcatgctattaaggtcatagactgtgattcagatgaagccaagagtatcagagatgtacctacccttctgggagccaaactggataagtaccacagtctaaatgaggagcttgatttcttggttacatcatatgaagaaatcattgaatgtgctgaccaaaggcttgcaatatcccactcccagattgcacatttggaagagagaaataaacatttagaggatttaattagaaagcccagagaaaaagccagaaaaccaagatcaaaaagcttagaaaatcatccgaagtccatgaccatgttggcatataacttgtacatatttataggatacaggctgggcgcggtggctgacgcctgtaatcccagcactttgggaggccgaggcgggtggatcacttgagttcaggagttcaagaccagcctgaccaacatggggaaccctcgtctctattaaaaatacagaaaatt

SEQ ID NO: 4441 - DNA, 3069 bp, Homo sapiens
tggatgttctgtgctctcaggaaggcgtgttgagtagccggcacggcgaggcccgtgctggccgtttcttcccggagttttcgtttctgtaccccactttgtgtttactgcggcaggaggcgccagctagcccacaggctgttcggcctagggggtcgtaccttcctaacttcaccactctctgggaagacaccgcacccacagtagggtcgctcgggcctcgcgggctgcacctgtctctgcggagttcccccggcgcgggcggacgtcacacaggggcgttccagcactccgggagcccgattgcgagtttgtgagagtccttggtggaggaggttggaaagcgttctccctcccacaaaacccggtgcagagggagggagagccaggtccgtagcgtgggtccaagaaactatggatcctggaagtgagcacacttttgtgtcttaaaaagtttggtgtctcgttttgaggtgaaaaatgaatgagataagtgctttttaaaaagaagtcttctattgttcaacagttatgaacaaggactatcaaaaattttggtcatcaccttcagatcctgtacattttgaagtggatacttctcatgaaaaagtagaaagcatgtcagaatcggataccatgaatgtcagcaatctttctcaaggtgtaatgctttcacattctccaatctgtatggaaaccaccggcaccacttgtgacttgcctcagaacgaaataaagaattttgaaagggaaaatgagtatgaatccacactttgtgaagatgcttatggcacactagacaatttgttaaatgataacaacattgaaaattactcaacgaatgcactaattcagccagttgacaccatcagcatatcttccttgagacaatttgaaaccgtttgcaaatttcactgggtagaagcatttgatgatgaaatgacagagaagccagaatttcaaagtcaagtgtataattatgcaaaagacaacaatataaagcaagactcatttaaggaagaaaatccaatggaaactagtgtttctgcaaatacagaccaacttggtaacgagtattttagacagcctcctcctagaagcccgcctctaatccactgcagtggagagatgctgaaatttacagaaaagtcactggctaaaagtattgccaaggaatctgccctcaaccctagccaacctccaagcttcttatgtaagactgcagttccttcaaaagaaatacagaattatggggagattcctgagatgtcagtcagttatgaaaaggaagtcacagcagagggtgtggagaggccagaaattgtctcaacttggtcttcggcaggcatttcctggaggagtgaagcatgtcgggagaactgtgagatgcctgactgggagcaaagtgctgaaagcttacaacctgttcaagaggacatggctttaaatgaagtcttgcagaaattaaaacatactaacagaaagcaggaagtgcgaatccaagaactccagtgtagtaacctgtatttagagaagagggttaaagaactacagatgaagattaccaaacagcaagtgttcattgatgtcatcaataagctaaaggagaatgttgaagaattaattgaagacaaatacaaaataatcctagagaagaatgatactaaaaagacattgcagaatttggaagaggttttagctaacacgcaaaaacatcttcaggaatccaggaatgacaaggaaatgttacagcttcaatttaagaagatcaaggctaattatgtgtgtttacaggaaaggtacatgactgaaatgcaacaaaaaaataaatctgtaagtcagtatttagagatggacaaaaccttaagcaagaaagaagaagaggtagagagactacaacaactcaaaaaagaactggaaaaggccacagcttctgctttggacttgttgaaacgggaaaaagaggcccaagaacaagagttcttgtctttacaggaggaattccagaaacttgaaaaggaaaacctggaagaaagacagaaactgaaatctagacttgagaaattgctcactcaagttagaaatttgcaatttatgtctgaaaatgaaagaacgaagaatataaaacttcagcagcaaatcaacgaagtaaaaaatgagaatgcaaaacttaaacagcaggttgcaaggagtgaagagcaaaattatgtccctaaatttgagacagctcagttaaaggatcaattagaggaagtcttgaagtcagatattaccaaggatacaaaaacgacacattctaatctgctcccggattgctcaccttgtgaagagaggctgaatcctgcagatataaaaagagcttctcagctggcctccaaaatgcacagtcttctggctctgatggtgggacttctcacatgccaggacatcatcaattctgatgctgaacatttcaaagagagtgagaaggttagtgatataatgctgcaaaaactgaagagcctccatcttaaaaagaaaactttagataaagaggtcatagactgtgattcagatgaagccaagagtatcagagatgtacctacccttctgggagccaaactggataagtaccacagtctaaatgaggagcttgatttcttggttacatcatatgaagaaatcattgaatgtgctgaccaaaggcttgcaatatcccactcccagattgcacatttggaagagagaaataaacatttagaggatttaattagaaagcccagagaaaaagccagaaaaccaagatcaaaaagcttagaaaatcatccgaagtccatgaccatgatgccagctctttttaaagaaaatagaaatgatttagattaaacaagcctgaagattaaacagtaatcatttttgtcaaccactccaggaagagtcattactacatatgctagccaaatcaatccatgcagatgatatattaaaatctgtataaagggtaaagtcttacattccaaagatgtgattacttttcttctaatttcttcctgtgaataatcaaatatattctatttaacataaacagaa

SEQ ID NO: 4442 - DNA, 2634 bp, Homo sapiens
tggatgttctgtgctctcaggaaggcgtgttgagtagccggcacggcgaggcccgtgctggccgtttcttcccggagttttcgtttctgtaccccactttgtgtttactgcggcaggaggcgccagctagcccacaggctgttcggcctagggggtcgtaccttcctaacttcaccactctctgggaagacaccgcacccacagtagggtcgctcgggcctcgcgggctgcacctgtctctgcggagttcccccggcgcgggcggacgtcacacaggggcgttccagcactccgggagcccgattgcgagtttgtgagagtccttggtggaggaggttggaaagcgttctccctcccacaaaacccggtgcagagggagggagagccaggtccgtagcgtgggtccaagaaactatggatcctggaagtgagcacacttttgtgtcttaaaaagtttggtgtctcgttttgaggtgaaaaatgaatgagataagtgctttttaaaaagaagtcttctattgttcaacagttatgaacaaggactatcaaaaattttggtcatcaccttcagatcctgtacattttgaagtggatacttctcatgaaaaagtagaaagcatgtcagaatcggataccatgaatgtcagcaatctttctcaaggtgtaatgctttcacattctccaatctgtatggaaaccaccggcaccacttgtgacttgcctcagaacgaaataaagaattttgaaagggaaaatgagtatgaatccacactttgtgaagatgcttatggcacactagacaatttgttaaatgataacaacattgaaaattactcaacgaatgcactaattcagccagttgacaccatcagcatatcttccttgagacaatttgaaaccgtttgcaaatttcactgggtagaagcatttgatgatgaaatgacagagaagccagaatttcaaagtcaagtgtataattatgcaaaagacaacaatataaagcaagactcatttaaggaagaaaatccaatggaaactagtgtttctgcaaatacagaccaacttggtaacgagtattttagacagcctcctcctagaagcccgcctctaatccactgcagtggagagatgctgaaatttacagaaaagtcactggctaaaagtattgccaaggaatctgccctcaaccctagccaacctccaagcttcttatgtaagactgcagttccttcaaaagaaatacagaattatggggagattcctgagatgtcagtcagttatgaaaaggaagtcacagcagagggtgtggagaggccagaaattgtctcaacttggtcttcggcaggcatttcctggaggagtgaagcatgtcgggagaactgtgagatgcctgactgggagcaaagtgctgaaagcttacaacctgttcaagaggacatggctttaaatgaagtcttgcagaaattaaaacatactaacagaaagcaggaagtgcgaatccaagaactccagtgtagtaacctgtatttagagaagagggttaaagaactacagatgaagattaccaaacagcaagtgttcattgatgtcatcaataagctaaaggagaatgttgaagaattaattgaagacaaatacaaaataatcctagagaagaatgatactaaaaagacattgcagaatttggaagaggttttagctaacacgcaaaaacatcttcaggaatccaggaatgacaaggaaatgttacagcttcaatttaagaagatcaaggctaattatgtgtgtttacaggaaaggtacatgactgaaatgcaacaaaaaaataaatctgtaagtcagtatttagagatggacaaaaccttaagcaagaaagaagaagaggtagagagactacaacaactcaaaaaagaactggaaaaggccacagcttctgctttggacttgttgaaacgggaaaaagaggcccaagaacaagagttcttgtctttacaggaggaattccagaaacttgaaaaggaaaacctggaagaaagacagaaactgaaatctagacttgagaaattgctcactcaagttagaaatttgcaatttatgtctgaaaatgaaagaacgaagaatataaaacttcagcagcaaatcaacgaagtaaaaaatgagaatgcaaaacttaaacagcaggttgcaaggagtgaagagcaaaattatgtccctaaatttgagacagctcagttaaaggatcaattagaggaagtcttgaagtcagatattaccaaggatacaaaaacgacacattctaatctgctcccggattgctcaccttgtgaagagaggctgaatcctgcagatataaaaagagcttctcagctggcctccaaaatgcacagtcttctggctctgatggtgggacttctcacatgccaggacatcatcaattctgatgctgaacatttcaaagagagtgagaaggttagtgatataatgctgcaaaaactgaagagcctccatcttaaaaagaaaactttagataaagagctactgaaacataaagatagaatcacaacctttagagagttaattgctaaggaaaaagcatttcaagatcatgctattaaggtattccaaggagtatga

SEQ ID NO: 4443 - DNA, 3284 bp, Homo sapiens
cggagctctctggatggcgcgctgtatagggctgtggatgttctgtgctctcaggaaggcgtgttgagtagccggcacggcgaggcccgtgctggccgtttcttcccggagttttcgtttctgtaccccactttgtgtttactgcggcaggaggcgccagctagcccacaggctgttcggcctagggggtcgtaccttcctaacttcaccactctctgggaagacaccgcacccacagtagggtcgctcgggcctcgcgggctgcacctgtctctgcggagttcccccggcgcgggcggacgtcacacaggggcgttccagcactccgggagcccgattgcgagtttgtgagagtccttggtggaggaggttggaaagcgttctccctcccacaaaacccggtgcagagggagggagagccaggtccgtagcgtgggtccaagaaactatggatcctggaagtgagcacacttttgtgtcttaaaaagtttggtgtctcgttttgaggtgaaaaatgaatgagataagtgctttttaaaaagaagtcttctattgttcaacagttatgaacaaggactatcaaaaattttggtcatcaccttcagatcctgtacattttgaagtggatacttctcatgaaaaagtagaaagcatgtcagaatcggataccatgaatgtcagcaatctttctcaaggtgtaatgctttcacattctccaatctgtatggaaaccaccggcaccacttgtgacttgcctcagaacgaaataaagaattttgaaagggaaaatgagtatgaatccacactttgtgaagatgcttatggcacactagacaatttgttaaatgataacaacattgaaaattactcaacgaatgcactaattcagccagttgacaccatcagcatatcttccttgagacaatttgaaaccgtttgcaaatttcactgggtagaagcatttgatgatgaaatgacagagaagccagaatttcaaagtcaagtgtataattatgcaaaagacaacaatataaagcaagactcatttaaggaagaaaatccaatggaaactagtgtttctgcaaatacagaccaacttggtaacgagtattttagacagcctcctcctagaagcccgcctctaatccactgcagtggagagatgctgaaatttacagaaaagtcactggctaaaagtattgccaaggaatctgccctcaaccctagccaacctccaagcttcttatgtaagactgcagttccttcaaaagaaatacagaattatggggagattcctgagatgtcagtcagttatgaaaaggaagtcacagcagagggtgtggagaggccagaaattgtctcaacttggtcttcggcaggcatttcctggaggagtgaagcatgtcgggagaactgtgagatgcctgactgggagcaaagtgctgaaagcttacaacctgttcaagaggacatggctttaaatgaagtcttgcagaaattaaaacatactaacagaaagcaggaagtgcgaatccaagaactccagtgtagtaacctgtatttagagaagagggttaaagaactacagatgaagattaccaaacagcaagtgttcattgatgtcatcaataagctaaaggagaatgttgaagaattaattgaagacaaatacaaaataatcctagagaagaatgatactaaaaagacattgcagaatttggaagaggttttagctaacacgcaaaaacatcttcaggaatccaggaatgacaaggaaatgttacagcttcaatttaagaagatcaaggctaattatgtgtgtttacaggaaaggtacatgactgaaatgcaacaaaaaaataaatctgtaagtcagtatttagagatggacaaaaccttaagcaagaaagaagaagaggtagagagactacaacaactcaaaaaagaactggaaaaggccacagcttctgctttggacttgttgaaacgggaaaaagaggcccaagaacaagagttcttgtctttacaggaggaattccagaaacttgaaaaggaaaacctggaagaaagacagaaactgaaatctagacttgagaaattgctcactcaagttagaaatttgcaatttatgtctgaaaatgaaagaacgaagaatataaaacttcagcagcaaatcaacgaagtaaaaaatgagaatgcaaaacttaaacagcaggttgcaaggagtgaagagcaaaattatgtccctaaatttgagacagctcagttaaaggatcaattagaggaagtcttgaagtcagatattaccaaggatacaaaaacgacacattctaatctgctcccggattgctcaccttgtgaagagaggctgaatcctgcagatataaaaagagcttctcagctggcctccaaaatgcacagtcttctggctctgatggtgggacttctcacatgccaggacatcatcaattctgatgctgaacatttcaaagagagtgagaaggttagtgatataatgctgcaaaaactgaagagcctccatcttaaaaagaaaactttagataaagagctactgaaacataaagatagaatcacaacctttagagagttaattgctaaggaaaaagcatttcaagatcatgctattaaggtcatagactgtgattcagatgaagccaagagtatcagagatgtacctacccttctgggagccaaactggataagtaccacagtctaaatgaggagcttgatttcttgatcacaaaactgggacatctcctagagtcaaaagaaaaccactgcaacagactcattgaagaaaatgacaagtatcaaagacatttaggcaacttaataaagaaggttacatcatatgaagaaatcattgaatgtgctgaccaaaggcttgcaatatcccactcccagattgcacatttggaagagagaaataaacatttagaggatttaattagaaagcccagagaaaaagccagaaaaccaagatcaaaaagcttagaaaatcatccgaagtccatgaccatgatgccagctctttttaaagaaaatagaaatgatttagattaaacaagcctgaagattaaacagtaatcatttttgtcaaccactccaggaagagtcattactacatatgctagccaaatcaatccatgcagatgatatattaaaatctgtataaagggtaaagtcttacattccaaagatgtgattacttttcttctaatttcttcctgtgaataatcaaatatattctatttaacataaa

SEQ ID NO: 4444 - DNA, 4180 bp, Homo sapiens
aatccgggtcggccgcaaacgtgccgcaggcctaggccccgcccagtgccccgcccctcccccaacacacacacacacacacacacacacacacaccccaacacacacacacacaccccaacacacacacacacacacacacacacacacacacacacacacacacacacacacacagcgggatggccgagcgccgcacgcgtagcacgccgggactagctatccagcctcccagcagcctctgcgacgggcgcggtgcgtaagtacctcgccggtggtggccgttctccgtaagatggcggaccggcggcggcagcgcgcttcgcaagacaccgaggacgaggaatctggtgcttcgggctccgacagcggcggctccccgttgcggggaggcgggagctgcagcggtagcgccggaggcggcggcagcggctctctgccttcacagcgcggaggccgaaccggggcccttcatctgcggcgggtggagagcgggggcgccaagagtgctgaggagtcggagtgtgagagtgaagatggcattgaaggtgatgctgttctctcggattatgaaagtgcagaagactcggaaggtgaagaaggtgaatacagtgaagaggaaaactccaaagtggagctgaaatcagaagctaatgatgctgttaattcttcaacaaaagaagagaagggagaagaaaagcctgacaccaaaagcactgtgactggagagaggcaaagtggggacggacaggagagcacagagcctgtggagaacaaagtgggtaaaaagggccctaagcatttggatgatgatgaagatcggaagaatccagcatacatacctcggaaagggctcttctttgagcatgatcttcgagggcaaactcaggaggaggaagtcagacccaaggggcgtcagcgaaagctatggaaggatgagggtcgctgggagcatgacaagttccgggaagatgagcaggccccaaagtcccgacaggagctcattgctctttatggttatgacattcgctcagctcataatcctgatgacatcaaacctcgaagaatccggaaaccccgatatgggagtcctccacaaagagatccaaactggaacggtgagcggctaaacaagtctcatcgccaccagggtcttgggggcaccctaccaccaaggacatttattaacaggaatgctgcaggtaccggccgtatgtctgcacccaggaattattctcgatctgggggcttcaaggaaggtcgtgctggttttaggcctgtggaagctggtgggcagcatggtggccggtctggtgagactgttaagcatgagattagttaccggtcacggcgcctagagcagacttctgtgagggatccatctccagaagcagatgctccagtgcttggcagtcctgagaaggaagaggcagcctcagagccaccagctgctgctcctgatgctgcaccaccaccccctgataggcccattgagaagaaatcctattcccgggcaagaagaactcgaaccaaagttggagatgcagtcaagcttgcagaggaggtgccccctcctcctgaaggactgattccagcacctccagtcccagaaaccaccccaactccacctactaagactgggacctgggaagctccggtggattctagtacaagtggacttgagcaagatgtggcacaactaaatatagcagaacagaattggagtccggggcagccttctttcctgcaaccacgggaacttcgaggtatgcccaaccatatacacatgggagcaggacctccacctcagtttaaccggatggaagaaatgggtgtccagggtggtcgagccaaacgctattcatcccagcggcaaagacctgtgccagagccccccgcccctccagtgcatatcagtatcatggagggacattactatgatccactgcagttccagggaccaatctatacccatggtgacagccctgccccgctgcctccacagggcatgcttgtgcagccaggaatgaaccttccccacccaggtttacatccccaccagacaccagctcctctgcccaatccaggcctctatcccccaccagtgtccatgtctccaggacagccaccacctcagcagttgcttgctcctacttacttttctgctccaggcgtcatgaactttggtaatcccagttacccttatgctccaggggcactgcctcccccaccaccgcctcatctgtatcctaatacacaggccccatcacaggtatatggaggagtgacctactataaccccgcccagcagcaggtgcagccaaagccctccccaccccggaggactccccagccagtcaccatcaagccccctccacctgaggttgtaagcaggggttccagttaatacaagtttctgaatattttaaatcttaacatcatataaaaagcagcagaggtgagaactcagaagagaaatacagctggctatctactaccagaagggcttcaaagatatagggtgtggctcctaccagcaaacagctgaaagaggaggacccctgccttcctctgaggacaggctctagagagagggagaaacaagtggacctcgtcccatcttcactcttcacttgagttggctgtgttcgggggagcagagagagccagacagccccaagcttctgagtctagatacagaagcccatgtcttctgctgttcttcacttctgggaaattgaagtgtcttctgttcccaaggaagctccttcctgtttgttttgttttctaagatgttcatttttaaagcctggcttcttatccttaatattattttaattttttctctttgtttctgtttcttgctctctctccctgcctttaaatgaaacaagtctagtcttctggttttctagcccctctggattcccttttgactcttccgtgcatcccagataatggagaatgtatcagccagccttccccaccaagtctaaaaagacctggcctttcacttttagttggcatttgttatcctcttgtatacttgtattcccttaactctaaccctgtggaagcatggctgtctgcacagagggtcccattgtgcagaaaagctcagagtaggtgggtaggagcccttctctttgacttaggtttttaggagtctgagcatccatcaatacctgtactatgatgggcttctgttctctgctgagggccaataccctactgtggggagagatggcacaccagatgcttttgtgagaaagggatggtggagtgagagcctttgcctttaggggtgtgtattcacatagtcctcagggctcagtcttttgaggtaagtggaattagagggccttgcttctcttctttccattcttcttgctacaccccttttccagttgctgtggaccaatgcatctctttaaaggcaaatattatccagcaagcagtctaccctgtcctttgcaattgctcttctccacgtctttcctgctacaagtgttttagatgttactaccttattttccccgaattctatttttgtccttgcagacagaatataaaaactcctgggcttaaggcctaaggaagccagtcaccttctgggcaagggctcctatctttcctccctatccatggcactaaaccacttctctgctgcctctgtggaagagattcctattactgcagtacatacgtctgccaggggtaacctggccactgtccctgtccttctacagaacctgagggcaaagatggtggctgtgtctctccccggtaatgtcactgtttttattccttccatctagcagctggcctaatcactctgagtcacaggtgtgggatggagagtggggagaggcacttaatctgtaacccccaaggaggaaataactaagagattcttctaggggtagctggtggttgtgccttttgtaggctgttccctttgccttaaacctgaagatgtctcctcaagcctgtgggcagcatgcccagattcccagaccttaagacactgtgagagttgtctctgttggtccactgtgtttagttgcaaggatttttccatgtgtggtggtgttttttgttactgttttaaagggtgcccatttgtgatcagcattgtgacttggagataataaaatttagactataaacttggctccct

SEQ ID NO: 4445 - DNA, 4895 bp, Homo sapiens
cacacacacacacacacacacacacaccccaacacacacacacacaccccaacacacacacacacacacacacacacacacacacacacacacacacacacacacacagcgggatggccgagcgccgcacgcgtagcacgccgggactagctatccagcctcccagcagcctctgcgacgggcgcggtgcgtaagtacctcgccggtggtggccgttctccgtaagatggcggaccggcggcggcagcgcgcttcgcaagacaccgaggacgaggaatctggtgcttcgggctccgacagcggcggctccccgttgcggggaggcgggagctgcagcggtagcgccggaggcggcggcagcggctctctgccttcacagcgcggaggccgaaccggggcccttcatctgcggcgggtggagagcgggggcgccaagagtgctgaggagtcggagtgtgagagtgaagatggcattgaaggtgatgctgttctctcggattatgaaagtgcagaagactcggaaggtgaagaaggtgaatacagtgaagaggaaaactccaaagtggagctgaaatcagaagctaatgatgctgttaattcttcaacaaaagaagagaagggagaagaaaagcctgacaccaaaagcactgtgactggagagaggcaaagtggggacggacaggagagcacagagcctgtggagaacaaagtgggtaaaaagggccctaagcatttggatgatgatgaagatcggaagaatccagcatacatacctcggaaagggctcttctttgagcatgatcttcgagggcaaactcaggaggaggaagtcagacccaaggggcgtcagcgaaagctatggaaggatgagggtcgctgggagcatgacaagttccgggaagatgagcaggccccaaagtcccgacaggagctcattgctctttatggttatgacattcgctcagctcataatcctgatgacatcaaacctcgaagaatccggaaaccccgatatgggagtcctccacaaagagatccaaactggaacggtgagcggctaaacaagtctcatcgccaccagggtcttgggggcaccctaccaccaaggacatttattaacaggaatgctgcaggtaccggccgtatgtctgcacccaggaattattctcgatctgggggcttcaaggaaggtcgtgctggttttaggcctgtggaagctggtgggcagcatggtggccggtctggtgagactgttaagcatgagattagttaccggtcacggcgcctagagcagacttctgtgagggatccatctccagaagcagatgctccagtgcttggcagtcctgagaaggaagaggcagcctcagagccaccagctgctgctcctgatgctgcaccaccaccccctgataggcccattgagaagaaatcctattcccgggcaagaagaactcgaaccaaagttggagatgcagtcaagcttgcagaggaggtgccccctcctcctgaaggactgattccagcacctccagtcccagaaaccaccccaactccacctactaagactgggacctgggaagctccggtggattctagtacaagtggacttgagcaagatgtggcacaactaaatatagcagaacagaattggagtccggggcagccttctttcctgcaaccacgggaacttcgaggtatgcccaaccatatacacatgggagcaggacctccacctcagtttaaccggatggaagaaatgggtgtccagggtggtcgagccaaacgctattcatcccagcggcaaagacctgtgccagagccccccgcccctccagtgcatatcagtatcatggagggacattactatgatccactgcagttccagggaccaatctatacccatggtgacagccctgccccgctgcctccacagggcatgcttgtgcagccaggaatgaaccttccccacccaggtttacatccccaccagacaccagctcctctgcccaatccaggcctctatcccccaccagtgtccatgtctccaggacagccaccacctcagcagttgcttgctcctacttacttttctgctccaggcgtcatgaactttggtaatcccagttacccttatgctccaggggcactgcctcccccaccaccgcctcatctgtatcctaatacacaggccccatcacaggtatatggaggagtgacctactataaccccgcccagcagcaggtgcagccaaagccctccccaccccggaggactccccagccagtcaccatcaagccccctccacctgaggttgtaagcaggggttccagttaatacaagtttctgaatattttaaatcttaacatcatataaaagtaagtgcacaacttactgtgaatattgttaaaactaatgctcacacttgcttaataaacaaaaatcacttaattaatgctttttttttttttttttttttttttttttttgagacggcgtctcagtctgttatccaggctggagtgcagtggtgcaatctcggctcactgcaacctccatctcctgagttcaagcgattctcttgcctcagcctcctaagtagctaggattacaggcacgcaccaccacacctggctaatttttgtatttttagtgggaatggggtttcaccatattggccaggctggtcttgaactcctgacctcaggtgatccacctgccttggcctcccaaagtgttgggattacaggtgtgagccaccccacccagcctctgattaatgctttaagttataataatcatgggatatctcaggaggcttaaaggagtcctgaaatttgccagtttgtttgtttggcaagtgtattgggcagggttgaagtagaaacgattgttaacatgacagttttcaattgggaagctacaaggaaaaaatacaggaaggcagtcaaggaaaagggaaatctaaatttgagatgttatagcagaaaaaaccagttctaaagatcatagaggagaaggactgggggttttgttgcttttgtttaaggacattacttaaaacacattatttagaagtgtggctttttgaaaacagcttgtgaatgcccagaaggcccactaacactttggtggttcttccctttttccaacccctgtcagagcagcagaggtgagaactcagaagagaaatacagctggctatctactaccagaagggcttcaaagatatagggtgtggctcctaccagcaaacagctgaaagaggaggacccctgccttcctctgaggacaggctctagagagagggagaaacaagtggacctcgtcccatcttcactcttcacttgagttggctgtgttcgggggagcagagagagccagacagccccaagcttctgagtctagatacagaagcccatgtcttctgctgttcttcacttctgggaaattgaagtgtcttctgttcccaaggaagctccttcctgtttgttttgttttctaagatgttcatttttaaagcctggcttcttatccttaatattattttaattttttctctttgtttctgtttcttgctctctctccctgcctttaaatgaaacaagtctagtcttctggttttctagcccctctggattcccttttgactcttccgtgcatcccagataatggagaatgtatcagccagccttccccaccaagtctaaaaagacctggcctttcacttttagttggcatttgttatcctcttgtatacttgtattcccttaactctaaccctgtggaagcatggctgtctgcacagagggtcccattgtgcagaaaagctcagagtaggtgggtaggagcccttctctttgacttaggtttttaggagtctgagcatccatcaatacctgtactatgatgggcttctgttctctgctgagggccaataccctactgtggggagagatggcacaccagatgcttttgtgagaaagggatggtggagtgagagcctttgcctttaggggtgtgtattcacatagtcctcagggctcagtcttttgaggtaagtggaattagagggccttgcttctcttctttccattcttcttgctacaccccttttccagttgctgtggaccaatgcatctctttaaaggcaaatattatccagcaagcagtctaccctgtcctttgcaattgctcttctccacgtctttcctgctacaagtgttttagatgttactaccttattttccccgaattctatttttgtccttgcagacagaatataaaaactcctgggcttaaggcctaaggaagccagtcaccttctgggcaagggctcctatctttcctccctatccatggcactaaaccacttctctgctgcctctgtggaagagattcctattactgcagtacatacgtctgccaggggtaacctggccactgtccctgtccttctacagaacctgagggcaaagatggtggctgtgtctctccccggtaatgtcactgtttttattccttccatctagcagctggcctaatcactctgagtcacaggtgtgggatggagagtggggagaggcacttaatctgtaacccccaaggaggaaataactaagagattcttctaggggtagctggtggttgtgccttttgtaggctgttccctttgccttaaacctgaagatgtctcctcaagcctgtgggcagcatgcccagattcccagaccttaagacactgtgagagttgtctctgttggtccactgtgtttagttgcaaggatttttccatgtgtggtggtgttttttgttactgttttaaagggtgcccatttgtgatcagcattgtgacttggagataataaaatttagactataaacttggctccct

SEQ ID NO: 4446 - DNA, 2173 bp, Homo sapiens
aacacacacacacacacacacacacacacacaccccaacacacacacacacaccccaacacacacacacacacacacacacacacacacacacacacacacacacacacacacagcgggatggccgagcgccgcacgcgtagcacgccgggactagctatccagcctcccagcagcctctgcgacgggcgcggtgcgtaagtacctcgccggtggtggccgttctccgtaagatggcggaccggcggcggcagcgcgcttcgcaagacaccgaggacgaggaatctggtgcttcgggctccgacagcggcggctccccgttgcggggaggcgggagctgcagcggtagcgccggaggcggcggcagcggctctctgccttcacagcgcggaggccgaaccggggcccttcatctgcggcgggtggagagcgggggcgccaagagtgctgaggagtcggagtgtgagagtgaagatggcattgaaggtgatgctgttctctcggattatgaaagtgcagaagactcggaaggtgaagaaggtgaatacagtgaagaggaaaactccaaagtggagctgaaatcagaagctaatgatgctgttaattcttcaacaaaagaagagaagggagaagaaaagcctgacaccaaaagcactgtgactggagagaggcaaagtggggacggacaggagagcacagagcctgtggagaacaaagtgggtaaaaagggccctaagcatttggatgatgatgaagatcggaagaatccagcatacatacctcggaaagggctcttctttgagcatgatcttcgagggcaaactcaggaggaggaagtcagacccaaggggcgtcagcgaaagctatggaaggatgagggtcgctgggagcatgacaagttccgggaagatgagcaggccccaaagtcccgacaggagctcattgctctttatggttatgacattcgctcagctcataatcctgatgacatcaaacctcgaagaatccggaaaccccgatatgggagtcctccacaaagagatccaaactggaacggtgagcggctaaacaagtctcatcgccaccagggtcttgggggcaccctaccaccaaggacatttattaacaggaatgctgcaggtaccggccgtatgtctgcacccaggaattattctcgatctgggggcttcaaggaaggtcgtgctggttttaggcctgtggaagctggtgggcagcatggtggccggtctggtgagactgttaagcatgagattagttaccggtcacggcgcctagagcagacttctgtgagggatccatctccagaagcagatgctccagtgcttggcagtcctgagaaggaagaggcagcctcagagccaccagctgctgctcctgatgctgcaccaccaccccctgataggcccattgagaagaaatcctattcccgggcaagaagaactcgaaccaaagttggagatgcagtcaagcttgcagaggaggtgccccctcctcctgaaggactgattccagcacctccagtcccagaaaccaccccaactccacctactaagactgggacctgggaagctccggtggattctagtacaagtggacttgagcaagatgtggcacaactaaatatagcagaacagaattggagtccggggcagccttctttcctgcaaccacgggaacttcgaggtatgcccaaccatatacacatgggagcaggacctccacctcagtttaaccggatggaagaaatgggtgtccagggtggtcgagccaaacgctattcatcccagcggcaaagacctgtgccagagccccccgcccctccagtgcatatcagtatcatggagggacattactatgatccactgcagttccagggaccaatctatacccatggtgacagccctgccccgctgcctccacagggcatgcttgtgcagccaggaatgaaccttccccacccaggtttacatccccaccagacaccagcatgcccagattcccagaccttaagacactgtgagagttgtctctgttggtccactgtgtttagttgcaaggatttttccatgtgtggtggtgttttttgttactgttttaaagggtgcccatttgtgatcagcattgtgacttggagataataaaatttagactat

SEQ ID NO: 4447 - DNA, 748 bp, Homo sapiens
atcctcgtgggccctgaccttctctctgagagccgggcagaggctccggagccatgcaggccgaaggccggggcacagggggttcgacgggcgatgctgatggcccaggaggccctggcattcctgatggcccagggggcaatgctggcggcccaggagaggcgggtgccacgggcggcagaggtccccggggcgcaggggcagcaagggcctcggggccgggaggaggcgccccgcggggtccgcatggcggcgcggcttcagggctgaatggatgctgcagatgcggggccagggggccggagagccgcctgcttgagttctacctcgccatgcctttcgcgacacccatggaagcagagctggcccgcaggagcctggcccaggatgccccaccgcttcccgtgccaggggtgcttctgaaggagttcactgtgtccggcaacatactgactatccgactgactgctgcagaccaccgccaactgcagctctccatcagctcctgtctccagcagctttccctgttgatgtggatcacgcagtgctttctgcccgtgtttttggctcagcctccctcagggcagaggcgctaagcccagcctggcgccccttcctaggtcatgcctcctcccctagggaatggtcccagcacgagtggccagttcattgtgggggcctgattgtttgtcgctggaggaggacggcttacatgtttgtttctgtagaaaataaaactgagctacga

SEQ ID NO: 4448 - DNA, 1010 bp, Homo sapiens
agtgttcggctggggcaggcacgctgtggctggctgcttcccttccttccatcccctttggaccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgctgtctctcctccagcaaggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagcaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacgagaaattaatgctgatataaaacgtaaattagtgaaggaactccgatgcgttggacaaaaatatgaaaaaatcttcgaaatgcttgaaggagtgcaaggacctactgcagtcaggaagcgattttttgaatccatcatcaaggaagcagcaagatgtatgagacgagactttgttaagcaccttaagaagaaactgaaacgtatgatttgagaatacttgtccctggaggattatcacaccccaaatgcataatctcgttaatgattgaggagagaaaaggatcagattgctgttttctacaatggagcaggatattgctgaagtctcctggcatatgttaccgaatcaactggccttccagaggctaagaaatttctgttagtaaaagatgttctttttcccaaa

SEQ ID NO: 4449 - DNA, 1010 bp, Homo sapiens
agtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaaggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttgagaatacttgtccctggaggattatcacaccccaaatgcataatctcattaatgattgaggagagaaaaggatcagattgctgttttctacaatggagcaggatattgctgaagtctcctggcatatgttaccgaatcaactggccttccagaggctaagaaatttctgttagtaaaagatgttctttttcccaaa

SEQ ID NO: 4450 - DNA, 827 bp, Homo sapiens
gcgccacaacttcactgccattttgtgaggtgccgccgtctctcctccagcaaggtcaggacttcaggactgaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttgagaatacttgtccctggaggattatcacaccccaaatgcataatctcattaatgattgaggagagaaaaggatcagattgctgttttctacaatggagcaggatattgctgaagtctcctggcatatgttaccgaatcaactggccttccagaggctaagaaatttctgttagtaaaagat

SEQ ID NO: 4451 - DNA, 1010 bp, Homo sapiens
agtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaaggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacgagaaattaatgctgatataaaacgtaaattagtgaaggaactccgatgcgttggacaaaaatatgaaaaaatcttcgaaatgcttgaaggagtgcaaggacctactgcagtcaggaagcgattttttgaatccatcatcaaggaagcagcaagatgtatgagacgagactttgttaagcaccttaagaagaaactgaaacgtatgatttgagaatacttgtccctggaggattatcacaccccaaatgcataatctcgttaatgattgaggagagaaaaggatcagattgctgttttctacaatggagcaggatattgctgaagtctcctggcatatgttaccgaatcaaatagccttccagaggctaagaaatttctgttagtaaaagatgttctttttcccaaa

SEQ ID NO: 4452 - DNA, 763 bp, Homo sapiens
atgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacgagaaattaatgctgatataaaacgtaaattagtgaaggaactccgatgcgttggacaaaaatatgaaaaaatcttcgaaatgcttgaaggagtgcaaggacctactgcagtcaggaagcgattttttgaatccatcatcaaggaagcagcaagatgtatgagacgagactttgttaagcaccttaagaagaaactgaaacgtatgatttgagaatacttgtccctggaggattatcacaccccaaatgcataatctcgttaatgattgaggagagaaaaggatcagattgctgttttctacaatggagcaggatattgctgaagtctcctggcatatgttaccgaatcaaatagccttccagaggctaagaaatttctgttagtaaaagatgttctttttccca

SEQ ID NO: 4453 - DNA, 1008 bp, Homo sapiens
agtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaaggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttgagaatacttgtccctggaggattatcacaccccaaatgcataatctcgttaatgattgaggagagaaaaggatcagattgctgttttctacaatggagcaggatattgctgaagtctcctggcatatgttaccgaatcaaatagccttccagaggctaagaaatttctgttagtaaaagatgttctttttccca

SEQ ID NO: 4454 - DNA, 1010 bp, Homo sapiens
agtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaaggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagcaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttgagaatacttgtccctggaggattatcacaccccaaatgcataatctcgttaatgattgaggagagaaaaggatcagattgctgttttctacaatggagcaggatattgctgaagtctcctggcatatgttaccgaatcaaatagccttccagaggctaagaaatttctgttagtaaaagatgttctttttcccaaa

SEQ ID NO: 4455 - DNA, 831 bp, Homo sapiens
gcgccacaacttcactgccattttgtgaggtgccgccgtctctcctccagcaaggtcaggacttcaggactgaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagcaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttgagaatacttgtccctggaggattatcacaccccaaatgcataatctcgttaatgattgaggagagaaaaggatcagattgctgttttctacaatggagcaggatattgctgaagtctcctggcatatgttaccgaatcaaatagccttccagaggctaagaaatttctgttagtaaaagatgttc

SEQ ID NO: 4456 - DNA, 1010 bp, Homo sapiens
agtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaaggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagatgggatgatgcagaaacctggtagcaatgcacctgtgggaggaaatgttaccagcaatttctctggagatgacctagaatgcagaggaatagcctcctctcccaaaagccaacaagaaattaatgctgatataaaatgtcaagtagtgaaggaaatccgatgccttggacgaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttgagaatacttgtccctggaggattatcacaccccaaatgcataatctcattaatgattgaggagagaaaaggatcagattgctgttttctacaatggagcaggatattgctgaagtctcctggcatatgttaccgaatcaactggccttccagaggctaagaaatttctgttagtaaaagatgttctttttcccaaa

SEQ ID NO: 4457 - DNA, 831 bp, Homo sapiens
gcgccacaacttcactgccattttgtgaggtgccgccgtctctcctccagcaaggtcaggacttcaggactgaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagatgggatgatgcagaaacctggtagcaatgcacctgtgggaggaaatgttaccagcaatttctctggagatgacctagaatgcagaggaatagcctcctctcccaaaagccaacaagaaattaatgctgatataaaatgtcaagtagtgaaggaaatccgatgccttggacgaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttgagaatacttgtccctggaggattatcacaccccaaatgcataatctcattaatgattgaggagagaaaaggatcagattgctgttttctacaatggagcaggatattgctgaagtctcctggcatatgttaccgaatcaactggccttccagaggctaagaaatttctgttagtaaaagatgttc

SEQ ID NO: 4458 - DNA, 1010 bp, Homo sapiens
agtgttcggctgggacaggcacgctgtggctggctacttcccttccttccatcccccttgggccaaacaggatcggtgcttctggtgagacgtctccccatgcacatcactcccagatgccctagggggcacatttcccacaactcccagagggcaggtttctagaaagtgccaccagtggggaggcgccacaacttcactgccattttgtgaggtgccgccgtctctcctccagcaaggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagcaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttgagaatacttgtccctggaggattatcacaccccaaatgcataatctcgttaatgattgaggagagaaaaggatcagattgctgttttctacaatggagcaggatattgctgaagtctcctggcatatgttaccgaatcaactggccttccagaggctaagaaatttctgttagtaaaagatgttctttttcccaaa

SEQ ID NO: 4459 - DNA, 831 bp, Homo sapiens
gcgccacaacttcactgccattttgtgaggtgccgccgtctctcctccagcaaggtcaggacttcaggactgaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagcaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttgagaatacttgtccctggaggattatcacaccccaaatgcataatctcgttaatgattgaggagagaaaaggatcagattgctgttttctacaatggagcaggatattgctgaagtctcctggcatatgttaccgaatcaactggccttccagaggctaagaaatttctgttagtaaaagatgttc

SEQ ID NO: 4460 - DNA, 1126 bp, Homo sapiens
gccaaccagaatctttcccaacttgtctaagtcctctcaggccagccttggtgggaggtttctaggattcgctccctgcccttcccatcttagggtgtcgtctgagacagactcttattccctcaataaagagagagactcttattccctcagcggccagctcctcgcctcccctcggccgtagccacctcagtggtcaccgtcttcaccgtggtcgcctcagcccgctcgccaccccagttgaggcgctgctggtgtcatgtctgccacaggggaccgacacccgacccaaggggaccaggaggccccggtaagccaggagggagcacaggccgaggcggccggagctggtaaccaggagggcggcgactccggccccgacagcagcgacgtggtgcctgcggccgaggtggtcggagtcgcagggcccgtggaaggcctcggggaggaggagggtgagcaggcggcaggcctggccgcagtcccccggggcgggagcgccgaggaggactcagatatcgggcccgcgacggaggaagaggaggaggaagaggggaacgaggcggccaacttcgacttggcggtggtcgcccgtcgctacccggcgtcgggcattcacttcgtgctcctggacatggtccactcccttctccaccgcctctctcacaacgaccacatcctcatagagaaccgtcaactcagccgcctgatggtggggccacacgctgctgcgcgcaacctctggggcaacctccccccgctgctgctgccccagaggctgggtgcaggggccgcagcccgggcgggcgagggcctgggcctgatccaggaggccgcatcggtcccagagcctgcagtgccagctgacctggccgagatggccagggagcccgcggaggaggccgcagaggagaagctctcagaggaggccacagaggaaccagacgcagaggaaccggccacagaagaaccgaccgcacaggaggccacggccccagaggaagtcactaaatctcagcccgaaaagtgggatgaagaggcccaagatgctgcaggcgaggaagagaaagaacaagaaaaagagaaggatgcagaaaacaaggtgaagaactccaaagggacctag

SEQ ID NO: 4461 - DNA, 1288 bp, Homo sapiens
accagaatctttcccaacttgtctaagtcctctcaggccagccttggtgggaggtttctaggattcgctccctgcccttcccatcttagggtgtcgtctgagacagactcttattccctcaataaagagagagactcttattccctcagcggccagctcctcgcctcccctcggccgtagccacctcagtggtcaccgtcttcaccgtggtcgcctcagcccgctcgccaccccagttgaggcgctgctggtgtcatgtctgccacaggggaccgacacccgacccaaggggaccaggaggccccggtaagccaggagggagcacaggccgaggcggccggagctggtaaccaggagggcggcgactccggccccgacagcagcgacgtggtgcctgcggccgaggtggtcggagtcgcagggcccgtggaaggcctcggggaggaggagggtgagcaggcggcaggcctggccgcagtcccccggggcgggagcgccgaggaggactcagatatcgggcccgcgacggaggaagaggaggaggaagaggggaacgaggcggccaacttcgacttggcggtggtcgcccgtcgctacccggcgtcgggcattcacttcgtgctcctggacatggtccactcccttctccaccgcctctctcacaacgaccacatcctcatagagaaccgtcaactcagccgcctgatggtggggccacacgctgctgcgcgcaacctctggggcaacctccccccgctgctgctgccccagaggctgggtgcaggggccgcagcccgggcgggcgagggcctgggcctgatccaggaggccgcatcggtcccagagcctgcagtgccagctgacctggccgagatggccagggagcccgcggaggaggccgcagaggagaagctctcagaggaggccacagaggaaccagacgcagaggaaccggccacagaagaaccgaccgcacaggaggccacggccccagaggaagtcactaaatctcagcccgaaaagtgggatgaagaggcccaagatgctgcaggcgaggaagagaaagaacaagaaaaagagaaggatgcagaaaacaaggtgaagaactccaaagggacctagacgcagcagaggtgaagccaagaaaatccagatgcctgtgggaattgtaacacatatcattccaaagttcgttacatcaaaagtgatatccagtgacatctaactttcatggatgtatgtgacagtgttcaagttaaaaaataaaagtttgttttaaatgaataaa

SEQ ID NO: 4462 - DNA, 1294 bp, Homo sapiens
accagaatctttcccaacttgtctaagtcctctcaggccagccttggtgggaggtttctaggattcgctccctgcccttcccatcttagggtgtcgtctgagacagactcttattccctcaataaagagagagactcttattccctcagcggccagctcctcgcctcccctcggccgtagccacctcagtggtcaccgtcttcaccgtggtcgcctcagcccgctcgccaccccagttgaggcgctgctggtgtcatgtctgccacaggggaccgacacccgacccaaggggaccaggaggccccggtaagccaggagggagcacaggccgaggcggccggagctggtaaccaggagggcggcgactccggccccgacagcagcgacgtggtgcctgcggccgaggtggtcggagtcgcagggcccgtggaaggcctcggggaggaggagggtgagcaggcggcaggcctggccgcagtcccccggggcgggagcgccgaggaggactcagatatcgggcccgcgacggaggaagaggaggaggaagaggggaacgaggcggccaacttcgacttggcggtggtcgcccgtcgctacccggcgtcgggcattcacttcgtgctcctggacatggtccactcccttctccaccgcctctctcacaacgaccacatcctcatagagaaccgtcaactcagccgcctgatggtggggccacacgctgctgcgcgcaacctctggggcaacctccccccgctgctgctgccccagaggctgggtgcaggggccgcagcccgggcgggcgagggcctgggcctgatccaggaggccgcatcggtcccagagcctgcagtgccagctgacctggccgagatggccagggagcccgcggaggaggccgcagaggagaagctctcagaggaggccacagaggaaccagacgcagaggaaccggccacagaagaaccgaccgcacaggaggccacggccccagaggaagtcactaaatctcagcccgaaaagtgggatgaagaggcccaagatgctgcaggcgaggaagagaaagaacaagaaaaagagaaggatgcggaaaacaaggtgaagaactccaaagggacctagacgcagcagaggtgaagccaagaaaatccagatgcctgtgggaattgtaacacatatcattccaaagttcgttacatcaaaagtgatatccagtgacatctaactttcatggatgtatgtgacagtgttcaagttaaaaaataaaagtttgttttaaatgaataaactgaaa

SEQ ID NO: 4463 - DNA, 1288 bp, Homo sapiens
accagaatctttcccaacttgtctaagtcctctcaggccagccttggtgggaggtttctaggattcgctccctgcccttcccatcttagggtgtcgtctgagacagactcttattccctcaataaagagagagactcttattccctcagcggccagctcctcgcctcccctcggccgtagccacctcagtggtcaccgtcttcaccgtggtcgcctcagcccgctcgccaccccagttgaggcgctgctggtgtcatgtctgccacaggggaccgacacccgacccaaggggaccaggaggccccggtaagccaggagggagcacaggccgaggcggccggagctggtaaccaggagggcggcgactccggccccgacagcagcgacgtggtgcctgcggccgaggtggtcggagtcgcagggcccgtggaaggcctcggggaggaggagggtgagcaggcggcaggcctggccgcagtcccccggggcgggagcgccgaggaggactcagatatcgggcccgcgacggaggaagaggaggaggaagaggggaacgaggcggccaacttcgacttggcggtggtcgcccgtcgctacccggcgtcgggcattcacttcgtgctcctggacatggtccactcccttctccaccgcctctctcacaacgaccacatcctcatagagaaccgtcaactcagccgcctgatggtggggccacacgctgctgcgcgcaacctctggggcaacctccccccgctgctgctgccccagaggctgggtgcaggggccgcagcccgggcgggcgagggcctgggcctgatccaggaggccgcatcggtcccagagcctgcagtgccagctgacctggccgagatggccagggagcccgcggaggaggccgcagaggagaagctctcagaggaggccacagaggaaccagacgcagaggaaccggccacagaagaaccgaccgcacaggaggccacggccccagaggaagtcactaaatctcagcccgaaaagtgggatgaagaggcccaagatgctgcaggcgaggaagagaaagaacaagaaaaagagaaggatgcggaaaacaaggtgaagaactccaaagggacctagacgcagcagaggtgaagccaagaaaatccagatgcctgtgggaattgtaacacatatcattccaaagttcgttacatcaaaagtgatatccagtgacatctaactttcatggatgtatgtgacagtgttcaagttaaaaaataaaagtttgttttaaatgaataaa

SEQ ID NO: 4464 - DNA, 1288 bp, Homo sapiens; identical to SEQ ID NO: 4463

SEQ ID NO: 4465 - DNA, 1288 bp, Homo sapiens; identical to SEQ ID NO: 4463

SEQ ID NO: 4466 - DNA, 1288 bp, Homo sapiens; identical to SEQ ID NO: 4463

SEQ ID NO: 4467 - DNA, 1288 bp, Homo sapiens; identical to SEQ ID NO: 4463

SEQ ID NO: 4468 - DNA, 1294 bp, Homo sapiens
accagaatctttcccaacttgtctaagtcctctcaggccagccttggtgggaggtttctaggattcgctccctgcccttcccatcttagggtgtcgtctgagacagactcttattccctcaataaagagagagactcttattccctcagcggccagctcctcgcctcccctcggccgtagccacctcagtggtcaccgtcttcaccgtggtcgcctcagcccgctcgccaccccagttgaggcgctgctggtgtcatgtctgccacaggggaccgacacccgacccaaggggaccaggaggccccggtaagccaggagggagcacaggccgaggcggccggagctggtaaccaggagggcggcgactccggccccgacagcagcgacgtggtgcctgcggccgaggtggtcggagtcgcagggcccgtggaaggcctcggggaggaggagggtgagcaggcggcaggcctggccgcagtcccccggggcgggagcgccgaggaggactcagatatcgggcccgcgacggaggaagaggaggaggaagaggggaacgaggcggccaacttcgacttggcggtggtcgcccgtcgctacccggcgtcgggcattcacttcgtgctcctggacatggtccactcccttctccaccgcctctctcacaacgaccacatcctcatagagaaccgtcaactcagccgcctgatggtggggccacacgctgctgcgcgcaacctctggggcaacctccccccgctgctgctgccccagaggctgggtgcaggggccgcagcccgggcgggcgagggcctgggcctgatccaggaggccgcatcggtcccagagcctgcagtgccagctgacctggccgagatggccagggagcccgcggaggaggccgcagaggagaagctctcagaggaggccacagaggaaccagacgcagaggaaccggccacagaagaaccgaccgcacaggaggccacggccccagaggaagtcactaaatctcagcccgaaaagtgggatgaagaggcccaagatgctgcaggcgaggaagagaaagaacaagaaaaagagaaggatgcagaaaacaaggtgaagaactccaaagggacctagacgcagcagaggtgaagccaagaaaatccagatgcctgtgggaattgtaacacatatcattccaaagttcgttacatcaaaagtgatatccagtgacatctaactttcatggatgtatgtgacagtgttcaagttaaaaaataaaagtttgttttaaatgaataaactgaaa

SEQ ID NO: 4469 - DNA, 1288 bp, Homo sapiens; identical to SEQ ID NO: 4463

SEQ ID NO: 4470 - DNA, 1288 bp, Homo sapiens
accagaatctttcccaacttgtctaagtcctctcaggccagccttggtgggaggtttctaggattcgctccctgcccttcccatcttagggtgtcgtctgagacagactcttattccctcaataaagagagagactcttattccctcagcggccagctcctcgcctcccctcggccgtagccacctcagtggtcaccgtcttcaccgtggtcgcctcagcccgctcgccaccccagttgaggcgctgctggtgtcatgtctgccacaggggaccgacacccgacccaaggggaccaggaggccccggtaagccaggagggagcacaggccgaggcggccggagctggtaaccaggagggcggcgactccggccccgacagcagcgacgtggtgcctgcggccgaggtggtcggagtcgcagggcccgtggaaggcctcggggaggaggagggtgagcaggcggcaggcctggccgcagtcccccggggcgggagcgccgaggaggactcagatatcgggcccgcgacggaggaagaggaggaggaagaggggaacgaggcggccaacttcgacttggcggtggtcgcccgtcgctacccggcgtcgggcattcacttcgtgctcctggacatggtccactcccttctccaccgcctctctcacaacgaccacatcctcatagagaaccgtcaactcagccgcctgatggtggggccacacgctgctgcgcgcaacctctggggcaacctccccccgctgctgctgccccagaggctgggtgcaggggccgcagcccgggcgggcgagggcctgggcctgatccaggaggccgcatcggtcccagagcctgcagtgccagctgacctggccgagatggccagggagcccgcggaggaggccgcagaggagaagctctcagaggaggccacagaggaaccagacgcagaggaaccagccacagaagaaccgaccgcacaggaggccacggccccagaggaagtcactaaatctcagcccgaaaagtgggatgaagaggcccaagatgctgcaggcgaggaagagaaagaacaagaaaaagagaaggatgcagaaaacaaggtgaagaactccaaagggacctagacgcagcagaggtgaagccaagaaaatccagatgcctgtgggaattgtaacacatatcattccaaagttcgttacatcaaaagtgatatccagtgacatctaactttcatggatgtatgtgacagtgttcaagttaaaaaataaaagtttgttttaaatgaataaa

SEQ ID NO: 4471 - DNA, 1288 bp, Homo sapiens
accagaatctttcccgccttatctaagtcctctcaggccagacttggtgggaggttcctaggattcgctccctgcccttcccaccttagggtgtcctctgagacagactcttatttcctcaataaagagaaagactcttattccctcagcggccagctcctcgcctcccctcggccgtagccacctcagtggtcaccgtcttcaccgtggtcgcctcagcccgctcgccaccccagttgaggcgctgctggtgtcatgtctgccacaggggaccgacacccgacccaaggggaccaggaggccccggtaagccaggagggagcacaggccgaggcggccggagctggtaaccaggagggcggcgactccggccccgacagcagcgacgtggtgcctgcggccgaggtggtcggagtcgcagggcccgtggaaggcctcggggaggaggagggtgagcaggcggcaggcctggccgcagtcccccggggcgggagcgccgaggaggactcagatatcgggcccgcgacggaggaagaggaggaggaagaggggaacgaggcggccaacttcgacttggcggtggtcgcccgtcgctacccggcgtcgggcattcacttcgtgctcctggacatggtccactcccttctccaccgcctctctcacaacgaccacatcctcatagagaaccgtcaactcagccgcctgatggtggggccacacgctgctgcgcgcaacctctggggcaacctccccccgctgctgctgccccagaggctgggtgcaggggccgcagcccgggcgggcgagggcctgggcctgatccaggaggccgcatcggtcccagagcctgcagtgccagctgacctggccgagatggccagggagcccgcggaggaggccgcagaggagaagctctcagaggaggccacagaggaaccagacgcagaggaaccggccacagaagaaccgaccgcacaggaggccacggccccagaggaagtcactaaatctcagcccgaaaagtgggatgaagaggcccaagatgctgcaggcgaggaagagaaagaacaagaaaaagagaaggatgcggaaaacaaggtgaagaactccaaagggacctagacgcagcagaggtgaagccaagaaaatccagatgcctgtgggaattgtaacacatatcattccaaagttcgttacatcaaaagtgatatccagtgacatctaactttcatggatgtatgtgacagtgttcaagttaaaaaataaaagtttgttttaaatgaataaa

SEQ ID NO: 4472 - DNA, 1288 bp, Homo sapiens; identical to SEQ ID NO: 4463

SEQ ID NO: 4473 - DNA, 1288 bp, Homo sapiens; identical to SEQ ID NO: 4463

SEQ ID NO: 4474 - DNA, 1324 bp, Homo sapiens
accagaatctttcccgccttatctaagtcctctcaggccagacttggtgggaggttcctaggattcgctccctgcccttcccaccttagggtgtcctctgagacagactcttatttcctcaataaagagaaagactcttattccctcagcggccagctcctcgcctcccctcggccgtagccacctcagtggtcaccgtcttcaccgtggtcgcctcagcccgctcgccaccccagttgaggcgctgctggtgtcatgtctgccacaggggaccgacacccgacccaaggggaccaggaggccccggtaagccaggagggagcacaggccgaggcggccggagctggtaaccaggagggcggcgactccggccccgacagcagcgacatggtgcctgcggccgaggtggtcggagtcgcagggcccgtggaaggcctcggggaggaggagggtgagcaggcggcaggcctggccgcagtcccccagggcgggagcgccgaggaggactcagatatcgggcccgcgacggaggaagaggaggaggaggaagaggggaacgaggcggccaacttcgacttggcggtggccacccgtcggtacccggcggcgggcattggcttcgtgttcctgtacctggtccactcccttctccgccgcctctatcacaacgaccacatccagatagcgaaccgtcacctcagccgcctgatggtggggccccacgctgctgtgcccaacctctgggacaaccctcccctgctgctgctgtcccagaggctgggtgcaggggctgcagccccagaaggcgagggcctcggcctgatccaggaggctgcgtcggtccaggaggccgcgtcggtcccagagcctgcagtgccagctgacctggccgagatggccagggagcccgcggaggaggccgcagatgagaaacccccagaggaggccgcagaggagaagctcacagaggaggccacagaggaaccggccgcagaggaaccgacctcagaggaggccgtggcccccgaggaagtcactaaatctcagcccgaaaagtgggatgaagaggcccaagatgctgcaggcgaggaagagaaagaacaagaaaaagagaaggatgtggaaaacaaggtgaagaactccaaagggacctagacgcagcagaggtgaagccaagaaaatccagatgcctgtgggaattgtaacacatatcattccaaagttcgttacatcaaaagtgatatccagtgacatctaactttcatggatgtatgtgacagtgtttgttcaagttaaaaataaaagtttgttttcaatgaataaa

SEQ ID NO: 4475 - DNA, 5549 bp, Homo sapiens
ttagcttatcaggagaacttactgtaaaccgactctttttgtttcaaagatgtctcccactccaggcgaggagcgctcttggctgaggattgccccctgtgggtcactttctcagtcattttgagctcagcctaatcaaagactgaggttatgaagtcgatcctagatggccttgcagataccaccttccgcaccatcaccactgacctcctgtacgtgggctcaaatgacattcagtacgaagacatcaaaggtgacatggcatccaaattagggtacttcccacagaaattccctttaacttcctttaggggaagtcccttccaagagaagatgactgcgggagacaacccccagctagtcccagcagaccaggtgaacattacagaattttacaacaagtctctctcgtccttcaaggagaatgaggagaacatccagtgtggggagaacttcatggacatagagtgtttcatggtcctgaaccccagccagcagctggccattgcagtcctgtccctcacgctgggcaccttcacggtcctggagaacctcctggtgctgtgcgtcatcctccactcccgcagcctccgctgcaggccttcctaccacttcatcggcagcctggcggtggcagacctcctggggagtgtcatttttgtctacagcttcattgacttccacgtgttccaccgcaaagatagccgcaacgtgtttctgttcaaactgggtggggtcacggcctccttcactgcctccgtgggcagcctgttcctcacagccatcgacaggtacatatccattcacaggcccctggcctataagaggattgtcaccaggcccaaggccgtggtggcgttttgcctgatgtggaccatagccattgtgatcgccgtgctgcctctcctgggctggaactgcgagaaactgcaatctgtttgctcagacattttcccacacattgatgaaacctacctgatgttctggatcggggtcaccagcgtactgcttctgttcatcgtgtatgcgtacatgtatattctctggaaggctcacagccacgccgtccgcatgattcagcgtggcacccagaagagcatcatcatccacacgtctgaggatgggaaggtacaggtgacccggccagaccaagcccgcatggacattaggttagccaagaccctggtcctgatcctggtggtgttgatcatctgctggggccctctgcttgcaatcatggtgtatgatgtctttgggaagatgaacaagctcattaagacggtgtttgcattctgcagtatgctctgcctgctgaactccaccgtgaaccccatcatctatgctctgaggagtaaggacctgcgacacgctttccggagcatgtttccctcttgtgaaggcactgcgcagcctctggataacagcatgggggactcggactgcctgcacaaacacgcaaacaatgcagccagtgttcacagggccgcagaaagctgcatcaagagcacggtcaagattgccaaggtaaccatgtctgtgtccacagacacgtctgccgaggctctgtgagcctgatgcctccctggcagcacaggaaaagaatttttttttttaagctcaaaatctagaagagtctattgtctccttggttatatttttttaactttaccatgctcaatgaaaaggtgattgtcaccatgatcacttatcagtttgctaatgtttccatagtttaggtactcaaactccattctccaggggtttacagtgaagaaagcctgttgtttaagtgactgaacgatccttcaaagtctcaatgaaataggagggaaacctttggctacacaattggaagtctaagaacccatggaaaaatgccatcaaatgaataatgcctttgtaaccacaactttcactataatgtgaaatgtaactgtccgtagtatcagagatgtccatttttacaagttatagtactagagatattttgtaaaatgtattatgtcctgtgagatgtgtatcagtgtttatgtgctattaatatttgtttagttcagcaaaactgaaaggtagacttttatgagaacaatggacaagcagtggatacgtgtcaatgtgtgcactttttttctatattattgcccatgatataactttagaaataaaccttaatatttcttcaaatatctctatttaattttgacactgaaataaccgtaaaggtttatttttctgttacctcaacaagaagaatttgaagacttcaaaatattgagcagaattcattcatacttaaaaatttattagccctgcattttcataggaagacacattatcttctggactatagctgttctaatggattataatcagaatggaagagagaaagcatattgactttttttgagcgacatctctgactttctttagtctttagctattactggatctcttaagacagcatgtgttaatcttaatgtatatcgttatcactgtgcagttgctgtttacttgaatagtattgtgttcctatattccaggtttaagtagatttcatgcctgggtggccaaacaacagtcttcattttttttaattgaaaagaagtagtgtctggatcagtaaaattatactgtgtgtgagtgtgaatataaatgtgtgtatgtgtgtttctgtcctgtaactgttacagtaatgtcataaagtgagaaaactgtgaccaagtataaacttttaccacttgctgcactcttgcacatggattcagtttctaaaattgagttcttcctgtaatcttgttgataaaaatactgactccaaccattcaaaaatttcaccccatccctccttaagagattggatcaagtattactaaattgacctttaggtattacacaagaccagtgcttagcaaaaaataatgacaggcatccaaggaagggatgtatttgtagtgttattgccaggaaaggagagtactttggtttctgagcaccgaatattgagcaatatgtcagtcactaaaaggaagacagttctacagaaaaacaatggtaacatttttcaatagcgtgtgtagatagtatgcactatatacatcacgttaaagtaggactatcacacccagcccatgtggctaaaaaagctgaatcagacagtggatgagacacacaacggcagtgaagaaccgatacacttggcattgacgtctagctatgctgtatctgtgctttgcccacatgcccttggtgacagctgagcacccagctctgtcttggtaggtttgggctaaggaacaaatctctcctttgctcgtggttagcaagatacactcaagcatgaagataaacacagctgctttcttcttacaccccggtctcatgctccttaatggcgccatgggtgcttgttgggcctttttccagtaaggaatgatattgctgaagaatctacttaaccctgacaaattttaattataatctcttcttatacagataaaacatgactcctacaaggccccaaggtttacatagtctgaagtgaagtacagagctggcatctatctggtgatttctagctctcgagatacccaagcagcctgatggggcagttccccttcttacggttcacgctctaaggcaggatgtggcttatgagatactttgcattgtctgtctgcacaccttgaatctgcctgctggctcccttactttacctctctgtcatgtgcagatgaaggctcagggtgctagaggattagtaagatctctttctaaagacaggagagattatttacaagaagaactcaccagggtttagtttgcatttaagaattgccagtcttttgtcctgcatcatcttgaacattaatccacatgtttcagagctcaccaggcagtaccaatgctcttttcacagctatgaagagctagagaaattcttgttatggtagaaaaatttcacgattcatttttgaaactgcatttgtgcgtatgcagtgtagattttatagtgtgttgtgctttcaagatctaaatcatatataataaattaagggacaatggggctgacagcactaaacttggtgcttattgatattctaagaaatatctgtgaaatatcatcacgtatgttatacaaccttcatttaaaaaggtttaaaactagttagattcactttgacacttttcatatcatttcttaacccaagtgacgaaaacattgtccccaatgaatatactcattagaattaccatttgttaatatcactcattaattaaccccataattagatccattaatttaaatgatttaaatttaagtaagttttataaggtctgacatcagaggtatcttactttcctctgaggatgatgtacttgccctgaccatgcattttaccatcacacatgttcagaaagggccaaattcccaacctgctcattttttttttatcagagtcatgatgaatcagtcctagaatgtttcatttgcacaagtagggctgcctccaagaggaacctctgatttattttgtatgaaatatatgtgaaaggatatgaatctgagagatgctgtagacatctgtcctacacttgagatgatttccaagcctctctggcactttgagttaagtctatctggtattaaatgccaaggaccttttgctgcctaaatccactctgcaggaaataggcccaaccaccagatgagaattaggccctggatgagtagcgctatagttactgtcctgttgattaatttctgccatttcatgtccataaaagagaccacccatatcatgcacacaattagatttctcacactctaactgtatatttgtatgatattttaaaatctcctaaatgctgggcaatggctattaacaattaattgtcttgcactggccttctgatgaaatgttaacaatgcctattgtaatatagaaaaaaacattctatctactgatttgggctgaatgtatgtaaataggtttctaaaaagtcagatgtttgagcagtggcctacaaatcagtaattttcggatgggagagtttctttacattgccgtggcatcttaaaagctatcttcatgtaaattgactgtactaggcctactggggatcagagttcccaagaaaggaaaccttttcttgtatctggattcaaatttatttccaatgtttcaagcgggaaacatgactctttattgtctgtaaatctaacattattacttttcctcttagaagaatattgtattgttagatgtttgttgagctggtaacatcgttgcaaccactgcaatatcttcgttagtaatctgtataatactttgtatacaagtactggtaagattgttattaaatgtagcttcagtcattaaattactatagcaaagtagtacttcttctgtaatatttacaatgtattaagcccacagtatattttatttcaatgtaattaaactgttaacttattcaaagagaaaacatctcatcatgtctattgtccaaagttacctggaatcaaataaaaattctagattaccatg

SEQ ID NO: 4476 - DNA, 6031 bp, Homo sapiens
cgagagggagccagagacagcgcgagcggagggagcggcagggactgcgcgagcgggacgaggcgacgggcgcccgggctggcggagacgggcggccccacgccgggccaggcggggctcgcgggaggacccagtgaagagcctgggaaggggcgaggctcgccggcggtcggagcagcggggcgccagtcccggtcgctgtcgcgggcgggcgctggagaccgggacgccggcgctcggacggactgacttgctgaccgcccgccggaggcacaccccactccaccccaccccgcctcgccagcagcccggcgccggcgccgcctcccgcacgctactccctctgccaccccttccttctccacttcttttccgcctccgcctcttcttgtctcccgcggcgccagcgccttcccttggcccgggcgggggcctcggctccctgcagagctctccgtagtcagtgggggatatttcgttctagcggacaaccagcccctgagctgggcgagaggtgccaagggagcttctgtcccgaggaccaggggatgcgaagggattgccccctgtgggtcactttctcagtcattttgagctcagcctaatcaaagactgaggttatgaagtcgatcctagatggccttgcagataccaccttccgcaccatcaccactgacctcctgtacgtgggctcaaatgacattcagtacgaagacatcaaaggtgacatggcatccaaattagggtacttcccacagaaattccctttaacttcctttaggggaagtcccttccaagagaagatgactgcgggagacaacccccagctagtcccagcagaccaggtgaacattacagaattttacaacaagtctctctcgtccttcaaggagaatgaggagaacatccagtgtggggagaacttcatggacatagagtgtttcatggtcctgaaccccagccagcagctggccattgcagtcctgtccctcacgctgggcaccttcacggtcctggagaacctcctggtgctgtgcgtcatcctccactcccgcagcctccgctgcaggccttcctaccacttcatcggcagcctggcggtggcagacctcctggggagtgtcatttttgtctacagcttcattgacttccacgtgttccaccgcaaagatagccgcaacgtgtttctgttcaaactgggtggggtcacggcctccttcactgcctccgtgggcagcctgttcctcacagccatcgacaggtacatatccattcacaggcccctggcctataagaggattgtcaccaggcccaaggccgtggtggcgttttgcctgatgtggaccatagccattgtgatcgccgtgctgcctctcctgggctggaactgcgagaaactgcaatctgtttgctcagacattttcccacacattgatgaaacctacctgatgttctggatcggggtcaccagcgtactgcttctgttcatcgtgtatgcgtacatgtatattctctggaaggctcacagccacgccgtccgcatgattcagcgtggcacccagaagagcatcatcatccacacgtctgaggatgggaaggtacaggtgacccggccagaccaagcccgcatggacattaggttagccaagaccctggtcctgatcctggtggtgttgatcatctgctggggccctctgcttgcaatcatggtgtatgatgtctttgggaagatgaacaagctcattaagacggtgtttgcattctgcagtatgctctgcctgctgaactccaccgtgaaccccatcatctatgctctgaggagtaaggacctgcgacacgctttccggagcatgtttccctcttgtgaaggcactgcgcagcctctggataacagcatgggggactcggactgcctgcacaaacacgcaaacaatgcagccagtgttcacagggccgcagaaagctgcatcaagagcacggtcaagattgccaaggtaaccatgtctgtgtccacagacacgtctgccgaggctctgtgagcctgatgcctccctggcagcacaggaaaagaatttttttttttaagctcaaaatctagaagagtctattgtctccttggttatatttttttaactttaccatgctcaatgaaaaggtgattgtcaccatgatcacttatcagtttgctaatgtttccatagtttaggtactcaaactccattctccaggggtttacagtgaagaaagcctgttgtttaagtgactgaacgatccttcaaagtctcaatgaaataggagggaaacctttggctacacaattggaagtctaagaacccatggaaaaatgccatcaaatgaataatgcctttgtaaccacaactttcactataatgtgaaatgtaactgtccgtagtatcagagatgtccatttttacaagttatagtactagagatattttgtaaaatgtattatgtcctgtgagatgtgtatcagtgtttatgtgctattaatatttgtttagttcagcaaaactgaaaggtagacttttatgagaacaatggacaagcagtggatacgtgtcaatgtgtgcactttttttctatattattgcccatgatataactttagaaataaaccttaatatttcttcaaatatctctatttaattttgacactgaaataaccgtaaaggtttatttttctgttacctcaacaagaagaatttgaagacttcaaaatattgagcagaattcattcatacttaaaaatttattagccctgcattttcataggaagacacattatcttctggactatagctgttctaatggattataatcagaatggaagagagaaagcatattgactttttttgagcgacatctctgactttctttagtctttagctattactggatctcttaagacagcatgtgttaatcttaatgtatatcgttatcactgtgcagttgctgtttacttgaatagtattgtgttcctatattccaggtttaagtagatttcatgcctgggtggccaaacaacagtcttcattttttttaattgaaaagaagtagtgtctggatcagtaaaattatactgtgtgtgagtgtgaatataaatgtgtgtatgtgtgtttctgtcctgtaactgttacagtaatgtcataaagtgagaaaactgtgaccaagtataaacttttaccacttgctgcactcttgcacatggattcagtttctaaaattgagttcttcctgtaatcttgttgataaaaatactgactccaaccattcaaaaatttcaccccatccctccttaagagattggatcaagtattactaaattgacctttaggtattacacaagaccagtgcttagcaaaaaataatgacaggcatccaaggaagggatgtatttgtagtgttattgccaggaaaggagagtactttggtttctgagcaccgaatattgagcaatatgtcagtcactaaaaggaagacagttctacagaaaaacaatggtaacatttttcaatagcgtgtgtagatagtatgcactatatacatcacgttaaagtaggactatcacacccagcccatgtggctaaaaaagctgaatcagacagtggatgagacacacaacggcagtgaagaaccgatacacttggcattgacgtctagctatgctgtatctgtgctttgcccacatgcccttggtgacagctgagcacccagctctgtcttggtaggtttgggctaaggaacaaatctctcctttgctcgtggttagcaagatacactcaagcatgaagataaacacagctgctttcttcttacaccccggtctcatgctccttaatggcgccatgggtgcttgttgggcctttttccagtaaggaatgatattgctgaagaatctacttaaccctgacaaattttaattataatctcttcttatacagataaaacatgactcctacaaggccccaaggtttacatagtctgaagtgaagtacagagctggcatctatctggtgatttctagctctcgagatacccaagcagcctgatggggcagttccccttcttacggttcacgctctaaggcaggatgtggcttatgagatactttgcattgtctgtctgcacaccttgaatctgcctgctggctcccttactttacctctctgtcatgtgcagatgaaggctcagggtgctagaggattagtaagatctctttctaaagacaggagagattatttacaagaagaactcaccagggtttagtttgcatttaagaattgccagtcttttgtcctgcatcatcttgaacattaatccacatgtttcagagctcaccaggcagtaccaatgctcttttcacagctatgaagagctagagaaattcttgttatggtagaaaaatttcacgattcatttttgaaactgcatttgtgcgtatgcagtgtagattttatagtgtgttgtgctttcaagatctaaatcatatataataaattaagggacaatggggctgacagcactaaacttggtgcttattgatattctaagaaatatctgtgaaatatcatcacgtatgttatacaaccttcatttaaaaaggtttaaaactagttagattcactttgacacttttcatatcatttcttaacccaagtgacgaaaacattgtccccaatgaatatactcattagaattaccatttgttaatatcactcattaattaaccccataattagatccattaatttaaatgatttaaatttaagtaagttttataaggtctgacatcagaggtatcttactttcctctgaggatgatgtacttgccctgaccatgcattttaccatcacacatgttcagaaagggccaaattcccaacctgctcattttttttttatcagagtcatgatgaatcagtcctagaatgtttcatttgcacaagtagggctgcctccaagaggaacctctgatttattttgtatgaaatatatgtgaaaggatatgaatctgagagatgctgtagacatctgtcctacacttgagatgatttccaagcctctctggcactttgagttaagtctatctggtattaaatgccaaggaccttttgctgcctaaatccactctgcaggaaataggcccaaccaccagatgagaattaggccctggatgagtagcgctatagttactgtcctgttgattaatttctgccatttcatgtccataaaagagaccacccatatcatgcacacaattagatttctcacactctaactgtatatttgtatgatattttaaaatctcctaaatgctgggcaatggctattaacaattaattgtcttgcactggccttctgatgaaatgttaacaatgcctattgtaatatagaaaaaaacattctatctactgatttgggctgaatgtatgtaaataggtttctaaaaagtcagatgtttgagcagtggcctacaaatcagtaattttcggatgggagagtttctttacattgccgtggcatcttaaaagctatcttcatgtaaattgactgtactaggcctactggggatcagagttcccaagaaaggaaaccttttcttgtatctggattcaaatttatttccaatgtttcaagcgggaaacatgactctttattgtctgtaaatctaacattattacttttcctcttagaagaatattgtattgttagatgtttgttgagctggtaacatcgttgcaaccactgcaatatcttcgttagtaatctgtataatactttgtatacaagtactggtaagattgttattaaatgtagcttcagtcattaaattactatagcaaagtagtacttcttctgtaatatttacaatgtattaagcccacagtatattttatttcaatgtaattaaactgttaacttattcaaagagaaaacatctcatcatgtctattgtccaaagttacctggaatcaaataaaaattctagattaccatgaagaacataaaa

SEQ ID NO: 4477 - DNA, 1550 bp, Homo sapiens
cagttgcataaagaacatagatgagagctttcattccctgctgaaaaggatgccatgcctccaccagtgattgccccctgtgggtcactttctcagtcattttgagctcagcctaatcaaagactgaggttatgaagtcgatcctagatggccttgcagataccaccttccgcaccatcaccactgacctcctgtacgtgggctcaaatgacattcagtacgaagacatcaaaggtgacatggcatccaaattagggtacttcccacagaaattccctttaacttcctttaggggaagtcccttccaagagaagatgactgcgggagacaacccccagctagtcccagcagaccaggtgaacattacagaattttacaacaagtctctctcgtccttcaaggagaatgaggagaacatccagtgtggggagaacttcatggacatagagtgtttcatggtcctgaaccccagccagcagctggccattgcagtcctgtccctcacgctgggcaccttcacggtcctggagaacctcctggtgctgtgcgtcatcctccactcccgcagcctccgctgcaggccttcctaccacttcatcggcagcctggcggtggcagacctcctggggagtgtcatttttgtctacagcttcattgacttccacgtgttccaccgcaaagatagccgcaacgtgtttctgttcaaactgggtggggtcacggcctccttcactgcctccgtgggcagcctgttcctcacagccatcgacaggtacatatccattcacaggcccctggcctataagaggattgtcaccaggcccaaggccgtggtggcgttttgcctgatgtggaccatagccattgtgatcgccgtgctgcctctcctgggctggaactgcgagaaactgcaatctgtttgctcagacattttcccacacattgatgaaacctacctgatgttctggatcggggtcaccagcgtactgcttctgttcatcgtgtatgcgtacatgtatattctctggaaggctcacagccacgccgtccgcatgattcagcgtggcacccagaagagcatcatcatccacacgtctgaggatgggaaggtacaggtgacccggccagaccaagcccgcatggacattaggttagccaagaccctggtcctgatcctggtggtgttgatcatctgctggggccctctgcttgcaatcatggtgtatgatgtctttgggaagatgaacaagctcattaagacggtgtttgcattctgcagtatgctctgcctgctgaactccaccgtgaaccccatcatctatgctctgaggagtaaggacctgcgacacgctttccggagcatgtttccctcttgtgaaggcactgcgcagcctctggataacagcatgggggactcggactgcctgcacaaacacgcaaacaatgcagccagtgttcacagggccgcagaaagctgcatcaagagcacggtcaagattgccaaggtaaccatgtctgtgtccacagacacgtctgccgaggctctgtga

SEQ ID NO: 4478 - DNA, 1320 bp, Homo sapiens
atgaagtcgatcctagatggccttgcagataccaccttccgcaccatcaccactgacctcctgggaagtcccttccaagagaagatgactgcgggagacaacccccagctagtcccagcagaccaggtgaacattacagaattttacaacaagtctctctcgtccttcaaggagaatgaggagaacatccagtgtggggagaacttcatggacatagagtgtttcatggtcctgaaccccagccagcagctggccattgcagtcctgtccctcacgctgggcaccttcacggtcctggagaacctcctggtgctgtgcgtcatcctccactcccgcagcctccgctgcaggccttcctaccacttcatcggcagcctggcggtggcagacctcctggggagtgtcatttttgtctacagcttcattgacttccacgtgttccaccgcaaagatagccgcaacgtgtttctgttcaaactgggtggggtcacggcctccttcactgcctccgtgggcagcctgttcctcacagccatcgacaggtacatatccattcacaggcccctggcctataagaggattgtcaccaggcccaaggccgtggtggcgttttgcctgatgtggaccatagccattgtgatcgccgtgctgcctctcctgggctggaactgcgagaaactgcaatctgtttgctcagacattttcccacacattgatgaaacctacctgatgttctggatcggggtcaccagcgtactgcttctgttcatcgtgtatgcgtacatgtatattctctggaaggctcacagccacgccgtccgcatgattcagcgtggcacccagaagagcatcatcatccacacgtctgaggatgggaaggtacaggtgacccggccagaccaagcccgcatggacattaggttagccaagaccctggtcctgatcctggtggtgttgatcatctgctggggccctctgcttgcaatcatggtgtatgatgtctttgggaagatgaacaagctcattaagacggtgtttgcattctgcagtatgctctgcctgctgaactccaccgtgaaccccatcatctatgctctgaggagtaaggacctgcgacacgctttccggagcatgtttccctcttgtgaaggcactgcgcagcctctggataacagcatgggggactcggactgcctgcacaaacacgcaaacaatgcagccagtgttcacagggccgcagaaagctgcatcaagagcacggtcaagattgccaaggtaaccatgtctgtgtccacagacacgtctgccgaggctctgtga

SEQ ID NO: 4479 - DNA, 5776 bp, Homo sapiens
gcgccggcgccgcctcccgcacgctactccctctgccaccccttccttctccacttcttttccgcctccgcctcttcttgtctcccgcggcgccagcgccttcccttggcccgggcgggggcctcggctccctgcagagctctccgtagtcagtgggggatatttcgttctagcggacaaccagcccctgagctgggcgagaggtgccaagggagcttctgtcccgaggaccaggggatgcgaagggtaagacctggcagagttgcgtttggaaatactttttccgcctcccgccccctcgggattgccccctgtgggtcactttctcagtcattttgagctcagcctaatcaaagactgaggttatgaagtcgatcctagatggccttgcagataccaccttccgcaccatcaccactgacctcctgtacgtgggctcaaatgacattcagtacgaagacatcaaaggtgacatggcatccaaattagggtacttcccacagaaattccctttaacttcctttaggggaagtcccttccaagagaagatgactgcgggagacaacccccagctagtcccagcagaccaggtgaacattacagaattttacaacaagtctctctcgtccttcaaggagaatgaggagaacatccagtgtggggagaacttcatggacatagagtgtttcatggtcctgaaccccagccagcagctggccattgcagtcctgtccctcacgctgggcaccttcacggtcctggagaacctcctggtgctgtgcgtcatcctccactcccgcagcctccgctgcaggccttcctaccacttcatcggcagcctggcggtggcagacctcctggggagtgtcatttttgtctacagcttcattgacttccacgtgttccaccgcaaagatagccgcaacgtgtttctgttcaaactgggtggggtcacggcctccttcactgcctccgtgggcagcctgttcctcacagccatcgacaggtacatatccattcacaggcccctggcctataagaggattgtcaccaggcccaaggccgtggtggcgttttgcctgatgtggaccatagccattgtgatcgccgtgctgcctctcctgggctggaactgcgagaaactgcaatctgtttgctcagacattttcccacacattgatgaaacctacctgatgttctggatcggggtcaccagcgtactgcttctgttcatcgtgtatgcgtacatgtatattctctggaaggctcacagccacgccgtccgcatgattcagcgtggcacccagaagagcatcatcatccacacgtctgaggatgggaaggtacaggtgacccggccagaccaagcccgcatggacattaggttagccaagaccctggtcctgatcctggtggtgttgatcatctgctggggccctctgcttgcaatcatggtgtatgatgtctttgggaagatgaacaagctcattaagacggtgtttgcattctgcagtatgctctgcctgctgaactccaccgtgaaccccatcatctatgctctgaggagtaaggacctgcgacacgctttccggagcatgtttccctcttgtgaaggcactgcgcagcctctggataacagcatgggggactcggactgcctgcacaaacacgcaaacaatgcagccagtgttcacagggccgcagaaagctgcatcaagagcacggtcaagattgccaaggtaaccatgtctgtgtccacagacacgtctgccgaggctctgtgagcctgatgcctccctggcagcacaggaaaagaatttttttttttaagctcaaaatctagaagagtctattgtctccttggttatatttttttaactttaccatgctcaatgaaaaggtgattgtcaccatgatcacttatcagtttgctaatgtttccatagtttaggtactcaaactccattctccaggggtttacagtgaagaaagcctgttgtttaagtgactgaacgatccttcaaagtctcaatgaaataggagggaaacctttggctacacaattggaagtctaagaacccatggaaaaatgccatcaaatgaataatgcctttgtaaccacaactttcactataatgtgaaatgtaactgtccgtagtatcagagatgtccatttttacaagttatagtactagagatattttgtaaaatgtattatgtcctgtgagatgtgtatcagtgtttatgtgctattaatatttgtttagttcagcaaaactgaaaggtagacttttatgagaacaatggacaagcagtggatacgtgtcaatgtgtgcactttttttctatattattgcccatgatataactttagaaataaaccttaatatttcttcaaatatctctatttaattttgacactgaaataaccgtaaaggtttatttttctgttacctcaacaagaagaatttgaagacttcaaaatattgagcagaattcattcatacttaaaaatttattagccctgcattttcataggaagacacattatcttctggactatagctgttctaatggattataatcagaatggaagagagaaagcatattgactttttttgagcgacatctctgactttctttagtctttagctattactggatctcttaagacagcatgtgttaatcttaatgtatatcgttatcactgtgcagttgctgtttacttgaatagtattgtgttcctatattccaggtttaagtagatttcatgcctgggtggccaaacaacagtcttcattttttttaattgaaaagaagtagtgtctggatcagtaaaattatactgtgtgtgagtgtgaatataaatgtgtgtatgtgtgtttctgtcctgtaactgttacagtaatgtcataaagtgagaaaactgtgaccaagtataaacttttaccacttgctgcactcttgcacatggattcagtttctaaaattgagttcttcctgtaatcttgttgataaaaatactgactccaaccattcaaaaatttcaccccatccctccttaagagattggatcaagtattactaaattgacctttaggtattacacaagaccagtgcttagcaaaaaataatgacaggcatccaaggaagggatgtatttgtagtgttattgccaggaaaggagagtactttggtttctgagcaccgaatattgagcaatatgtcagtcactaaaaggaagacagttctacagaaaaacaatggtaacatttttcaatagcgtgtgtagatagtatgcactatatacatcacgttaaagtaggactatcacacccagcccatgtggctaaaaaagctgaatcagacagtggatgagacacacaacggcagtgaagaaccgatacacttggcattgacgtctagctatgctgtatctgtgctttgcccacatgcccttggtgacagctgagcacccagctctgtcttggtaggtttgggctaaggaacaaatctctcctttgctcgtggttagcaagatacactcaagcatgaagataaacacagctgctttcttcttacaccccggtctcatgctccttaatggcgccatgggtgcttgttgggcctttttccagtaaggaatgatattgctgaagaatctacttaaccctgacaaattttaattataatctcttcttatacagataaaacatgactcctacaaggccccaaggtttacatagtctgaagtgaagtacagagctggcatctatctggtgatttctagctctcgagatacccaagcagcctgatggggcagttccccttcttacggttcacgctctaaggcaggatgtggcttatgagatactttgcattgtctgtctgcacaccttgaatctgcctgctggctcccttactttacctctctgtcatgtgcagatgaaggctcagggtgctagaggattagtaagatctctttctaaagacaggagagattatttacaagaagaactcaccagggtttagtttgcatttaagaattgccagtcttttgtcctgcatcatcttgaacattaatccacatgtttcagagctcaccaggcagtaccaatgctcttttcacagctatgaagagctagagaaattcttgttatggtagaaaaatttcacgattcatttttgaaactgcatttgtgcgtatgcagtgtagattttatagtgtgttgtgctttcaagatctaaatcatatataataaattaagggacaatggggctgacagcactaaacttggtgcttattgatattctaagaaatatctgtgaaatatcatcacgtatgttatacaaccttcatttaaaaaggtttaaaactagttagattcactttgacacttttcatatcatttcttaacccaagtgacgaaaacattgtccccaatgaatatactcattagaattaccatttgttaatatcactcattaattaaccccataattagatccattaatttaaatgatttaaatttaagtaagttttataaggtctgacatcagaggtatcttactttcctctgaggatgatgtacttgccctgaccatgcattttaccatcacacatgttcagaaagggccaaattcccaacctgctcattttttttttatcagagtcatgatgaatcagtcctagaatgtttcatttgcacaagtagggctgcctccaagaggaacctctgatttattttgtatgaaatatatgtgaaaggatatgaatctgagagatgctgtagacatctgtcctacacttgagatgatttccaagcctctctggcactttgagttaagtctatctggtattaaatgccaaggaccttttgctgcctaaatccactctgcaggaaataggcccaaccaccagatgagaattaggccctggatgagtagcgctatagttactgtcctgttgattaatttctgccatttcatgtccataaaagagaccacccatatcatgcacacaattagatttctcacactctaactgtatatttgtatgatattttaaaatctcctaaatgctgggcaatggctattaacaattaattgtcttgcactggccttctgatgaaatgttaacaatgcctattgtaatatagaaaaaaacattctatctactgatttgggctgaatgtatgtaaataggtttctaaaaagtcagatgtttgagcagtggcctacaaatcagtaattttcggatgggagagtttctttacattgccgtggcatcttaaaagctatcttcatgtaaattgactgtactaggcctactggggatcagagttcccaagaaaggaaaccttttcttgtatctggattcaaatttatttccaatgtttcaagcgggaaacatgactctttattgtctgtaaatctaacattattacttttcctcttagaagaatattgtattgttagatgtttgttgagctggtaacatcgttgcaaccactgcaatatcttcgttagtaatctgtataatactttgtatacaagtactggtaagattgttattaaatgtagcttcagtcattaaattactatagcaaagtagtacttcttctgtaatatttacaatgtattaagcccacagtatattttatttcaatgtaattaaactgttaacttattcaaagagaaaacatctcatcatgtctattgtccaaagttacctggaatcaaataaaaattctagattaccatgaagaacataaaa

SEQ ID NO: 4480 - DNA, 8974 bp, Homo sapiens
accctctgtgcctttcttctgaaaatggggataatagcacctacttcatagggccattgtgaaataaaggaattgatatatatgtaataggctcagtgtcaccagtccataagaagctctctctatatgcttaaaagaggaaaatcagcaagacttagtggtctacctgattgtagaggtcaagaaagaggaggtgtcatagtaagtccaagttaggaacttaggtgactagaaagactactcacaatgccataagaaatgtgaaaaagttctcaggagtcaactcttgctccttgcaaacttatgtttgctaaacaactccatttacatatgaaagttttcatccataatcaaagggacacagaagacagtcacaatatatgagagagctgttccttacatggtcctggcacatccacaaacctagcttttgcctttcaactcccacccatacttaaacaccaggcttactggtcctgagtgacttgctgagtgacctgtggttggattcaatttattgcagcatcatttctaatagcaaaagatgataacctaaacctccatcagtaggaggctggtcacattcatctaacagatccttaaggcagctgaatgaagagagaggttttatatacgaatatggaactgttcacaatgtgtacttctaagaagaaaagaaaggtatgtataataatgttaattactgtttgctaaaaagaaaacaaagagggggtaaatacatatatttgtttgaatatgcatggagtatctctggaaggggtaacaagaaacttactccttgcctttgagaaaaaaaactaggtggctgggatatagggatgagagagattgacttttctctgtatgtctttctgtaccttttgaatcttaaatcttgtgaatctaatacataaagataatcaaaatttctgataaactagtttccagttggaaagtgtaaagggggagttagttaattgagggaagatggcataaggaatgggaagatgactggaatggctcacaggagctacttggagatggaggctcaaactctggttttcaggctaaatgtctattgcataaattattttttctgtcctctaattttaagaaaaaggcaaatgcaaatcactgttttaaggtaccacctaataaaaattcaactgccattttattaggttcaggtgaacatttctgtgggaactcagctgtctgctctcctgctatcatgctatcaggctggtaaaccacttaagaaaaaaagatgcctctgtgtttggagatctcattctagttatggaaataaatatgtgaactcctgattatacgacgtgatgaggcctgtaatagagggatgtgctggggaactagttatacctagtgggaggggctggtcaggaaggtctcagacatggaagtagcattggcacagacctggaaagataagtttagtaggcagagagcttctatccagataaaagaagggacaaggtgaaggaggaaggtgtgcaggtatgacggtgtattcaaagagcagcaagtcactcagggccagtaagcctggtgtttaagtatgagtgggagtcgaaaggcaaaagttaggtttgtggatgtgcaaggaccatgtaaggaacagctctcacacattgtggctgtcttctgtgtccctttgattatggatgaaaactttccatatgtaaatggagttgttaagcaaacataagtttgcaaggagcaagagttgactcctgagaaatagccgaatgtgggacatatagagcatgttctagaagaggtgaggatatgagaaaagatatgacagacagacagatgaacagggaacctaaggatactaaggatactcgagagttaacattggagccaggctgagggtaggaactcaggagatattttagataaaggagcccagaagcactgggcaactggcttggctgttggtctttggtcttttatttctgcatcctttatttctatagccactagcctttgcccctgagacactgccttgacttgattggcgttagcagactgtaccagcacactgggtgcctctgtgtggcttgtaccttagagctcctgcctctggtccagtaggtgatggctcccatctgctttattctatgacagttgcaggaaaggtgtgcagaactggttcagaagcccagactaaaaaaaaccctcaattttcttagtgatgatagaagttacccatgggagattcggggccctcagtttggcagtgcctcctactgccatcacaggctacagtgatcttgtaaaagggttacacaaccatggaggagctaagggagccttctggcttacctgtcacattagtgctgagggctctttctctgttcaccatttggtatggcattgccaatattcttgtttgcctctctgtagccaaagttgcttattgcatatagctcattccatgagagtttagactagataattatataggcagcttcatttaaaatgctaataaccttacctaaatagagcatatttctagcacaattggattgggcagctctccaggctagatcccttgattcaagttacatgatcattttttttttttaatcagcattgggagaatccttccccttctttgggtagaaaagagcttcttgtttttgttctattttgaaatacgtatatccaatcaaccagcttatttggagccttcttctgtgtgttaggcattctactaaatgctgagtagatactaagataaagtccccagtaagatcttcagtgaacttactgtctagtgggtgggaggaagtagtggaacagatgcaaacacaaagaagtattagaaaatctggtcagtaccatgatagaactctgtttgggtattctgggagcccagaaagggtgttcatcgccatgggaagcagggagctatggcaagaagtgacatcaaagtgatggggaggagttgaccaggcgggagtgtaaggggcaatgggagcaacagcactgaggtgaggagcagtcaatttgctgtgtttatggaactaaaattcatctggtgtagcccaagtggcaaggccagggctggcaagaagaagattggagaggtgggcgggagctagatcacaggaaactttttactggacttcatcctgcaggtgggagatagaaagccatcctgtttagggagacaggttgtggagagtattaaggacaagagcctgagggtcagaattggaaaggagctcagctggatggaaacatagaaggcagacgagagttgcatacatgtctggagggcctgggcctgaaaaggaaactgcgtgaaagtttatatttggtttttagggcaaagagattgaaagaggggagtcacataatcagcatacgtttatgaagattacccccacagctgtgtggcaagtgatcaaaaaggaacaggaccagagaagagcaggaaaactggtcagaaagcaggcgccctaaccctggattgccccctgtgggtcactttctcagtcattttgagctcagcctaatcaaagactgaggttatgaagtcgatcctagatggccttgcagataccaccttccgcaccatcaccactgacctcctgtacgtgggctcaaatgacattcagtacgaagacatcaaaggtgacatggcatccaaattagggtacttcccacagaaattccctttaacttcctttaggggaagtcccttccaagagaagatgactgcgggagacaacccccagctagtcccagcagaccaggtgaacattacagaattttacaacaagtctctctcgtccttcaaggagaatgaggagaacatccagtgtggggagaacttcatggacatagagtgtttcatggtcctgaaccccagccagcagctggccattgcagtcctgtccctcacgctgggcaccttcacggtcctggagaacctcctggtgctgtgcgtcatcctccactcccgcagcctccgctgcaggccttcctaccacttcatcggcagcctggcggtggcagacctcctggggagtgtcatttttgtctacagcttcattgacttccacgtgttccaccgcaaagatagccgcaacgtgtttctgttcaaactgggtggggtcacggcctccttcactgcctccgtgggcagcctgttcctcacagccatcgacaggtacatatccattcacaggcccctggcctataagaggattgtcaccaggcccaaggccgtggtggcgttttgcctgatgtggaccatagccattgtgatcgccgtgctgcctctcctgggctggaactgcgagaaactgcaatctgtttgctcagacattttcccacacattgatgaaacctacctgatgttctggatcggggtcaccagcgtactgcttctgttcatcgtgtatgcgtacatgtatattctctggaaggctcacagccacgccgtccgcatgattcagcgtggcacccagaagagcatcatcatccacacgtctgaggatgggaaggtacaggtgacccggccagaccaagcccgcatggacattaggttagccaagaccctggtcctgatcctggtggtgttgatcatctgctggggccctctgcttgcaatcatggtgtatgatgtctttgggaagatgaacaagctcattaagacggtgtttgcattctgcagtatgctctgcctgctgaactccaccgtgaaccccatcatctatgctctgaggagtaaggacctgcgacacgctttccggagcatgtttccctcttgtgaaggcactgcgcagcctctggataacagcatgggggactcggactgcctgcacaaacacgcaaacaatgcagccagtgttcacagggccgcagaaagctgcatcaagagcacggtcaagattgccaaggtaaccatgtctgtgtccacagacacgtctgccgaggctctgtgagcctgatgcctccctggcagcacaggaaaagaatttttttttttaagctcaaaatctagaagagtctattgtctccttggttatatttttttaactttaccatgctcaatgaaaaggtgattgtcaccatgatcacttatcagtttgctaatgtttccatagtttaggtactcaaactccattctccaggggtttacagtgaagaaagcctgttgtttaagtgactgaacgatccttcaaagtctcaatgaaataggagggaaacctttggctacacaattggaagtctaagaacccatggaaaaatgccatcaaatgaataatgcctttgtaaccacaactttcactataatgtgaaatgtaactgtccgtagtatcagagatgtccatttttacaagttatagtactagagatattttgtaaaatgtattatgtcctgtgagatgtgtatcagtgtttatgtgctattaatatttgtttagttcagcaaaactgaaaggtagacttttatgagaacaatggacaagcagtggatacgtgtcaatgtgtgcactttttttctatattattgcccatgatataactttagaaataaaccttaatatttcttcaaatatctctatttaattttgacactgaaataaccgtaaaggtttatttttctgttacctcaacaagaagaatttgaagacttcaaaatattgagcagaattcattcatacttaaaaatttattagccctgcattttcataggaagacacattatcttctggactatagctgttctaatggattataatcagaatggaagagagaaagcatattgactttttttgagcgacatctctgactttctttagtctttagctattactggatctcttaagacagcatgtgttaatcttaatgtatatcgttatcactgtgcagttgctgtttacttgaatagtattgtgttcctatattccaggtttaagtagatttcatgcctgggtggccaaacaacagtcttcattttttttaattgaaaagaagtagtgtctggatcagtaaaattatactgtgtgtgagtgtgaatataaatgtgtgtatgtgtgtttctgtcctgtaactgttacagtaatgtcataaagtgagaaaactgtgaccaagtataaacttttaccacttgctgcactcttgcacatggattcagtttctaaaattgagttcttcctgtaatcttgttgataaaaatactgactccaaccattcaaaaatttcaccccatccctccttaagagattggatcaagtattactaaattgacctttaggtattacacaagaccagtgcttagcaaaaaataatgacaggcatccaaggaagggatgtatttgtagtgttattgccaggaaaggagagtactttggtttctgagcaccgaatattgagcaatatgtcagtcactaaaaggaagacagttctacagaaaaacaatggtaacatttttcaatagcgtgtgtagatagtatgcactatatacatcacgttaaagtaggactatcacacccagcccatgtggctaaaaaagctgaatcagacagtggatgagacacacaacggcagtgaagaaccgatacacttggcattgacgtctagctatgctgtatctgtgctttgcccacatgcccttggtgacagctgagcacccagctctgtcttggtaggtttgggctaaggaacaaatctctcctttgctcgtggttagcaagatacactcaagcatgaagataaacacagctgctttcttcttacaccccggtctcatgctccttaatggcgccatgggtgcttgttgggcctttttccagtaaggaatgatattgctgaagaatctacttaaccctgacaaattttaattataatctcttcttatacagataaaacatgactcctacaaggccccaaggtttacatagtctgaagtgaagtacagagctggcatctatctggtgatttctagctctcgagatacccaagcagcctgatggggcagttccccttcttacggttcacgctctaaggcaggatgtggcttatgagatactttgcattgtctgtctgcacaccttgaatctgcctgctggctcccttactttacctctctgtcatgtgcagatgaaggctcagggtgctagaggattagtaagatctctttctaaagacaggagagattatttacaagaagaactcaccagggtttagtttgcatttaagaattgccagtcttttgtcctgcatcatcttgaacattaatccacatgtttcagagctcaccaggcagtaccaatgctcttttcacagctatgaagagctagagaaattcttgttatggtagaaaaatttcacgattcatttttgaaactgcatttgtgcgtatgcagtgtagattttatagtgtgttgtgctttcaagatctaaatcatatataataaattaagggacaatggggctgacagcactaaacttggtgcttattgatattctaagaaatatctgtgaaatatcatcacgtatgttatacaaccttcatttaaaaaggtttaaaactagttagattcactttgacacttttcatatcatttcttaacccaagtgacgaaaacattgtccccaatgaatatactcattagaattaccatttgttaatatcactcattaattaaccccataattagatccattaatttaaatgatttaaatttaagtaagttttataaggtctgacatcagaggtatcttactttcctctgaggatgatgtacttgccctgaccatgcattttaccatcacacatgttcagaaagggccaaattcccaacctgctcattttttttttatcagagtcatgatgaatcagtcctagaatgtttcatttgcacaagtagggctgcctccaagaggaacctctgatttattttgtatgaaatatatgtgaaaggatatgaatctgagagatgctgtagacatctgtcctacacttgagatgatttccaagcctctctggcactttgagttaagtctatctggtattaaatgccaaggaccttttgctgcctaaatccactctgcaggaaataggcccaaccaccagatgagaattaggccctggatgagtagcgctatagttactgtcctgttgattaatttctgccatttcatgtccataaaagagaccacccatatcatgcacacaattagatttctcacactctaactgtatatttgtatgatattttaaaatctcctaaatgctgggcaatggctattaacaattaattgtcttgcactggccttctgatgaaatgttaacaatgcctattgtaatatagaaaaaaacattctatctactgatttgggctgaatgtatgtaaataggtttctaaaaagtcagatgtttgagcagtggcctacaaatcagtaattttcggatgggagagtttctttacattgccgtggcatcttaaaagctatcttcatgtaaattgactgtactaggcctactggggatcagagttcccaagaaaggaaaccttttcttgtatctggattcaaatttatttccaatgtttcaagcgggaaacatgactctttattgtctgtaaatctaacattattacttttcctcttagaagaatattgtattgttagatgtttgttgagctggtaacatcgttgcaaccactgcaatatcttcgttagtaatctgtataatactttgtatacaagtactggtaagattgttattaaatgtagcttcagtcattaaattactatagcaaagtagtacttcttctgtaatatttacaatgtattaagcccacagtatattttatttcaatgtaattaaactgttaacttattcaaagagaaaacatctcatcatgtctattgtccaaagttacctggaatcaaataaaaattctagattaccatgaagaacataaaa

SEQ ID NO: 4481 - DNA, 1236 bp, Homo sapiens
atggccttgcagataccaccttccgcaccatcaccactgacctcctgtacgtgggctcaaatgacattcagtacgaagacatcaaaggagaatgaggagaacatccagtgtggggagaacttcatggacatagagtgtttcatggtcctgaaccccagccagcagctggccattgcagtcctgtccctcacgctgggcaccttcacggtcctggagaacctcctggtgctgtgcgtcatcctccactcccgcagcctccgctgcaggccttcctaccacttcatcggcagcctggcggtggcagacctcctggggagtgtcatttttgtctacagcttcattgacttccacgtgttccaccgcaaagatagccgcaacgtgtttctgttcaaactgggtggggtcacggcctccttcactgcctccgtgggcagcctgttcctcacagccatcgacaggtacatatccattcacaggcccctggcctataagaggattgtcaccaggcccaaggccgtggtggcgttttgcctgatgtggaccatagccattgtgatcgccgtgctgcctctcctgggctggaactgcgagaaactgcaatctgtttgctcagacattttcccacacattgatgaaacctacctgatgttctggatcggggtcaccagcgtactgcttctgttcatcgtgtatgcgtacatgtatattctctggaaggctcacagccacgccgtccgcatgattcagcgtggcacccagaagagcatcatcatccacacgtctgaggatgggaaggtacaggtgacccggccagaccaagcccgcatggacattaggttagccaagaccctggtcctgatcctggtggtgttgatcatctgctggggccctctgcttgcaatcatggtgtatgatgtctttgggaagatgaacaagctcattaagacggtgtttgcattctgcagtatgctctgcctgctgaactccaccgtgaaccccatcatctatgctctgaggagtaaggacctgcgacacgctttccggagcatgtttccctcttgtgaaggcactgcgcagcctctggataacagcatgggggactcggactgcctgcacaaacacgcaaacaatgcagccagtgttcacagggccgcagaaagctgcatcaagagcacggtcaagattgccaaggtaaccatgtctgtgtccacagacacgtctgccgaggctctgtga

SEQ ID NO: 4482 - DNA, 2122 bp, Homo sapiens
tcggcttatttgttttccctcctcttaggattgccccctgtgggtcactttctcagtcattttgagctcagcctaatcaaagactgaggttatgaagtcgatcctagatggccttgcagataccaccttccgcaccatcaccactgacctcctgtacgtgggctcaaatgacattcagtacgaagacatcaaaggtgacatggcatccaaattagggtacttcccacagaaattccctttaacttcctttaggggaagtcccttccaagagaagatgactgcgggagacaacccccagctagtcccagcagaccaggtgaacattacagaattttacaacaagtctctctcgtccttcaaggagaatgaggagaacatccagtgtggggagaacttcatggacatagagtgtttcatggtcctgaaccccagccagcagctggccattgcagtcctgtccctcacgctgggcaccttcacggtcctggagaacctcctggtgctgtgcgtcatcctccactcccgcagcctccgctgcaggccttcctaccacttcatcggcagcctggcggtggcagacctcctggggagtgtcatttttgtctacagcttcattgacttccacgtgttccaccgcaaagatagccgcaacgtgtttctgttcaaactgggtggggtcacggcctccttcactgcctccgtgggcagcctgttcctcacagccatcgacaggtacatatccattcacaggcccctggcctataagaggattgtcaccaggcccaaggccgtggtggcgttttgcctgatgtggaccatagccattgtgatcgccgtgctgcctctcctgggctggaactgcgagaaactgcaatctgtttgctcagacattttcccacacattgatgaaacctacctgatgttctggatcggggtcaccagcgtactgcttctgttcatcgtgtatgcgtacatgtatattctctggaaggctcacagccacgccgtccgcatgattcagcgtggcacccagaagagcatcatcatccacacgtctgaggatgggaaggtacaggtgacccggccagaccaagcccgcatggacattaggttagccaagaccctggtcctgatcctggtggtgttgatcatctgctggggccctctgcttgcaatcatggtgtatgatgtctttgggaagatgaacaagctcattaagacggtgtttgcattctgcagtatgctctgcctgctgaactccaccgtgaaccccatcatctatgctctgaggagtaaggacctgcgacacgctttccggagcatgtttccctcttgtgaaggcactgcgcagcctctggataacagcatgggggactcggactgcctgcacaaacacgcaaacaatgcagccagtgttcacagggccgcagaaagctgcatcaagagcacggtcaagattgccaaggtaaccatgtctgtgtccacagacacgtctgccgaggctctgtgagcctgatgcctccctggcagcacaggaaaagaatttttttttttaagctcaaaatctagaagagtctattgtctccttggttatatttttttaactttaccatgctcaatgaaaaggtgattgtcaccatgatcacttatcagtttgctaatgtttccatagtttaggtactcaaactccattctccaggggtttacagtgaagaaagcctgttgtttaagtgactgaacgatccttcaaagtctcaatgaaataggagggaaacctttggctacacaattggaagtctaagaacccatggaaaaatgccatcaaatgaataatgcctttgtaaccacaactttcactataatgtgaaatgtaactgtccgtagtatcagagatgtccatttttacaagttatagtactagagatattttgtaaaatgtattatgtcctgtgagatgtgtatcagtgtttatgtgctattaatatttgtttagttcagcaaaactgaaaggtagacttttatgagaacaatggacaagcagtggatacgtgtcaatgtgtgcactttttttctatattattgcccatgatataactttagaaataaaccttaatatttcttc

SEQ ID NO: 4483 - DNA, 591 bp, Homo sapiens
gcagagctctccgtagtcagtgggggatatttcgttctagcggacaaccagcccctgagctgggcgagaggtgccaagggagcttctgtcccgaggaccaggggatgcgaaggatgtctcccactccaggcgaggagcgctcttggctgagggcaaagagattgaaagaggggagtcacataatcagcatacgtttatgaagattacccccacagctgtgtggcaagtgatcaaaaaggaacaggaccagagaagagcaggaaaactggtcagaaagcaggcgccctaaccctggattgccccctgtgggtcactttctcagtcattttgagctcagcctaatcaaagactgaggttatgaagtcgatcctagatggccttgcagataccaccttccgcaccatcaccactgacctcctgtacgtgggctcaaatgacattcagtacgaagacatcaaaggtgacatggcatccaaattagggtacttcccacagaaattccctttaacttcctttaggggaagtcccttccaagagaagatgactgcgggagacaacccccagctagtcccagcagaccaggtgaacatt

SEQ ID NO: 4484 - DNA, 5254 bp, Homo sapiens
ggcactcaacaggtgctctgagtggcacccacggccaggtcctgggagaggacagaaaacaactgggactcctcagcccccggcagctcccagtgcccagccacccacaacacaacccaaagccttctagacaagctcagtggaatctgaagggcccaccccatggaggaatgctgggtgacagagatagccaatggctccaaggatggcttggattccaaccctatgaaggattacatgatcctgagtggtccccagaagacagctgttgctgtgttgtgcactcttctgggcctgctaagtgccctggagaacgtggctgtgctctatctgatcctgtcctcccaccaactccgccggaagccctcatacctgttcattggcagcttggctggggctgacttcctggccagtgtggtctttgcatgcagctttgtgaatttccatgttttccatggtgtggattccaaggctgtcttcctgctgaagattggcagcgtgactatgaccttcacagcctctgtgggtagcctcctgctgaccgccattgaccgatacctctgcctgcgctatccaccttcctacaaagctctgctcacccgtggaagggcactggtgaccctgggcatcatgtgggtcctctcagcactagtctcctacctgcccctcatgggatggacttgctgtcccaggccctgctctgagcttttcccactgatccccaatgactacctgctgagctggctcctgttcatcgccttcctcttttccggaatcatctacacctatgggcatgttctctggaaggcccatcagcatgtggccagcttgtctggccaccaggacaggcaggtgccaggaatggcccgaatgaggctggatgtgaggttggccaagaccctagggctagtgttggctgtgctcctcatctgttggttcccagtgctggccctcatggcccacagcctggccactacgctcagtgaccaggtcaagaaggcctttgctttctgctccatgctgtgcctcatcaactccatggtcaaccctgtcatctatgctctacggagtggagagatccgctcctctgcccatcactgcctggctcactggaagaagtgtgtgaggggccttgggtcagaggcaaaagaagaagccccgagatcctcagtcaccgagacagaggctgatgggaaaatcactccgtggccagattccagagatctagacctctctgattgctgatgaggcctcttcccaatttaaacaactcaagtcagaaatcagttcactccctggaagagagagaggggtcttggcactctcttcttacttaaaccagtcccagacacctagacacggacccctttttgctgatgagtgttgggactgactcctggaagacagcctggccttgcccacctgcacacagtctgttggataggtagggccacgaggagtagccaggtaggcgagacacaaaaggcctgggacagggtcagtacaagtcaggtcaggcttcatgcctgcatcctccagagaccacaggagccaaagcgagcctccaggcccagcaatgagggacttgggagaaatctgagaagaatgggttgttctcttgggaagtcagggtatcagatgggatggacatccaggtcttctctctgcctaattgtcaaggcctccttggctctggagctatgaaaggccccactttcaagtcacccttgccactgaggaccgaggactatgctatgatgaggattaaggtgttgacttgcctctttcagagataaatgacaagccttcagtttggggcatcctgttgtttgggcgaggaccctctctgatattctgataatccccacctgtaacctcaggtccctggaaatacagaggaggctgggatcgcctgagacacaaaaatctttggagaattttcttgaccctctgaagtccttccagcagcagtcctggtggtgctgctggaagcaggcaatgtcctagtctaacctaactcgaagaaaaaaaggaagatattcacaaagattgtataaatctccaaactgttcccctatctgcccccaattcagctcccttgcctcctccacacccctattacatataataagcagagcaagtgggaggaggggaaatgtccttcctatatgccaggtatggggctgacatttcagtctattgaccccagctagaatatagctccatgattttaaagatctcaggggccaggcatggtagctcatgcctgtaatcccagcactttgggaggccaaggcaggtggatcacctgaggtcaggagtttgagaccagcctgaccaatatggtgaaaccctgtctctactaaaaatacaaaaattagcagggcatggtggcaggcacctgtagtcccagctactcgggaggctgagacaggagaattgcttgaaccctggaggcagaggttgcagtgagccgagattgcaccactgcactccagcctgggtgacagagcaagactgtctcaaaaaaataaaataaaatagatcccagggtactcatttttcatatgagggaggctgggttcctcccagaggagcctaaaacagccaacaagagaaattgttggcggcaggaagattgcagaggaattctaatgcaattatttgggacctcaaatggaataaaatgaaagatattggttaaacatgtcttcgtttaatactttcaagacaaaatatccactagctattcacttattcattcatctcataaacatgagccaggctctgtgcagggtcctgagtacccagccataaatgagactgtgcccctgtctcatggggcttacagtctatatcctgcttgcaagacagccaataagtcaataaagaagataattacaggcagtacaacaaaggaaatatgcaggttcatgtcatgtaatagggattaattgagttaactcaataaacggtaggatagacctaccatgtgccggctcacttttattgagcctttactatgtgccaggcagggggctaagtgtttttaaatgccttatttcacttcatgtttcccaacaacctaataagaaggtcttagttatcttcattttacagatgtggcaacctcaaagatgcaaagtcacttgtctaaggtcaccctgctaagtaccagagctgaggtctccaacctagttctgtttgacttcaaagcctgccctcttaaccactaaccttttgtcctagttcagtcaaattctgcttgattattgctcattagggataatattagctatctgtagcatcagattgctgcaaagttaactcatcgtagattctcaatatactccattttattaaatggccccgtattaatctcctgtaataaatttcacaaatccagtggcttatcaacagaaatttactgtctcataattctggaggccagaagtcaaaatcaagatgtggtagggccctgctccctccaaaagtttaaggggagaattattccttgactctttcaacttctggcagtccctgtcattccttggcttgtggaaacatcactcctacctctgactctgtcttcatatggcatttcctctgtgtctcttggtgtcttttttttttttttttttttttttgagacggaatctcattctgttgtccaggcaggagtgcagtgacatgatcttggctcactgcaacctccacctctcaggttcaagtgattctcctgcctcagcctcccaaatagctgggactacaggcacccgccaccacactcagctaatttttgtatttttagtagagatggggtttcaccatcttgcccaggctggtcttgaactcctgacctcaagtgatccgcccaccttggcctcctaaattgctgggattacagacgtgagccaccatacccggcctggtgtcttttttaaagaatatcagtcactggatttgggcccaccctaatcctaatagtatgacttcatcttaatttaaccaattatatctgtagagaccctgtttccaaataaggtcacattcacagattccaggtggacaagaagtttaggcggacactattcaactcagtacagacccaggaacaaagtccacccactgggctgtgttgagtggcagtcactagtttatcctccctcaacaagatgagctccaggttgacctctgcatccccagtgctcagtcaggacccagcagagcatctgaagggatctggtcaatatgtgtggaactgaactgtttctgaaaagctctgacgtatgttttggaaaatcaaatcttgttttaatccagacaccaatctttttgtaaggcaaacaagtagcataaatgtttaaaagtgaatttgcatgtttatatactgtcattccttaaagttgaagcatgcctttctttattcatcggtggaatcctttctcattttggcaaagaaaatgcccaagtgcctggcacaaacaagcactgagtaaatacttcttgaatgaataaaactagattctaaaaatcatttgatcaaacgcaactccacactttctacttctcttcttttagaaccacactgtatttctgctttttttttttttttttttttttttgacatagaatctcactctgtcacccaggttggagtgcagtggcatgcaatcttggctcactgcaacctctgcctcctgggttcaagcagttctcctgccttagcctcccatgtagctgggattacaggtacccgccaccatgcccagctaatttttgtattgttagtagagatggaatttcaccatattggccaggctggtcttgaactcctgacttcaagtgatccacccaccttagcctcccaaagtgctaggattacaggtgtgagccaccactcccagcccctatgtctgctttaagtggagaagcagagcttatgagggaggagaacaagggtgcaaaagggacctagatatcactgagaactgcccttgttgtttggttgaggaaatgggcccagacagtggacaagacttgctcagggagacaaacgagatggtgtccagtgcaacaaacctaggtttcctaacttccagttctgtccactctacatcagtgcctctcacctgtccctgcaggttcacattttggttatgtggataaggagaaataaattgaagatcacaatgtcccattttatcttccccaagacaagctctgtaacattaaagaccactatgcaaaccga

SEQ ID NO: 4485 - DNA, 5350 bp, Homo sapiens
cgccttcgcgcgttgtaagtgcacagtaagtttgctgaaagaatgaggactgctctcctcccctttctgccccacttgtaagtgaaaaaggggaagaaagagaatattgttcagttgattatgccagccagatgcagccgccgccgctccactgtcactctccaaggccagcgccacctctcactcaccgagctccagccgaaggagaagggggcaaagccttctagacaagctcagtggaatctgaagggcccaccccatggaggaatgctgggtgacagagatagccaatggctccaaggatggcttggattccaaccctatgaaggattacatgatcctgagtggtccccagaagacagctgttgctgtgttgtgcactcttctgggcctgctaagtgccctggagaacgtggctgtgctctatctgatcctgtcctcccaccaactccgccggaagccctcatacctgttcattggcagcttggctggggctgacttcctggccagtgtggtctttgcatgcagctttgtgaatttccatgttttccatggtgtggattccaaggctgtcttcctgctgaagattggcagcgtgactatgaccttcacagcctctgtgggtagcctcctgctgaccgccattgaccgatacctctgcctgcgctatccaccttcctacaaagctctgctcacccgtggaagggcactggtgaccctgggcatcatgtgggtcctctcagcactagtctcctacctgcccctcatgggatggacttgctgtcccaggccctgctctgagcttttcccactgatccccaatgactacctgctgagctggctcctgttcatcgccttcctcttttccggaatcatctacacctatgggcatgttctctggaaggcccatcagcatgtggccagcttgtctggccaccaggacaggcaggtgccaggaatggcccgaatgaggctggatgtgaggttggccaagaccctagggctagtgttggctgtgctcctcatctgttggttcccagtgctggccctcatggcccacagcctggccactacgctcagtgaccaggtcaagaaggcctttgctttctgctccatgctgtgcctcatcaactccatggtcaaccctgtcatctatgctctacggagtggagagatccgctcctctgcccatcactgcctggctcactggaagaagtgtgtgaggggccttgggtcagaggcaaaagaagaagccccgagatcctcagtcaccgagacagaggctgatgggaaaatcactccgtggccagattccagagatctagacctctctgattgctgatgaggcctcttcccaatttaaacaactcaagtcagaaatcagttcactccctggaagagagagaggggtcttggcactctcttcttacttaaaccagtcccagacacctagacacggacccctttttgctgatgagtgttgggactgactcctggaagacagcctggccttgcccacctgcacacagtctgttggataggtagggccacgaggagtagccaggtaggcgagacacaaaaggcctgggacagggtcagtacaagtcaggtcaggcttcatgcctgcatcctccagagaccacaggagccaaagcgagcctccaggcccagcaatgagggacttgggagaaatctgagaagaatgggttgttctcttgggaagtcagggtatcagatgggatggacatccaggtcttctctctgcctaattgtcaaggcctccttggctctggagctatgaaaggccccactttcaagtcacccttgccactgaggaccgaggactatgctatgatgaggattaaggtgttgacttgcctctttcagagataaatgacaagccttcagtttggggcatcctgttgtttgggcgaggaccctctctgatattctgataatccccacctgtaacctcaggtccctggaaatacagaggaggctgggatcgcctgagacacaaaaatctttggagaattttcttgaccctctgaagtccttccagcagcagtcctggtggtgctgctggaagcaggcaatgtcctagtctaacctaactcgaagaaaaaaaggaagatattcacaaagattgtataaatctccaaactgttcccctatctgcccccaattcagctcccttgcctcctccacacccctattacatataataagcagagcaagtgggaggaggggaaatgtccttcctatatgccaggtatggggctgacatttcagtctattgaccccagctagaatatagctccatgattttaaagatctcaggggccaggcatggtagctcatgcctgtaatcccagcactttgggaggccaaggcaggtggatcacctgaggtcaggagtttgagaccagcctgaccaatatggtgaaaccctgtctctactaaaaatacaaaaattagcagggcatggtggcaggcacctgtagtcccagctactcgggaggctgagacaggagaattgcttgaaccctggaggcagaggttgcagtgagccgagattgcaccactgcactccagcctgggtgacagagcaagactgtctcaaaaaaataaaataaaatagatcccagggtactcatttttcatatgagggaggctgggttcctcccagaggagcctaaaacagccaacaagagaaattgttggcggcaggaagattgcagaggaattctaatgcaattatttgggacctcaaatggaataaaatgaaagatattggttaaacatgtcttcgtttaatactttcaagacaaaatatccactagctattcacttattcattcatctcataaacatgagccaggctctgtgcagggtcctgagtacccagccataaatgagactgtgcccctgtctcatggggcttacagtctatatcctgcttgcaagacagccaataagtcaataaagaagataattacaggcagtacaacaaaggaaatatgcaggttcatgtcatgtaatagggattaattgagttaactcaataaacggtaggatagacctaccatgtgccggctcacttttattgagcctttactatgtgccaggcagggggctaagtgtttttaaatgccttatttcacttcatgtttcccaacaacctaataagaaggtcttagttatcttcattttacagatgtggcaacctcaaagatgcaaagtcacttgtctaaggtcaccctgctaagtaccagagctgaggtctccaacctagttctgtttgacttcaaagcctgccctcttaaccactaaccttttgtcctagttcagtcaaattctgcttgattattgctcattagggataatattagctatctgtagcatcagattgctgcaaagttaactcatcgtagattctcaatatactccattttattaaatggccccgtattaatctcctgtaataaatttcacaaatccagtggcttatcaacagaaatttactgtctcataattctggaggccagaagtcaaaatcaagatgtggtagggccctgctccctccaaaagtttaaggggagaattattccttgactctttcaacttctggcagtccctgtcattccttggcttgtggaaacatcactcctacctctgactctgtcttcatatggcatttcctctgtgtctcttggtgtcttttttttttttttttttttttttgagacggaatctcattctgttgtccaggcaggagtgcagtgacatgatcttggctcactgcaacctccacctctcaggttcaagtgattctcctgcctcagcctcccaaatagctgggactacaggcacccgccaccacactcagctaatttttgtatttttagtagagatggggtttcaccatcttgcccaggctggtcttgaactcctgacctcaagtgatccgcccaccttggcctcctaaattgctgggattacagacgtgagccaccatacccggcctggtgtcttttttaaagaatatcagtcactggatttgggcccaccctaatcctaatagtatgacttcatcttaatttaaccaattatatctgtagagaccctgtttccaaataaggtcacattcacagattccaggtggacaagaagtttaggcggacactattcaactcagtacagacccaggaacaaagtccacccactgggctgtgttgagtggcagtcactagtttatcctccctcaacaagatgagctccaggttgacctctgcatccccagtgctcagtcaggacccagcagagcatctgaagggatctggtcaatatgtgtggaactgaactgtttctgaaaagctctgacgtatgttttggaaaatcaaatcttgttttaatccagacaccaatctttttgtaaggcaaacaagtagcataaatgtttaaaagtgaatttgcatgtttatatactgtcattccttaaagttgaagcatgcctttctttattcatcggtggaatcctttctcattttggcaaagaaaatgcccaagtgcctggcacaaacaagcactgagtaaatacttcttgaatgaataaaactagattctaaaaatcatttgatcaaacgcaactccacactttctacttctcttcttttagaaccacactgtatttctgctttttttttttttttttttttttttgacatagaatctcactctgtcacccaggttggagtgcagtggcatgcaatcttggctcactgcaacctctgcctcctgggttcaagcagttctcctgccttagcctcccatgtagctgggattacaggtacccgccaccatgcccagctaatttttgtattgttagtagagatggaatttcaccatattggccaggctggtcttgaactcctgacttcaagtgatccacccaccttagcctcccaaagtgctaggattacaggtgtgagccaccactcccagcccctatgtctgctttaagtggagaagcagagcttatgagggaggagaacaagggtgcaaaagggacctagatatcactgagaactgcccttgttgtttggttgaggaaatgggcccagacagtggacaagacttgctcagggagacaaacgagatggtgtccagtgcaacaaacctaggtttcctaacttccagttctgtccactctacatcagtgcctctcacctgtccctgcaggttcacattttggttatgtggataaggagaaataaattgaagatcacaatgtcccattttatcttccccaagacaagctctgtaacattaaagaccactatgcaaaccg

SEQ ID NO: 4486 - DNA, 1704 bp, Homo sapiens
gcaggcttcttctcgggtcttggtcctgcatcctctctctcccagagcctccgttagggggtgggaaaggactttgccataggtcgctgaggccaccatctgctctcttactggccaagggcgtaaaaagatagtcttcccattagctagagagcaaaccccagaaagcctattggctgcgccgtccgcgggccttggtccgctttgaaggcgggctgcggctgcgagaggagggcgggcgggaggctagctgttgtcgtggttgctcggaggcacgtgtgcagtcccggaagcggcgaggggaaactgctccgcgcgcgccgcgggaggaggaaccgcccggtcctttagggtccgggcccggccgggccatggattcaatgcctgagcccgcgtcccgctgtcttctgcttcttcccttgctgctgctgctgctgctgctgctgccggccccggagctgggcccgagccaggccggagctgaggagaacgactgggttcgcctgcccagcaaatgcgaagtgtgtaaatatgttgctgtggagctgaagtcagcctttgaggaaaccggcaagaccaaggaggtgattggcacgggctatggcatcctggaccagaaggcctctggagtcaaatacaccaagtcggacttgcggttaatcgaagtcactgagaccatttgcaagaggctcctggattatagcctgcacaaggagaggaccggcagcaatcgatttgccaagggcatgtcagagacctttgagacattacacaacctggtacacaaaggggtcaaggtggtgatggacatcccctatgagctgtggaacgagacttctgcagaggtggctgacctcaagaagcagtgtgatgtgctggtggaagagtttgaggaggtgatcgaggactggtacaggaaccaccaggaggaagacctgactgaattcctctgcgccaaccacgtgctgaagggaaaagacaccagttgcctggcagagcagtggtccggcaagaagggagacacagctgccctgggagggaagaagtccaagaagaagagcagcagggccaaggcagcaggcggcaggagtagcagcagcaaacaaaggaaggagctgggtggccttgagggagaccccagccccgaggaggatgagggcatccagaaggcatcccctctcacacacagcccccctgatgagctctgagcccacccagcatcctctgtcctgagacccctgattttgaagctgaggagtcaggggcatggctctggcaggccgggatggccccgcagccttcagcccctccttgccttggctgtgccctcttctgccaaggaaagacacaagccccaggaagaactcagagccgtcatgggtagcccacgccgtcctttcccctccccaagtgtttctctcctgacccagggttcaggcaggccttgtggtttcaggactgcaaggactccagtgtgaactcaggaggggcaggtgtcagaactgggcaccaggactggagccccctccggagaccaaactcaccatccctcagtcctccccaacagggtactaggactgcagccccctgtagctcctctctgcttacccctcctgtggacaccttgcactctgcctggcccttcccagagcccaaagagtaaaaatgttctggttctgatttctgagtcctctgcagccctca

SEQ ID NO: 4487 - DNA, 1518 bp, Homo sapiens
gagcctccgttagggggtgggaaaggactttgccataggtcgctgaggccaccatctgctctcttactggccaagggcgtaaaaagatagtcttcccattagctagagagcaaaccccagaaagcctattggctgcgccgtccgcgggccttggtccgctttgaaggcgggctgcggctgcgagaggagggcgggcgggaggctagctgttgtcgtggttgctcggaggcacgtgtgcagtcccggaagcggcgaggggaaactgctccgcgcgcgccgcgggaggaggaaccgcccggtcctttagggtccgggcccggccgggccatggattcaatgcctgagcccgcgtcccgctgtcttctgcttcttcccttgctgctgctgctgctgctgctgctgccggccccggagctgggcccgagccaggccggagctgaggagaacgactgggttcgcctgcccagcaaatgcgaagggacttgcggttaatcgaagtcactgagaccatttgcaagaggctcctggattatagcctgcacaaggagaggaccggcagcaatcgatttgccaagggcatgtcagagacctttgagacattacacaacctggtacacaaaggggtcaaggtggtgatggacatcccctatgagctgtggaacgagacttctgcagaggtggctgacctcaagaagcagtgtgatgtgctggtggaagagtttgaggaggtgatcgaggactggtacaggaaccaccaggaggaagacctgactgaattcctctgcgccaaccacgtgctgaagggaaaagacaccagttgcctggcagagcagtggtccggcaagaagggagacacagctgccctgggagggaagaagtccaagaagaagagcagcagggccaaggcagcaggcggcaggagtagcagcagcaaacaaaggaaggagctgggtggccttgagggagaccccagccccgaggaggatgagggcatccagaaggcatcccctctcacacacagcccccctgatgagctctgagcccacccagcatcctctgtcctgagacccctgattttgaagctgaggagtcaggggcatggctctggcaggccgggatggccccgcagccttcagcccctccttgccttggctgtgccctcttctgccaaggaaagacacaagccccaggaagaactcagagccgtcatgggtagcccacgccgtcctttcccctccccaagtgtttctctcctgacccagggttcaggcaggccttgtggtttcaggactgcaaggactccagtgtgaactcaggaggggcaggtgtcagaactgggcaccaggactggagccccctccggagaccaaactcaccatccctcagtcctccccaacagggtactaggactgcagccccctgtagctcctctctgcttacccctcctgtggacaccttgcactctgcctggcccttcccagagcccaaagagtaaaaatgttctggttctgatttctg

SEQ ID NO: 4488 - DNA, 1502 bp, Homo sapiens
tgatcctgcgcatgcgccgaccttcctcggctggatttaaggttgccgctagccgcctgggaatttaagggacccacactaccttcccgaagttgaaggcaagcggtgattgtttgtagacggcgctttgtcatgggacctgtgcggttgggaatattgcttttcctttttttggccgtgcacgaggcttgggctgggatgttgaaggaggaggacgatgacacagaacgcttgcccagcaaatgcgaagtgtgtaagctgctgagcacagagctacaggcggaactgagtcgcaccggtcgatctcgagaggtgctggagctggggcaggtgctggatacaggcaagaggaagagacacgtgccttacagcgtttcagagacaaggctggaagaggccttagagaatttatgtgagcggatcctggactatagtgttcacgctgagcgcaagggctcactgagatatgccaagggtcagagtcagaccatggcaacactgaaaggcctagtgcagaagggggtgaaggtggatctggggatccctctggagctttgggatgagcccagcgtggaggtcacatacctcaagaagcagtgtgagaccatgttggaggagtttgaagacattgtgggagactggtacttccaccatcaggagcagcccctacaaaattttctctgtgaaggtcatgtgctcccagctgctgaaactgcatgtctacaggaaacttggactggaaaggagatcacagatggggaagagaaaacagaaggggaggaagagcaggaggaggaggaggaagaggaggaagaggaagggggagacaagatgaccaagacaggaagccaccccaaacttgaccgagaagatctttgacccttgcctttgagcccccaggaggggaagggatcatggagagccctctaaagcctgcactctccctgctccacagctttcagggtgtgtttatgagtgactccacccaagcttgtagctgttctctcccatctaacctcaggcaagatcctggtgaaacagcatgacatggcttctggggtggagggtgggggtggaggtcctgctcctagagatgaactctatccagccccttaattggcaggtgtatgtgctgacagtactgaaagctttcctctttaactgatcccacccccacccaaaagtcagcagtggcactggagctgtgggctttggggaagtcacttagctccttaaggtctgtttttagacccttccaaggaagaggccagaacggacattctctgcgatctatatacattgcctgtatccaggaggctacacaccagcaaaccgtgaaggagaatgggacactgggtcatggcctggagttgctgataatttaggtgggatagatacttggtctacttaagctcaatgtaacccagagcccaccatatagttttataggtgctcaattttctatatcgctattaaacttttttctttttttctaaaaacta

SEQ ID NO: 4489 - DNA, 3316 bp, Homo sapiens
atattgggtctggggacacacatgccgtctcttgattcctaaggatccattacccatttctctgcacagatcttcgggtatccaacctatctgtgcctccttcagccaggagcctccggatctttccagacttctttgcaatactgcctcatgcactgaatccatttctcgcatagcctggcgcttggcaggcaggctggcgttccctggctctgccttccccatctccctgtcttttctcccacggcccatctgcccctcctttcctccacccccttctcctctctgctcccctttatttccactccccacccgcgtggctttgctctccctctcccccctcagctcgtctgtatttggagctccggaagctgccggcgactctcccctggagcagcgtgactgacaccggctcctattcagctgggaggagggagaggggaggagaaggggagggccgcgggaggagggtacgagtggccgaccacggatttgcattgccgaggacgggaccccagggcagcgaagcagaatggccaacatgcagggactggtggaaagactggaacgagctgtcagccgcctggagtcgctgtctgcagagtcccacaggccccctgggaactgcggggaagtcaatggtgtcattgcaggtgtggcaccctccgtggaagcctttgacaagctgatggacagtatggtggccgagtttttaaagaacagtaggatccttgctggggacgtggagacccatgcagaaatggtgcacagtgctttccaggcccagcgggctttccttctgatggcctctcagtaccaacaaccccacgagaatgacgtggccgcacttctgaaacccatatcggaaaagattcaggaaatccaaactttcagagagagaaaccgggggagtaacatgtttaatcatctttcggccgtcagcgaaagcatccctgcccttggatggatagctgtgtctcccaaacctggtccttatgtcaaggagatgaatgacgctgccaccttttacactaacagggtcttaaaggactacaaacacagtgatttgcgtcatgtggattgggtgaagtcatatttgaacatttggagtgaacttcaagcatacatcaaggaacaccacaccacgggcctcacatggagcaaaacaggtcctgtagcatccacagtatcagcgttttctgtcctctcctctgggcctggccttcctccaccccctcctcctctgcctcctccagggccacctccacttttcgagaatgaaggcaaaaaagaggaatcttctccttcacgctcagctttatttgcccaacttaaccagggagaagcaattacaaaagggctccgccatgtcacagatgaccagaagacatacaaaaatcccagcctgcgggctcaaggagggcaaactcaatctcccaccaaaagtcacactccaagtcccacatctcctaaatcttatccttctcaaaaacatgccccagtgttggagttggaaggaaagaaatggagagtggagtaccaagaggacaggaatgaccttgtgatttcagagactgagctgaaacaagtggcttacattttcaaatgcgaaaaatcaactattcagataaaagggaaagtaaactccattataattgacaactgtaaaaaactcggcctggtgtttgacaatgtggtgggcattgtggaagtgatcaactcccaggacattcaaatccaggtaatggggagagtgccaacaatttccattaataagacagaaggttgccacatatacctcagtgaagatgcattagactgtgagatcgtgagcgccaagtcatctgaaatgaacatacttatccctcaggatggtgattatagagaatttcccattcctgaacagttcaagacagcatgggatggatccaagttaatcactgaacctgcagaaattatggcctaacttcctgagagaccgaaccccctcacctgaatccccctctatcaaacaaacaaaaaagcagcagtaaagagctagaagttgcagtagcccctactgctttagctttggcctccaacgattctgtgctatagatacagcactgtttctggcacgcctcgtgggcattttgaaatatttaacgtttcctcatgatttgcctttgtgtgtgattttagttccacatgatgacttgtgaacattagggatttaaaggaaaaaaaaaaagaattctgttcccctcatatcatgaacacagtaactgataggtaaaaagactgcatgattcacttttacacttatatttcattgctagttaaaaaataaaacctttgagaatctaagatgtacatttttaccttttaggcaatttcaatataatgtagaagtagtagtgtgccctgaaaaatgtacacgttttttcttattgttaccacatgttcacctttatcagcgtggatactgtcagcatgagtacatatttcaacccacgcttgtaaaagacataagagtttataaaggaccaaattcagttccttggtccttggaagacctatattctctgtagttactgaaaaccgaaagtcaattctaattattcatcttacatatttttccaccatgtcatttgaaaacttgcttttcttctgcataagagattcttatgccaaaaacattaaacagaagaaatcattttttttgctatgtaatacctcgcaactttgctctaaaatcaagctcagttattattttccaagtttgaacatgttaaatatcagatgccttgtaaattatgtctttaacgttttcttatagactaatttcctcttttccacctgccagacttgctaaccaagctcgaaaatgaacatgaaaaagccatacatgtattatttctcctaaaacctaaggcattatctgttggtttggcttgctgctcctattttgtagtcttgatagtagatgcttcttcagcgtaagagtagctatgatattcctttttatcttttcagtacatagtgctgaaaaatctgcaacttcttggatcatatttaatgaattatagtataatgcttgcaggcccagtacaagcatatatattgtgcctcttacagcctttggaatacattgtttccattttttaaatatcttctatatccatatagtattcaaattattaatgctcatgtaccaaggttttgctataaaagttttgtctgtatgaataatgtggctttagtaaataatcatttttcaactgtaaacttattctgaaataaagtaaaattctaattgtttaaatactgtgatgaa

SEQ ID NO: 4490 - DNA, 2686 bp, Homo sapiens
gactctcccctggagcagcgtgactgacaccggctcctattcagctgggaggagggagaggggaggagaaggggagggccgcgggaggagggtacgagtggccgaccacggatttgcattgccgaggacgggaccccagggcagcgaagcagaatggccaacatgcagggactggtggaaagactggaacgagctgtcagccgcctggagtcgctgtctgcagagtcccacaggccccctgggaactgcggggaagtcaatggtgtcattgcaggtgtggcaccctccgtggaagcctttgacaagctgatggacagtatggtggccgagtttttaaagaacagtaggatccttgctggggacgtggagacccatgcagaaatggtgcacagtgctttccaggcccagcgggctttccttctgatggcctctcagtaccaacaaccccacgagaatgacgtggccgcacttctgaaacccatatcggaaaagattcaggaaatccaaactttcagagagagaaaccgggggagtaacatgtttaatcatctttcggccgtcagcgaaagcatccctgcccttggatggatagctgtgtctcccaaacctcctcctctgcctcctccagggccacctccacttttcgagaatgaaggcaaaaaagaggaatcttctccttcacgctcagctttatttgcccaacttaaccagggagaagcaattacaaaagggctccgccatgtcacagatgaccagaagacatacaaaaatcccagcctgcgggctcaaggagggcaaactcaatctcccaccaaaagtcacactccaagtcccacatctcctaaatcttatccttctcaaaaacatgccccagtgttggagttggaaggaaagaaatggagagtggagtaccaagaggacaggaatgaccttgtgatttcagagactgagctgaaacaagtggcttacattttcaaatgcgaaaaatcaactattcagataaaagggaaagtaaactccattataattgacaactgtaaaaaactcggcctggtgtttgacaatgtggtgggcattgtggaagtgatcaactcccaggacattcaaatccaggtaatggggagagtgccaacaatttccattaataagacagaaggttgccacatatacctcagtgaagatgcattagactgtgagatcgtgagcgccaagtcatctgaaatgaacatacttatccctcaggatggtgattatagagaatttcccattcctgaacagttcaagacagcatgggatggatccaagttaatcactgaacctgcagaaattatggcctaacttcctgagagaccgaaccccctcacctgaatccccctctatcaaacaaacaaaaaagcagcagtaaagagctagaagttgcagtagcccctactgctttagctttggcctccaacgattctgtgctatagatacagcactgtttctggcacgcctcgtgggcattttgaaatatttaacgtttcctcatgatttgcctttgtgtgtgattttagttccacatgatgacttgtgaacattagggatttaaaggaaaaaaaaaaagaattctgttcccctcatatcatgaacacagtaactgataggtaaaaagactgcatgattcacttttacacttatatttcattgctagttaaaaaataaaacctttgagaatctaagatgtacatttttaccttttaggcaatttcaatataatgtagaagtagtagtgtgccctgaaaaatgtacacgttttttcttattgttaccacatgttcacctttatcagcgtggatactgtcagcatgagtacatatttcaacccacgcttgtaaaagacataagagtttataaaggaccaaattcagttccttggtccttggaagacctatattctctgtagttactgaaaaccgaaagtcaattctaattattcatcttacatatttttccaccatgtcatttgaaaacttgcttttcttctgcataagagattcttatgccaaaaacattaaacagaagaaatcattttttttgctatgtaatacctcgcaactttgctctaaaatcaagctcagttattattttccaagtttgaacatgttaaatatcagatgccttgtaaattatgtctttaacgttttcttatagactaatttcctcttttccacctgccagacttgctaaccaagctcgaaaatgaacatgaaaaagccatacatgtattatttctcctaaaacctaaggcattatctgttggtttggcttgctgctcctattttgtagtcttgatagtagatgcttcttcagcgtaagagtagctatgatattcctttttatcttttcagtacatagtgctgaaaaatctgcaacttcttggatcatatttaatgaattatagtataatgcttgcaggcccagtacaagcatatatattgtgcctcttacagcctttggaatacattgtttccattttttaaatatcttctatatccatatagtattcaaattattaatgctcatgtaccaaggttttgctataaaagttttgtctgtatgaataatgtggctttagtaaataatcatttttcaactgtaaacttattctgaaataaagtaaaattctaattgtttaaatactgtgatg

SEQ ID NO: 4491 - DNA, 5563 bp, Homo sapiens
cggctcggccgcggggcgcgcaggcggctgctgggcggcctcggtgcgcgcctcccgccttcccagagacgtggcgcgaggcccgggccctgagcacctatcgcggggatccccggcgccaggagggggtgcagccggtgggcagcgccgcgcagggaggggccgcagcatcctcgccccccagcgcgcccgggcccgagaggaggaggccggggctctccgggcctcccgccgcttagcctgatgctggaaggacgaaggtgagtgaagatggcagagaggacgtgaccagcactcacccttgtccacctgcccagtggcaccgccatgcagaagcccagcggcctgaagccccccggccgtggggggaagcactccagccccatgggccggacatctactgggtcagcttcatcctcggcggcggtggccgctagctccaaggaaggctccccactgcacaaacagtcatctggaccctcctcctccccggccgcagctgctgcccccgagaagccgggccccaaggcggcggaagtgggggatgacttcctgggggactttgtggtgggcgagcgggtgtgggtgaacggcgtgaagccaggcgtggtgcagtatctgggagagacgcagttcgcaccgggccagtgggctggcgtggtgctggacgacccggtgggcaagaatgatggcgcggtgggcggcgtgcgctacttcgagtgcccggccctccagggtatcttcacgcggccctccaagctgacccggcagcccacggccgagggctcggggagtgatgcccactccgtggagtcgctgactgcccagaacctgtcattgcattcgggcacggccacgcccccgctgaccagccgcgtcatccccctgcgggagagcgtcctcaacagctccgtgaagactggcaacgagtcgggatccaacctctcagacagcggctctgtgaagcggggcgaaaaggacctgcgcctgggggaccgcgtgctggttggcgggacgaagactggcgtggtgcggtacgtgggggagacagactttgccaagggcgagtggtgtggcgtggagctggacgagccccttgggaagaatgatggggcggtggcgggcaccaggtacttccagtgcccacccaagtttggtctcttcgcgcccatccacaaagtgatccgtatcggcttcccatctaccagcccagccaaggccaagaagaccaagcgtatggccatgggtgtgtcagcactgacccacagtcccagcagttcctccatcagctccgtcagctctgtggcctcctccgtggggggtcggcccagccgcagtggcctgctcacggagacctcttcacgctacgcccgcaagatctcgggcaccacggccttgcaggaggcactgaaggagaagcagcagcacattgagcagctgctggctgaacgagacctggaacgggctgaggtggccaaggccacaagccacatctgcgaggtggagaaggagattgccctgctcaaggcacagcatgagcagtatgttgcagaagccgaggagaagctgcagcgagcccggctgctcgtggagagcgtgcggaaagagaaggtggacctgtccaaccagctggaggaggagaggaggaaggtggaggatctgcagttccgcgtggaggaggagtccatcaccaagggagacctggagacccagacgcagctggagcacgcgcgcattggggagctggaacagagcctgctactggagaaggcgcaggccgagcggctgctccgagaattagcggacaacaggctgaccacagtggccgagaagtcgcgcgtgctgcagctggaggaggagctcaccctgcgccgaggtgaaatcgaggagctccagcagtgcctgttgcactcgggtcccccacctccggaccacccagacgccgccgagatcctgcggctacgggagcggctgctctcggccagcaaggaacaccagagggagagtggggtgctgcgggataaatacgagaaggccctgaaggcctaccaggcggaggtggacaagctccgcgcggccaacgagaagtacgcacaggaggtggcgggcctgaaggacaaggttcagcaggccaccagcgagaacatggggctaatggacaactggaaatccaagctggactcgctggcctcggaccaccagaagtccctggaggacctcaaagccaccctgaactcgggcccaggcgcccagcagaaggagatcggcgagctgaaggcagtgatggagggcatcaagatggagcaccagctggagctgggtaacttgcaggccaagcatgacctggagaccgccatgcacgtgaaggagaaggaggccctgcgagagaagctgcaggaggcccaggaggagctggctgggctgcagcggcactggcgggcccagctggaggtgcaagccagccagcaccggctggagctgcaggaggcccaggaccagcgccgggatgccgagctgcgtgtgcacgagctggaaaaactggacgtggagtaccggggccaggcgcaggctatcgagttcctcaaggagcagatctcgctggccgagaagaagatgttggactacgagcggctgcagcgggcagaagcccagggcaaacaggaggtcgagagtttgcgggagaagctcctggtggctgagaacagactccaggcggtcgaggccctgtgctcctcccagcacacccacatgattgagtcgaatgacatttcagaggagacgatcaggacgaaggaaactgtggagggcctgcaggacaagctgaacaagagggacaaagaggtgacagccttgacctcccagaccgagatgctcagggcccaagtaagtgcgctggagagcaagtgtaagtcaggcgagaagaaggtggacgccctcctgaaggagaagcggcgcctggaggcagagctggagaccgtgtcccggaagacccatgacgcctcgggccagctagtcctcatcagccaggagctgctgcggaaggagcggagcctgaacgaactgcgggtgttgctgctggaggccaatcgtcactccccagggccggagagggacctgagccgtgaggtacacaaggctgagtggcggatcaaggagcagaaactcaaggatgacatccggggcctgcgtgaaaagctgaccgggctggacaaagagaaatccctgtcggatcagaggcgctactccctcatcgaccggtcctcggcgcccgagcttctgcggctgcagcaccagctgatgagcacggaggacgccctgcgggatgcgctggaccaggctcagcaggtggagaagctgatggaggccatgaggagctgccctgacaaggcccagaccatcggcaattccggttctgcaaacggcatccaccagcaggacaaagctcagaaacaagaggacaagcactgatcctgaggggatactgtggagcagcccagtccacaccagagccccacgcggctgcccggcagtacctcctccaggcaggagccgggactgtcactttggagacaaaacagtgtttgtaacaataacgtactcaccgccgcggacaatcccccaccccgatccctcgccagaccaggacgcttcctcaagcccagccttctacagagagtgtgaacggtacagccccggcctgacccggggaccttcagcctggacacccggcagcttctggagtttgtcagtggaggcagaggggatccggccaggcccctctgtccagaaggagctgccctgaggaccatcttagcggccctgtcctctttttccgcccattctccctcgggtctccccagaggggccggcgggggctggggagggggtaagtttatccatgcagacaccaagggggagcatccagtctttaagagccaagtgggggccccttttccgaagccacttccaggccaaggcagtcgccagggcttcttgtccccaccttctgaaccttcttcaaacagtagtacaagctcccctcagccagcctgcctgcccagcgaggcccccaggttcaaggtgttggcgggggcggagggcaggggaacgggatccttctcccgctgcccaccaacaccaacacacacacacctctaagctgctggccgaagatgtcaccaaggccaaagacacagtattatgaaggtttggaaacccctctcctcacctcccaccgtgaccttgggcaaaccctggctcggagcccagggcagaggcagctcagagtggaggctctaggcaggtttgacaaaggtcagtaatacggtttcccctggggttgaccagatgttccaaaatatctgcatccacctggagatgcagctaagtgggtccttatgtacacaccacgttcacacacacacagagggaccacgtgtgcacgcatgaccgtgtgggtggcggcgtttgctgtgaaccacgctcaggccacacagagacacatacttggtttctgggactgagacccaggcctggcaggaccgtgcctacagatactgcaaacgttcctacagcctagaggtgcgtatacacacccaagtacacgcagccaggcattcaggggtgtgtttgccacatggagcatcccttcctggtcttgccaggcacctgcacagagcgtctccagccccatctcctaacgggggctgggggtaagagaaatctaactgcgctcccccaacccctcgccctgccatcttcccctcaagcctgctaagttatcccaggcctgtgcgtggtggaaaaagccagccttggccctgcagcctccacctcgccgctgggggaccaacaggttgcttacagctttgcaccccggcatcagcacaggggtccctgccccaccctccggcagctcagggagtgttttcctgtgaggcctcccccatcagtggaccagagggagaagcccgatgccccatcccggctttcccgtaacgcacaggacacgtgtgcaattcataggaacggcccagatcgccctcatgagtgccacctggtacaggtaggtggcgctcacgttcctgcccaaatgcagcccatcggggagtcacagtcagtccccccggcccccctcccagtccctgttggctttcggtagctctcgcatgcagttctattaacagccgtctagaagcgatgctttagtggcctaacccagggtcaaatacagctctttctagcaaaatcaggcagctctgccccatcggtaggggcaccgattagtctactaacagccagaggtccatctagcagggtgccgggaggagctgagcccccggaggtgggctcctggtgacgggtgtccaagaagcggtttccttgggagcttctgcctccgtgggcctctcagcccgccccgtgtggccgcccgggtgtggctcagccatgtcccctccccaggtccttcattcacccctcccctccccacagtggaattgttgaagtgtggcgagtctgtgctcgggacaataaagcttgtgacaggtccaggaccccggca

SEQ ID NO: 4492 - DNA, 5445 bp, Homo sapiens
cggctcggccgcggggcgcgcaggcggctgctgggcggcctcggtgcgcgcctcccgccttcccagagacgtggcgcgaggcccgggccctgagcacctatcgcggggatccccggcgccaggagggggtgcagccggtgggcagcgccgcgcagggaggggccgcagcatcctcgccccccagcgcgcccgggcccgagaggaggaggccggggctctccgggcctcccgccgcttagcctgatgctggaaggacgaaggtgagtgaagatggcagagaggacgtgaccagcactcacccttgtccacctgcccagtggcaccgccatgcagaagcccagcggcctgaagccccccggccgtggggggaagcactccagccccatgggccggacatctactgggtcagcttcatcctcggcggcggtggccgctagctccaaggaaggctccccactgcacaaacagtcatctggaccctcctcctccccggccgcagctgctgcccccgagaagccgggccccaaggcggcggaagtgggggatgacttcctgggggactttgtggtgggcgagcgggtgtgggtgaacggcgtgaagccaggcgtggtgcagtatctgggagagacgcagttcgcaccgggccagtgggctggcgtggtgctggacgacccggtgggcaagaatgatggcgcggtgggcggcgtgcgctacttcgagtgcccggccctccagggtatcttcacgcggccctccaagctgacccggcagcccacggccgagggctcggggagtgatgcccactccgtggagtcgctgactgcccagaacctgtcattgcattcgggcacggccacgcccccgctgaccagccgcgtcatccccctgcgggagagcgtcctcaacagctccgtgaagactggcaacgagtcgggatccaacctctcagacagcggctctgtgaagcggggcgaaaaggacctgcgcctgggggaccgcgtgctggttggcgggacgaagactggcgtggtgcggtacgtgggggagacagactttgccaagggcgagtggtgtggcgtggagctggacgagccccttgggaagaatgatggggcggtggcgggcaccaggtacttccagtgcccacccaagtttggtctcttcgcgcccatccacaaagtgatccgtatcggcttcccatctaccagcccagccaaggccaagaagaccaagcgtatggccatgggtgtgtcagcactgacccacagtcccagcagttcctccatcagctccgtcagctctgtggcctcctccgtggggggtcggcccagccgcagtggcctgctcacggagacctcttcacgctacgcccgcaagatctcgggcaccacggccttgcaggaggcactgaaggagaagcagcagcacattgagcagctgctggctgaacgagacctggaacgggctgaggtggccaaggccacaagccacatctgcgaggtggagaaggagattgccctgctcaaggcacagcatgagcagtatgttgcagaagccgaggagaagctgcagcgagcccggctgctcgtggagagcgtgcggaaagagaaggtggacctgtccaaccagctggaggaggagaggaggaaggtggaggatctgcagttccgcgtggaggaggagtccatcaccaagggagacctggagctgaccacagtggccgagaagtcgcgcgtgctgcagctggaggaggagctcaccctgcgccgaggtgaaatcgaggagctccagcagtgcctgttgcactcgggtcccccacctccggaccacccagacgccgccgagatcctgcggctacgggagcggctgctctcggccagcaaggaacaccagagggagagtggggtgctgcgggataaatacgagaaggccctgaaggcctaccaggcggaggtggacaagctccgcgcggccaacgagaagtacgcacaggaggtggcgggcctgaaggacaaggttcagcaggccaccagcgagaacatggggctaatggacaactggaaatccaagctggactcgctggcctcggaccaccagaagtccctggaggacctcaaagccaccctgaactcgggcccaggcgcccagcagaaggagatcggcgagctgaaggcagtgatggagggcatcaagatggagcaccagctggagctgggtaacttgcaggccaagcatgacctggagaccgccatgcacgtgaaggagaaggaggccctgcgagagaagctgcaggaggcccaggaggagctggctgggctgcagcggcactggcgggcccagctggaggtgcaagccagccagcaccggctggagctgcaggaggcccaggaccagcgccgggatgccgagctgcgtgtgcacgagctggaaaaactggacgtggagtaccggggccaggcgcaggctatcgagttcctcaaggagcagatctcgctggccgagaagaagatgttggactacgagcggctgcagcgggcagaagcccagggcaaacaggaggtcgagagtttgcgggagaagctcctggtggctgagaacagactccaggcggtcgaggccctgtgctcctcccagcacacccacatgattgagtcgaatgacatttcagaggagacgatcaggacgaaggaaactgtggagggcctgcaggacaagctgaacaagagggacaaagaggtgacagccttgacctcccagaccgagatgctcagggcccaagtaagtgcgctggagagcaagtgtaagtcaggcgagaagaaggtggacgccctcctgaaggagaagcggcgcctggaggcagagctggagaccgtgtcccggaagacccatgacgcctcgggccagctagtcctcatcagccaggagctgctgcggaaggagcggagcctgaacgaactgcgggtgttgctgctggaggccaatcgtcactccccagggccggagagggacctgagccgtgaggtacacaaggctgagtggcggatcaaggagcagaaactcaaggatgacatccggggcctgcgtgaaaagctgaccgggctggacaaagagaaatccctgtcggatcagaggcgctactccctcatcgaccggtcctcggcgcccgagcttctgcggctgcagcaccagctgatgagcacggaggacgccctgcgggatgcgctggaccaggctcagcaggtggagaagctgatggaggccatgaggagctgccctgacaaggcccagaccatcggcaattccggttctgcaaacggcatccaccagcaggacaaagctcagaaacaagaggacaagcactgatcctgaggggatactgtggagcagcccagtccacaccagagccccacgcggctgcccggcagtacctcctccaggcaggagccgggactgtcactttggagacaaaacagtgtttgtaacaataacgtactcaccgccgcggacaatcccccaccccgatccctcgccagaccaggacgcttcctcaagcccagccttctacagagagtgtgaacggtacagccccggcctgacccggggaccttcagcctggacacccggcagcttctggagtttgtcagtggaggcagaggggatccggccaggcccctctgtccagaaggagctgccctgaggaccatcttagcggccctgtcctctttttccgcccattctccctcgggtctccccagaggggccggcgggggctggggagggggtaagtttatccatgcagacaccaagggggagcatccagtctttaagagccaagtgggggccccttttccgaagccacttccaggccaaggcagtcgccagggcttcttgtccccaccttctgaaccttcttcaaacagtagtacaagctcccctcagccagcctgcctgcccagcgaggcccccaggttcaaggtgttggcgggggcggagggcaggggaacgggatccttctcccgctgcccaccaacaccaacacacacacacctctaagctgctggccgaagatgtcaccaaggccaaagacacagtattatgaaggtttggaaacccctctcctcacctcccaccgtgaccttgggcaaaccctggctcggagcccagggcagaggcagctcagagtggaggctctaggcaggtttgacaaaggtcagtaatacggtttcccctggggttgaccagatgttccaaaatatctgcatccacctggagatgcagctaagtgggtccttatgtacacaccacgttcacacacacacagagggaccacgtgtgcacgcatgaccgtgtgggtggcggcgtttgctgtgaaccacgctcaggccacacagagacacatacttggtttctgggactgagacccaggcctggcaggaccgtgcctacagatactgcaaacgttcctacagcctagaggtgcgtatacacacccaagtacacgcagccaggcattcaggggtgtgtttgccacatggagcatcccttcctggtcttgccaggcacctgcacagagcgtctccagccccatctcctaacgggggctgggggtaagagaaatctaactgcgctcccccaacccctcgccctgccatcttcccctcaagcctgctaagttatcccaggcctgtgcgtggtggaaaaagccagccttggccctgcagcctccacctcgccgctgggggaccaacaggttgcttacagctttgcaccccggcatcagcacaggggtccctgccccaccctccggcagctcagggagtgttttcctgtgaggcctcccccatcagtggaccagagggagaagcccgatgccccatcccggctttcccgtaacgcacaggacacgtgtgcaattcataggaacggcccagatcgccctcatgagtgccacctggtacaggtaggtggcgctcacgttcctgcccaaatgcagcccatcggggagtcacagtcagtccccccggcccccctcccagtccctgttggctttcggtagctctcgcatgcagttctattaacagccgtctagaagcgatgctttagtggcctaacccagggtcaaatacagctctttctagcaaaatcaggcagctctgccccatcggtaggggcaccgattagtctactaacagccagaggtccatctagcagggtgccgggaggagctgagcccccggaggtgggctcctggtgacgggtgtccaagaagcggtttccttgggagcttctgcctccgtgggcctctcagcccgccccgtgtggccgcccgggtgtggctcagccatgtcccctccccaggtccttcattcacccctcccctccccacagtggaattgttgaagtgtggcgagtctgtgctcgggacaataaagcttgtgacaggtc

SEQ ID NO: 4493 - DNA, 3141 bp, Homo sapiens
atgcagaagcccagcggcctgaagccccccggccgtggggggaagcactccagccccatgggccggacatctactgggtcagcttcatcctcggcggcggtggccgctagctccaaggaaggctccccactgcacaaacagtcatctggaccctcctcctccccggccgcagctgctgcccccgagaagccgggccccaaggcggcggaagtgggggatgacttcctgggggactttgtggtgggcgagcgggtgtgggtgaacggcgtgaagccaggcgtggtgcagtatctgggagagacgcagttcgcaccgggccagtgggctggcgtggtgctggacgacccggtgggcaagaatgatggcgcggtgggcggcgtgcgctacttcgagtgcccggccctccagggtatcttcacgcggccctccaagctgacccggcagcccacggccgagggctcggggagtgatgcccactccgtggagtcgctgactgcccagaacctgtcattgcattcgggcacggccacgcccccgctgaccagccgcgtcatccccctgcgggagagcgtcctcaacagctccgtgaagactggcaacgagtcgggatccaacctctcagacagcggctctgtgaagcggggcgaaaaggacctgcgcctgggggaccgcgtgctggttggcgggacgaagactggcgtggtgcggtacgtgggggagacagactttgccaagggcgagtggtgtggcgtggagctggacgagccccttgggaagaatgatggggcggtggcgggcaccaggtacttccagtgcccacccaagtttggtctcttcgcgcccatccacaaagtgatccgtatcggcttcccatctaccagcccagccaaggccaagaagaccaagcgtatggccatgggtgtgtcagcactgacccacagtcccagcagttcctccatcagctccgtcagctctgtggcctcctccgtggggggtcggcccagccgcagtggcctgctcacggagacctcttcacgctacgcccgcaagatctcgggcaccacggccttgcaggaggcactgaaggagaagcagcagcacattgagcagctgctggctgaacgagacctggaacgggctgaggtggccaaggccacaagccacatctgcgaggtggagaaggagattgccctgctcaaggcacagcatgagcagtatgttgcagaagccgaggagaagctgcagcgagcccggctgctcgtggagagcgtgcggaaagagaaggtggacctgtccaaccagctggaggaggagaggaggaaggtggaggatctgcagttccgcgtggaggaggagtccatcaccaagggagacctggagacccagacgcagctggagcacgcgcgcattggggagctggaacagagcctgctactggagaaggcgcaggccgagcggctgctccgagaattagcggacaacaggctgaccacagtggccgagaagtcgcgcgtgctgcagctggaggaggagctcaccctgcgccgaggtgaaatcgaggagctccagcagtgcctgttgcactcgggtcccccacctccggaccacccagacgccgccgagatcctgcggctacgggagcggctgctctcggccagcaaggaacaccagagggagagtggggtgctgcgggataaatacgagaaggccctgaaggcctaccaggcggaggtggacaagctccgcgcggccaacgagaagtacgcacaggaggtggcgggcctgaaggacaaggttcagcaggccaccagcgagaacatggggctaatggacaactggaaatccaagctggactcgctggcctcggaccaccagaagtccctggaggacctcaaagccaccctgaactcgggcccaggcgcccagcagaaggagatcggcgagctgaaggcagtgatggagggcatcaagatggagcaccagctggagctgggtaacttgcaggccaagcatgacctggagaccgccatgcacgtgaaggagaaggaggccctgcgagagaagctgcaggaggcccaggaggagctggctgggctgcagcggcactggcgggcccagctggaggtgcaagccagccagcaccggctggagctgcaggaggcccaggaccagcgccgggatgccgagctgcgtgtgcacgagctggaaaaactggacgtggagtaccggggccaggcgcaggctatcgagttcctcaaggagcagatctcgctggccgagaagaagatgttggactacgagcggctgcagcgggcagaagcccagggcaaacaggaggtcgagagtttgcgggagaagctcctggtggctgagaacagactccaggcggtcgaggccctgtgctcctcccagcacacccacatgattgagtcgaatgacatttcagaggagacgatcaggacgaaggaaactgtggagggcctgcaggacaagctgaacaagagggacaaagaggtgacagccttgacctcccagaccgagatgctcagggcccaagtaagtgcgctggagagcaagtgtaagtcaggcgagaagaaggtggacgccctcctgaaggagaagcggcgcctggaggcagagctggagaccgtgtcccggaagacccatgacgcctcgggccagctagtcctcatcagccaggagctgctgcggaaggagcggagcctgaacgaactgcgggtgttgctgctggaggccaatcgtcactccccagggccggagagggacctgagccgtgaggtacacaaggctgagtggcggatcaaggagcagaaactcaaggatgacatccggggcctgcgtgaaaagctgaccgggctggacaaagagaaatccctgtcggatcagaggcgctactccctcatcgaccggtcctcggcgcccgagcttctgcggctgcagcaccagctgatgagcacggaggacgccctgcgggatgcgctggaccaggctcagcaggtggagaagctgatggaggccatgaggagctgccctgacaaggcccagaccatcggcaattccggttctgcaaacggcatccaccagcaggacaaagctcagaaacaagaggacaagcactga

SEQ ID NO: 4494 - DNA, 533 bp, Homo sapiens
gtcagctctgtggcctcctccgtggggggtcggcccagccgcagtggcctgctcacggagacctcttcacgctacgcccgcaagatctcgggcaccacggccttgcaggaggcactgaaggagaagcagcagcacattgagcagctgctggctgaacgagacctggaacgggctgaggtggccaaggccacaagccacatctgcgaggtggagaaggagattgccctgctcaaggcacagcatgagcagtatgttgcagaagccgaggagaagctgcagcgagcccggctgctcgtggagagcgtgcggaaagagaaggtggacctgtccaaccagctggaggaggagaggaggaaggtggaggatctgcagttccgcgtggaggaggagtccatcaccaagggagacctggaggcagaggatcacttgagcccagaaccaagcatgctgaccacagtggccgagaagtcgcgcgtgctgcagctggaggaggagctcaccctgcgccgaggtgaaatcgaggagctccagca

SEQ ID NO: 4495 - DNA, 3467 bp, Homo sapiens
ctcggctcggccgcggggcgcgcaggcggctgctgggcggcctcggtgcgcgcctcccgccttcccagagacgtggcgcgaggcccgggccctgagcacctatcgcggggatccccggcgccaggagggggtgcagccggtgggcagcgccgcgcagggaggggccgcagcatcctcgccccccagcgcgcccgggcccgagaggaggaggccggggctctccgggcctcccgccgcttagcctgatgctggaaggacgaaggtgagtgaagatggcagagaggacgtgaccagcactcacccttgtccacctgcccagtggcaccgccatgcagaagcccagcggcctgaagccccccggccgtggggggaagcactccagccccatgggccggacatctactgggtcagcttcatcctcggcggcggtggccgctagctccaaggaaggctccccactgcacaaacagtcatctggaccctcctcctccccggccgcagctgctgcccccgagaagccgggccccaaggcggcggaagtgggggatgacttcctgggggactttgtggtgggcgagcgggtgtgggtgaacggcgtgaagccaggcgtggtgcagtatctgggagagacgcagttcgcaccgggccagtgggctggcgtggtgctggacgacccggtgggcaagaatgatggcgcggtgggcggcgtgcgctacttcgagtgcccggccctccagggtatcttcacgcggccctccaagctgacccggcagcccacggccgagggctcggggagtgatgcccactccgtggagtcgctgactgcccagaacctgtcattgcattcgggcacggccacgcccccgctgaccagccgcgtcatccccctgcgggagagcgtcctcaacagctccgtgaagactggcaacgagtcgggatccaacctctcagacagcggctctgtgaagcggggcgaaaaggacctgcgcctgggggaccgcgtgctggttggcgggacgaagactggcgtggtgcggtacgtgggggagacagactttgccaagggcgagtggtgtggcgtggagctggacgagccccttgggaagaatgatggggcggtggcgggcaccaggtacttccagtgcccacccaagtttggtctcttcgcgcccatccacaaagtgatccgtatcggcttcccatctaccagcccagccaaggccaagaagaccaagcgtatggccatgggtgtgtcagcactgacccacagtcccagcagttcctccatcagctccgtcagctctgtggcctcctccgtggggggtcggcccagccgcagtggcctgctcacggagacctcttcacgctacgcccgcaagatctcgggcaccacggccttgcaggaggcactgaaggagaagcagcagcacattgagcagctgctggctgaacgagacctggaacgggctgaggtggccaaggccacaagccacatctgcgaggtggagaaggagattgccctgctcaaggcacagcatgagcagtatgttgcagaagccgaggagaagctgcagcgagcccggctgctcgtggagagcgtgcggaaagagaaggtggacctgtccaaccagctggaggaggagaggaggaaggtggaggatctgcagttccgcgtggaggaggagtccatcaccaagggagacctggagacccagacgcagctggagcacgcgcgcattggggagctggaacagagcctgctactggagaaggcgcaggccgagcggctgctccgagaattagcggacaacaggctgaccacagtggccgagaagtcgcgcgtgctgcagctggaggaggagctcaccctgcgccgaggtgaaatcgaggagctccagcagtgcctgttgcactcgggtcccccacctccggaccacccagacgccgccgagatcctgcggctacgggagcggctgctctcggccagcaaggaacaccagagggagagtggggtgctgcgggataaatacgagaaggccctgaaggcctaccaggcggaggtggacaagctccgcgcggccaacgagaagtacgcacaggaggtggcgggcctgaaggacaaggttcagcaggccaccagcgagaacatggggctaatggacaactggaaatccaagctggactcgctggcctcggaccaccagaagtccctggaggacctcaaagccaccctgaactcgggcccaggcgcccagcagaaggagatcggcgagctgaaggcagtgatggagggcatcaagatggagcaccagctggagctgggtaacttgcaggccaagcatgacctggagaccgccatgcacgtgaaggagaaggaggccctgcgagagaagctgcaggaggcccaggaggagctggctgggctgcagcggcactggcgggcccagctggaggtgcaagccagccagcaccggctggagctgcaggaggcccaggaccagcgccgggatgccgagctgcgtgtgcacgagctggaaaaactggacgtggagtaccggggccaggcgcaggctatcgagttcctcaaggagcagatctcgctggccgagaagaagatgttggactacgagcggctgcagcgggcagaagcccagggcaaacaggaggtcgagagtttgcgggagaagctcctggtggctgagaacagactccaggcggtcgaggccctgtgctcctcccagcacacccacatgattgagtcgaatgacatttcagaggagacgatcaggacgaaggaaactgtggagggcctgcaggacaagctgaacaagagggacaaagaggtgacagccttgacctcccagaccgagatgctcagggcccaagtaagtgcgctggagagcaagtgtaagtcaggcgagaagaaggtggacgccctcctgaaggagaagcggcgcctggaggcagagctggagaccgtgtcccggaagacccatgacgcctcgggccagctagtcctcatcagccaggagctgctgcggaaggagcggagcctgaacgaactgcgggtgttgctgctggaggccaatcgtcactccccagggccggagagggacctgagccgtgaggtacacaaggctgagtggcggatcaaggagcagaaactcaaggatgacatccggggcctgcgtgaaaagctgaccgggctggacaaagagaaatccctgtcggatcagaggcgctactccctcatcgaccggtcctcggcgcccgagcttctgcggctgcagcaccagctgatgagcacggaggacgccctgcgggatgcgctggaccaggctcagcaggtggagaagctgatggaggccatgaggagctgccctgacaaggcccagaccatcggcaattccggttctgcaaacggcatccaccagcaggacaaagctcagaaacaagagaatacacac

SEQ ID NO: 4496 - DNA, 5473 bp, Homo sapiens
ggaggtgcgagcccctgccgggtcccccctgcgccggaccatgtattcggcccacaggcccctgatgcccgcgtccagcgcggcctcccgtggcctcggcatgttcgtgtggacgaatgtggaacctcgctctgtggctgtgttcccttggcactccttagtccccttcctggcacccagccagcctgacccctccgtgcagccgagcgaggcccagcaacctgccagccacccagtggcctccaaccagagcaaagaacctgctgagtcggcagctgttgctcatgaacggccaccaggtgggacagggagtgctgaccctgagcggccccctggagccacatgccctgagagcccaggacccggacccccacaccctttgggggtggtggaatctggtaagggtccgcctcccaccacggaggaggaggcctccggccccccaggagagccccggctggacagtgagacagagagtgaccatgatgatgccttcctctccatcatgtctcctgagatccagttgcctctaccgcccggaaaacgtcggacccagtccctcagtgccctacccaaggaacgggactcatcttctgagaaggatggacgcagccccaacaagcgggagaaggaccacatccggcggcccatgaatgccttcatgatcttcagcaagcggcaccgggccctggtccaccagcgtcatcccaaccaggacaaccggaccgtcagcaagatcctgggcgagtggtggtatgccctggggcccaaggagaagcagaagtaccacgacctggccttccaggtgaaggaggcccacttcaaggcccacccagattggaagtggtgcaacaaggaccgaaagaagtccagctcagaggccaagcccacgagcctggggctggcaggagggcacaaggagacgcgggagcggagcatgtcggagacgggcactgctgctgcccctggggtgtcctctgagctcctgtccgttgcagcccagacactcctgagctcagacaccaaggctccggggagcagctcctgtggggcagaacggctacacacagttgggggacctggctcagcccggccccgagctttctcccacagcggggtacacagcctggacggcggagaagtagacagtcaggcgctacaggaactgacgcagatggtgtctggccctgcatcgtactctggcccaaagccttctacccagtatggagctccaggaccctttgcagcccctggtgagggaggtgccttggcggccactgggcggcccccgctgctgcccacccgagcttctcgttctcagcgtgcggccagtgaggacatgacgagtgatgaggagcgcatggtcatctgtgaggaggaaggggatgatgatgtcattgctgacgatggcttcggcaccactgacattgatctcaagtgcaaggagcgggtgaccgacagcgagagtggggacagctctggggaggacccagagggcaacaagggctttggtcggaaggtgttttcacctgtgatccgttcctcctttacccactgccgccccccactggaccctgagcccccagggcccccggatcctcctgtagcctttggcaaaggctatggttccgccccatcctcctctgcgtcctcgcctgcttcctcctcagcctcggcagccacctccttctcactgggctcaggaaccttcaaggcccaggagtctggtcagggcagcacagcgggccccctacggcccccaccccctggggctgggggtccagcgacaccttccaaggcaacccggttcctcccaatggatcctgccaccttccggcgcaagagacccgaaagtgtgggtggcctggagccaccaggcccctcagtcatcgcggcccctcccagcggaggaggaaacatcctgcagacactggtgctgcccccaaacaaggaggagcaagagggcggcggagccagagtgccctccgcccccgccccatcactggcctatggggccccagcagctcccctgtcccgtcctgccgccaccatggtcaccaatgtggtgcggcctgtcagcagcactcctgtgcccatcgcctctaagcccttccccacctctggccgggctgaggcgtctccaaatgacacagcaggtgccaggactgaaatgggcactgggtctcgggtgcctgggggctccccgctgggtgtcagcttagtgtattcggacaagaagtcggcagcagccacctcaccagccccacacttggtggctggacccctgctgggcactgtggggaaggcgcctgccactgtcactaacctactggtgggcaccccggggtatggggcccctgcgccccctgctgtccagttcattgcccagggggcccctggtggtgggaccactgcgggctcaggagcaggtgctgggagtggccccaatgggccagtacccctgggcatcctgcaaccaggtgccctgggcaaggctgggggaatcacccaggtacagtacatcctgcccacgctgccccagcagcttcaggtggcacctgccccagcaccagcccctgggaccaaggcagcggctcccagcggccctgcacccaccaccagcatccgtttcaccctcccaccgggcacttccaccaacggcaaagtcctggctgccactgcacccactcctggcatccccatcctgcagtctgtaccctccgccccaccccccaaagcccagtcagtttctcccgtgcaggccccgcccccgggtggctcagcccagctgctgcctgggaaggtcctagtgcctctggccgcccctagcatgtcagtgcggggtggaggggccggccagccactgccactggtgagcccgcccttctcagtacctgtgcagaatggtgcccagccccccagcaagatcatccagctgaccccggtgcctgtgagcacacccagcggcctggtgccgcccctgagcccagccacactccctggacccacctctcagcctcagaaggtcctgttgccctcctccaccagaatcacctatgtgcagtcagcgggcgggcacgcgctgcccctgggtaccagccctgcgtccagccaggctggaacagtcacctcgtacgggcccacgagctctgtagctctaggcttcacctcgctggggcccagcggccccgccttcgtgcagcccctgctctcagcaggccaagccccactgctggctcccggtcaggtgggcgtgtcacctgtgcccagtccccagctgccgcctgcctgtgcagcccccggaggtcctgtcataacagcattttactctggcagccctgcacccacctcctcagcacccctggcccagccatcccaggcccccccaagcctggtctacactgtggccaccagcacaaccccacctgcagccaccattctgcccaagggcccgccagcccctgccactgccaccccagccccgactagccctttccccagcgccacagcaggttccatgacctacagcttagtggcccccaaggcccagcggcccagcccgaaggccccccagaaagtgaaggcagccatcgccagcattcccgtggggtcctttgaggcaggtgcctctgggcggcctggccctgcaccccggcagcctctggagcctggcccagtccgagagccaactgccccagagtctgagcttgaggggcagcccacaccaccagcccctccacccctgccagagacctggactcccacggcccggagcagccccccactgcccccacctgctgaggagcggaccagcgccaagggccctgagaccatggccagcaaattccccagctcatcttcagactggcgcgtccctgggcagggcctggagaatcgtggggagcctcccactcctcccagcccggccccagctccagctgtagcccctggtggcagcagcgagagcagcagtgggcgggcagccggggacaccccggagcgcaaggaggcggctggtactggcaagaaggtgaaggtgcggcccccgcccctgaagaagacctttgactctgtggacaacagggtcctgtcagaagtggacttcgaagagcgctttgctgagttgcctgagtttcggcctgaggaggtgctgccctcccccaccctgcagtctctggccacctcaccccgggccatcctgggctcttaccgcaagaagaggaagaactccacggacctggattcagcacccgaggaccccacctcgcccaagcgcaagatgagaagacgctccagctgcagctcggagcccaacacccccaagagtgccaagtgcgagggggacatcttcacctttgaccgtacaggtacagaagccgaggacgtgcttggggagctagagtatgacaaggtgccatactcctccctgcggcgcaccctggaccagcgccgggccctggtcatgcagctctttcaggaccatggcttcttcccgtcagcccaggccacagccgccttccaggcccgctatgcagacatctttccctccaaggtttgtctgcagttgaagatccgtgaggtgcgccagaagatcatgcaggctgccactcccacggagcagccccctggagctgaggctcctctccctgtaccgccccccactggcaccgctgctgcccctgcccccactcccagccccgcagggggccctgaccccacctcacccagctcggactctggcacggcccaggctgccccgccactgcctccacccccagagtcggggcctggacagcctggctgggagggggctccccagccctcccccccacccccaggtccctccacagctgccacaggcaggtgagggacccctgagaagatgccaggacttatagtaccccctcaggacatggacagtatgtgggggcaggaaggttatctcctcccgggtaaagccatttcgtcctctccagtttggggcggaatgaggcctgctcctcttgtaaatacccccttccctcgaagctccctcccggtgctggggggcagctgaggggctgcaggggcagtctccctcctccaagcccctgtacataacctggagcgtgtgaccttcagagcttttcactttatgcaaaatggctcctgtgagggctgcaagctggagggtggtgcaggccttgggccacagggaggcgcctgtggaatagggggagttcatgcaccccttttttccccagaggggctggactcaggttagtttgggggtgggggctcctgcactttgccacaggcacggggagggttttctcctcaccccctctgccctcccaacttgggttgtactttctaagaaggtgattccccctgcccttgcccccttccccagaacaaaacatgttgatcatgtgcaatatttcttactgtgccgagaagccgcaatgagcgagattaaagctgtttaacacac

SEQ ID NO: 4497 - DNA, 1195 bp, Homo sapiens
aagtgagaagccgggtggggcaggctggaaggaagacgaacctacgaagcagagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccatttgcccttgaactgctgatatctgatgactgctttgtgctggacaacgggctctgtggcaagatctatatctggaaggggcgaaaagcgaatgagaaggagcggcaggcagccctgcaggtggccgagggcttcatctcgcgcatgcagtacgccccgaacactcaggtggagattctgcctcagggccatgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacaagtgctttccca

SEQ ID NO: 4498 - DNA, 3020 bp, Homo sapiens
gggaatcctgggatagtggcggacctgaagttggcctctgtgaaggctgagtcctggggaaccgggaccgagaagatttcgaaggtggaggagcgtgtctcaagattggggctacctgttctttcgtggggcagggaaggggcggacagcagcgcctattctggaggaactggactgagatgtgaccccgaagtgttaccgcttccaaacgaaatgagggtcacctttcacaccgccccccccccggggttggaaaagccaccgatcgttccagctgccgagcagctcttaaagctttggattcggctgtcgtggagataacgggcaccagaaaaacttgtaggagtagcaacagctatttggtcggatggaggccagaagccaagaataatcgaaacacgctgccagcgcccattagatggatgggaaatgagtgtaactcattgggaaagatattagacttcaaatcacctaaggcaaaccctacttcctggggcgcgggcgcgggcgctggcgttaggagacgtcactcccgcgcataactgacatggggccctcttggtcggcgtttccgggcgggtccttccgacggccgccgcggtgattccatcactcggctttcttcccggcctgcctcgcgcccgtagccgggctgggccagaacagcccaagatggccgacttcgatgatcgtgtgtcggatgaggagaaggtacgcatagctgctaaattcatcactcatgcacccccaggggaatttaatgaagtattcaatgacgttcggctactacttaataatgacaatctcctcagggaaggggcagcacatgcatttgcccagtataacatggatcagttcacgcctgtgaagatagaaggatatgaagatcaggtcttaattacagagcacggtgacctgggtaatagcagatttttagatccaagaaacaaaatttcctttaaatttgaccacttacggaaagaagcaagtgacccccagccagaagaagcagatggaggtctgaagtcttggagagaatcctgtgacagtgctttaagagcctatgtgaaagaccattattccaacggcttctgtactgtttatgctaaaactatcgatgggcaacagactattattgcatgtattgaaagccaccagtttcagcctaaaaacttctggaatggtcgttggagatcagagtggaagttcaccatcacaccacctacagcccaggtggttggcgtgcttaagattcaggttcactattatgaagatggcaatgttcagttggttagtcataaagatgtacaggattcactaactgtttcgaatgaagcccaaactgccaaggagtttattaaaatcatagagaatgcagaaaatgagtatcagacagcaattagtgaaaactatcaaacaatgtcagataccacattcaaggccttgcgccggcagcttccagttacccgcaccaaaatcgactggaacaagatactcagctacaagattggcaaagaaatgcagaatgcttaaaggctgaatgtaggattcttcagtatgtggaaagacaaggattcaacgtgtggtcatatgataaataagtgatttataaacaagagtgatattttgctagggctttcaaagttaaccggttttctagcctcatggaatactgttgaacctatagcgttgtcttgattcttttgtgttctctgccttgtaattttctgttactgctatatctacgtgtaaatctttttttctttttttttttttttttttggttaattctgccacatttaatgttggtgagagagtgatctatcctaatgacattttactgtttaaaaaagtttcctagccatgaagccctgctactgatttagacaaggtattatggtcattactttgtacccctatccttccaagcacttctggtacttcagtcgtttttactgatccaccaacacctaaagaggctatgctacagtctctagctaaatggaagacacattcatccttctccctctgactgctttgatcatcatttattgcatctcataactaattttctaaagtttggattgggacttttcaggtcctttttggagggcaaaggaagtgccagcttctctggggaacttgtttttaaatccaaagacttgaaccacattccctgcacatgaacatgtttgcttttatcccttctctcattgtctccttcccatcttagtaccattgtagttataaacatctgcattttttagaagcattttacccatttatttttttaaacattcaagaactgctgacgtactgtggatgtagagtataaaacttgaaaaatgcagatgttgaaggaataataggtatcttgtgctttaatactttatggcaggattgtactataagcaaatgaattaaacagctatgtaaatcataaagaaaaactaaaaatgaaccaaagtgaaaggataacttccaggcagtatctttctattgtaacctgttatttaaggaaatactagtgatttcttctaaataggatgtaaaacttctttcaaattactcttcctcagtcctgcctgccaagaactcaagtgtaactgtgataaaataacctttcccaggtatattggcaggtatgtgtgtaatctcagaatacacaggtgacatagatatgatatgacaactggtaatggtggattcatttacattgtttacacttctatgaccaggccttaagggaaggtcagttttttaaaaaaccaagtagtgtcttcctacctatctccagatacatgtcaaaaaaagaaaggtgtttgtgcttccgttttgtttctgctcagtaatatagtcaagcaagtttgttccaggtgacccattgagctgtgtatgcatttttgtttatttcaataaaatatatttgtattatttgtccttcatactatccatccataccacactatcttctgtatcaggtagtctaatagaaatatacctgttttgttctaaaattg

SEQ ID NO: 4499 - DNA, 2394 bp, Homo sapiens
cccggggtgcgcgtgcgcggcggcctgagcggcgggcccctcccttagcgggggcgcgcggcgctgaggaccgcacggaaacggggaagtcaggtggccgctgccgccgccgccgccgcggtttgtcgccagaaggaagatggcggatctggaggagcagttgtctgatgaagagaaggtgcgtatagcagcaaaattcatcattcatgcccctcctggagaatttaatgaggttttcaatgatgttcggttactgcttaataatgacaatcttctcagggaaggagcagcccatgcatttgcacagtataacttggaccagtttactccagtaaaaattgaaggttatgaagatcaggtattgataacagaacatggcgacttgggaaatggaaagtttttggatccaaagaacagaatctgttttaaatttgatcacttaaggaaggaggcaactgatccaagaccctgtgaagtagaaaatgcagttgaatcatggagaacttcagtagaaactgctctgagagcttacgtaaaagaacattacccgaatggagtctgcactgtgtatggcaaaaaaatagatggacagcaaaccattattgcatgcatagaaagccatcagttccaagcaaaaaatttttggaatggtcgttggaggtcagaatggaagtttacaatcactccttcaaccactcaagtggttggcatcttgaaaattcaggttcattattatgaagatggtaatgttcagctagtgagtcataaagatatacaagattccctaacagtgtctaatgaagtgcaaacagcaaaagaatttataaagattgtagaagctgcagaaaatgaataccagactgccatcagtgagaattatcagacaatgtcggacactactttcaaagccttacgtcgacagttgccagttacacgcactaagattgattggaacaagatccttagctacaagattggcaaagagatgcagaatgcataagatgaacattgcatgaccggatcattttagtgtctttgcgttaaaaaatcattgcaaaagtattctgaactgtcaagctgcccagtcagatgggctgttgccatttaaaatcactgtaattaattagtttgattagagcacaaagcttagctaatcaaccattatttttcattttgtttgttctaagaggattgaaaatcagtttagtttaaatgtctttctgttaggcctttctttcttacaatgaagagatgattcttctagtttatggttaaaagtttttgaagtgtctcaaaaatattttactaactgtaaccctaaaattgatgtcttttggtttatgaaatcagtaatttttgatatttccccagttctttttaatggggtcaataatggacattctagtttaaggtggttgatggatttagccatatatgctgctaaagaaattgtctaccttttcttcctcacctgttccatttatgtaaagttgagattagagggaaagcattttctatatcaattgtgtttaaacctttcaagaaggttatttagctagcttagtgttgaactaaattttttttaaacaaggcaaggtctaatgctgttttgagattctgaaattaatgaaaatacttatttcagaaatgcatttaatgctttttttcttgtgacagttacgcaaatcagcttgaattccatatgtccctgagttatttttatcataaagccacaaatgtattataacaaggcaaattgtaatatatataatcctgaactcatgaccatgtctcggtttattttttttttcttggattgaaaagtactgaaattcaatgtgacattaaaatgcaaattttcctatttatttgagtagaaaatcacttaccagtgagcatatatattttaaaatactttctttggatattgtaattcttaactggttgtaaattagaaaagctgggattacatatggtgtgcggttacagtctaaattttttcatcctcctatgcatcataagcatgtttgtaatattttcaaaaatagttctactgatgctacaggaatttcaagcctgtggtgaatgttagtatttaccatagggagtgaagtggagttatggtttcattcaatagagtattgctgattatacttgagtggaatcctttcctcacgtactcccacagacgtctgggcctggaaattttttttttattttattttattgtttttttttttagaaaaacaccacttttattatgtacaataaaatatttcattagcttgaattgtatagatttttaaaaattcaatgaaagcatgttgtttaatttctttttaaaatcactgttgggctttgaaagcattgagaatataatatgaaattatgaca

SEQ ID NO: 4500 - DNA, 1423 bp, Homo sapiens
aagtcaggtggccgctgccgccgccgccgccgcggtttgtcgccagaaggaagatggcggatctggaggagcagttgtctgatgaagagaaggtgcgtatagcagcaaaattcatcattcatgcccctcctggagaatttaatgaggttttcaatgatgttcggttactgcttaataatgacaatcttctcagggaaggagcagcccatgcatttgcacagtataacttggaccagtttactccagtaaaaattgaaggttatgaagatcaggtattgataacagaacatggcgacttgggaaatggaaagtttttggatccaaagaacagaatctgttttaaatttgatcacttaaggaaggaggcaactgatccaagaccctgtgaagtagaaaatgcagttgaatcatggagaacttcagtagaaactgctctgagagcttacgtaaaagaacattacccgaatggagtctgcactgaatggtcgttggaggtcagaatggaagtttacaatcactccttcaaccactcaagtggttggcatcttgaaaattcaggttcattattatgaagatggtaatgttcagctagtgagtcataaagatatacaagattccctaacagtgtctaatgaagtgcaaacagcaaaagaatttataaagattgtagaagctgcagaaaatgaataccagactgccatcagtgagaattatcagacaatgtcggacactactttcaaagccttacgtcgacagttgccagttacacgcactaagattgattggaacaagatccttagctacaagattggcaaagagatgcagaatgcataagatgaacattgcatgaccggatcattttagtgtctttgcgttaaaaaatcattgcaaaagtattctgaactgtcaagctgcccagtcagatgggctgttgccatttaaaatcactgtaattaattagtttgattagagcacaaagcttagctaatcaaccattatttttcattttgtttgttctaagaggattgaaaatcagtttagtttaaatgtctttctgttaggcctttctttcttacaatgaagagatgattcttctagtttatggttaaaagtttttgaagtgtctcaaaaatattttactaactgtaaccctaaaattgatgtcttttggtttatgaaatcagtaatttttgatatttccccagttctttttaatggggtcaataatggacattctagtttaaggtggttgatggatttagccatatatgctgctaaagaaattgtctaccttttcttcctcacctgttccatttatgtaaagttgagattagagggaaagcattttctatatcaattgtgtttaaacctttcaagaaggttatttagctagcttagtgttgaactaaattttttttaaaca

SEQ ID NO: 4501 - DNA, 1077 bp, Homo sapiens
ggaggctcagaccttgccagactgcctgctttcatggatagacataaaaaccttcagcttgaatgttaacaccttgatgggaaaggtggctcatggaatgttttcttatcctttgaacactcctcatttcagaagctttgcttctgttgcaaccaaacatgacacttagcgtgctgagcaggaaggacaaggaaagagtaattcgcagactgttattacaggcccctccaggggaatttgtaaatgcctttgatgatctctgtctgcttatccgtgatgaaaaacttatgcaccaccaaggtgagtgtgcaggccaccaacactgccaaaaatattctgtaccactctgcatcgatggaaatccagtactcttgtctcaccacaatgtaatgggcgactaccgattttttgaccatcaaagcaaactttctttcaaatatgacctgcttcaaaatcagctgaaagacatccaaagtcatggtatcattcagaatgaggcagaatacctgagagttgttcttctgtgcgccttaaaactgtatgtgaatgaccactatccaaaaggaaattgcaacatgctgagaaaaactgtcaaaagtaaggagtacttgatagcttgcattgaagatcacaactatgaaacaggagagtgctggaacggactttggaaatctaaatggattttccaagttaacccatttctaacccaagtaacgggaagaatatttgtgcaagctcacttcttcaggtgtgtcaaccttcatattgaaatatccaaggacctgaaagaaagcttggaaatagttaaccaagctcaactggctctaagttttgcaaggcttgtggaagagcaagagaacaaatttcaagctgcagtcttggaagaattacaggagttatccaatgaagccctgagaaaaattctacgaagggatcttccagtgacccgcactcttattgactggcacaggatactctctgacttgaatctggtgatgtatcctaaattaggatatgtcatttattcaagaagtgtgttgtgcaactggataatataaagaattgctcctggtaact

SEQ ID NO: 4502 - DNA, 883 bp, Homo sapiens
ggggagagccactgacgccgggaccgggaccgccgccgccgccgccaccatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgagatctattgatgctatccctgacaaccaaaagtttaagcagttgcagagggagctctctcaagtgctgacccagcgccagatctacatccagcctgataattaa

SEQ ID NO: 4503 - DNA, 2068 bp, Homo sapiens
gtggaagcgccgggccctgctgcgggggggagagccactgacgccgggaccgggaccgccgccgccgccgccaccatgctccatgcctgaccgtgactcgcatctcgccaggccagtgcatttcctcttctggctgtcatcggaattttcaagtgtcaagaccccactttgttcctgttgtcctggttccggctttgggaagcatgacctttcaggcctgctcagagacaccgcagtgcactttgtgcgttatcagccttacagagactctacggtcaggagtttttgtggcaatggaactgctggggtttcatctgcaaatgaaaaccatctggccagctgcttgggtcagatggaaaccagatgggagaagtcaggagcgggcagcgagcagcctggggcagcgtccctagtcacgtcatgtttccacttcctcttgccccctcgcctcccctgcctgcaaaacgattgttattaacccatcacctcctccaatgcccaggcagttccaggatacagggttctctcgcccaggccttggccagcccagaagatgtgacccagaacctagaaagagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgcagtt

SEQ ID NO: 4504 - DNA, 1686 bp, Homo sapiens
ggagagccactgacgccgggaccgggaccgccgccgccgccgccaccatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgagatctattgatgctatccctgacaaccaaaagtttaagcagttgcagagggagctctctcaagtgctgacccagcgccagatctacatccagcctgataattaagccgatccaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatactta

SEQ ID NO: 4505 - DNA, 1568 bp, Homo sapiens
gagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgca

SEQ ID NO: 4506 - DNA, 1175 bp, Homo sapiens
atgggtggcccacaggacaaggatgaacgcacaatcgcccttgtgaggccgtggccttgggggcaccaggccctggatccagcatatggcctggacacgatgcacccaagcaggcgcagcctccccttccctctgaactgtcagcttgcaagggttggaactgctgattatggaagtccctcggatcagagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccacc

SEQ ID NO: 4507 - DNA, 1710 bp, Homo sapiens
gcccggcgcggggggaggggggtgctgacccggatgttcactcctgggcacccggggaagtggaagcgccgggccctgctgcgggggggagagccactgacgccgggaccgggaccgccgccgccgccgccaccatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgcagttagc

SEQ ID NO: 4508 - DNA, 853 bp, Homo sapiens
ggcccccacagatagacctgccctcctgccacttgacccttctgcaggacaggcccagcacttaggttggaagggccagagaacttcttcctgacaggatcaagggatttttggagcatgtttgtatgtggactttgggcctcaaagtgttttgaggaccatggttccttgtttagtcaagggatgttgctgctgaacgaggagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagag

SEQ ID NO: 4509 - DNA, 1462 bp, Homo sapiens
tccctgtacctggggcgcgccttctttgcagcctttggggagcgaggggagctctccatcagggatggggtggtcccggtgctgtgccttctcagttgccgcttctagggaggccgcctaggagccagcgagggaagggcgggcatcggtgtgcccagaaggcagcgcgctgctctgcgggcccttctcgaggctgccgccgtgggtgctgtgcgtgcgaagcattctgcagggcaggccggggtccacggcgcccgggcctgagtgggagccgaggggcgaggatgggtggcccacaggacaaggatgaacgcacaatcgcccttgtgaggccgtggccttggggggccaccaggccctggatccagcatatggcctggacacgatgcacccaagcaggcgcagcctccccttccctctgaactgtcagcttgcaagggttggaactgctgattatggaagtccctcggatcagagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccc

SEQ ID NO: 4510 - DNA, 432 bp, Homo sapiens
gttggtgtcagacacatgtggaaaagaaaagaacaggcccataattttgtctcagtgcccagggccagatgttaaaggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggatt

SEQ ID NO: 4511 - DNA, 1442 bp, Homo sapiens
gacggcctggcatacccactgcccaccccagtgactgctcttctgcttcaggcctgctggcctcccagcactgcctgcccctccctgtcgggggacatcgcctccacaccggctggggaaggagcccaggggtggggctggtgggtggggctggtggttggggcagccagagaagtaagagggaagtgagaagccgggtggggcaggctggaaggaagacgaacctacgaagcagagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccatttgcccttgaactgctgatatctgatgactgctttgtgctggacaacgggctctgtggcaagatctatatctggaaggggcgaaaagcgaatgagaaggagcggcaggcagccctgcaggtggccgagggcttcatctcgcgcatgcagtacgccccgaacactcaggtggagattctgcctcagggccatgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacaagtgctttcccagctcttttcctgcaccacc

SEQ ID NO: 4512 - DNA, 835 bp, Homo sapiens
cttacacgcgtcctggcgtgtggctctcctgcgtcctcgtttttctcgtgagccctggatctggacagtgggcccggcgcgaggccctcaactccggctgggctcccggtggcactttctgccgaccctgagatgtacccgccacgcctgcgggactgacctctagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctga

SEQ ID NO: 4513 - DNA, 1183 bp, Homo sapiens
tccagggggcggggggcggctgagacagcgcccagggcctcggagcaaggcgttggcaggcaagtaacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccatttgcccttgaactgctgatatctgatgactgctttgtgctggacaacgggctctgtggcaagatctatatctggaaggggcgaaaagcgaatgagaaggagcggcaggcagccctgcaggtggccgagggcttcatctcgcgcatgcagtacgccccgaacactcaggtggagattctgcctcagggccatgagagtcccatcttcaagcaatttttcaaggactggaaatgagggtgggcgtcttcctgccccatgctcccctgccccccaccacctgcctgcttgcttctctggct

SEQ ID NO: 4514 - DNA, 1151 bp, Homo sapiens
gactcaccgggggcggctcctggccgcgcacctccagggggcggggggcggctgagacagcgcccagggcctcggagcaaggcgttggcagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccatttgcccttgaactgctgatatctgatgactgctttgtgctggacaacgggctctgtggcaagatctatatctggaaggggcgaaaagcgaatgagaaggagcggcaggcagccctgcaggtggccgagggcttcatctcgcgcatgcagtacgccccgaacactcaggtggagattctgcctcagggccatgagagtcccatcttcaagcaatttttcaaggactggaaatga

SEQ ID NO: 4515 - DNA, 865 bp, Homo sapiens
gctcccctcttcaactttagcactttctaatgctgacatctgtgattctgtgacattccccacttagaggaagttcgtctgcggtttcactggatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataag

SEQ ID NO: 4516 - DNA, 930 bp, Homo sapiens
agggggcggggggcggctgagacagcgcccagggcctcggagcaaggcgttggcaggagaggctttagcctagacagctgagtgtgaggaacagtgattcccattgatccttgttccctccgtgggtcacagagtccagaacttaagagccacccaagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataag

SEQ ID NO: 4517 - DNA, 839 bp, Homo sapiens
gtggcacatttgattattttgcaaactctggaagaccttggctgagggtctaggtggactgtctgagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataag

SEQ ID NO: 4518 - DNA, 1703 bp, Homo sapiens
gacagcgcccagggcctcggagcaaggcgttggcagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccatttgcccttgaactgctgatatctgatgactgctttgtgctggacaacgggctctgtggcaagatctatatctggaaggggcgaaaagcgaatgagaaggagcggcaggcagccctgcaggtggccgagggcttcatctcgcgcatgcagtacgccccgaacactcaggtggagattctgcctcagggccatgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacaagtgctttcccagctcttttcctgcaccacctgccctgggctgattctcactgtcacccacctattcacctgggttcatccccatgctgggggtggagtagcacacagatgacaattggacagccttggaggggccagagctgctttgcatgacagaggagtcccagccaggcttgcagggactgccatgaacccaatagggaggtggcacagtgccaggcctcaggatcagttgcatccgggtgttcagttcagtctcacattcccaacagggagaaggttgtggcaatgggcttgggatgcagttccatttaaggcagtatttcttcggatgccctaataaagcactgccaggcagcttcaagtgacatatgcccactgagcaagagaggacagcctttcacaattgtaccaagcctggcttattacttcgtaggcacattgcccagcatgtttggctggtgagcccagggccactgcagggctgtgcgaaaagcaccaggctagcatggacagtcttcagtctggttcttaccctgcctctgtgatcctaggc

SEQ ID NO: 4519 - DNA, 1546 bp, Homo sapiens
aaaggcgtgagcgcgcgtgcgtgcgtgtgcgggtgcgtgagcgtgagcgcgcggaggccggaagcgagcgctgcgcagtcgggtggtcgcgggccatggagggtagcttttcggatggcggagcgctgccggaggggctcgcggaagaggccgagccgcagggcgccgcctggagcggggacagtggcactgtttcccagagccacagcagcgcctcggggccgtgggaggacgagggcgcggaggacggcgcgccgggccgcgacctgccgctgcttcgccgcgccgctgcgggctacgccgcctgcctgctgcccggggccggggcgcggcccgaggtcgaggccctggacgcgagcctagaggacctgcttaccagagtggacgagttcgtgggcatgctggacatgcttcgcggcgactcgtcccacgtcgtcagcgagggcgtgccgcgcatccacgcgaaggccgccgagatgcggcgcatctacagcaggatcgaccggctggaggccttcgtgaggatggtggggggccgcgtggccaggatggaggagcaggtcaccaaggccgaggccgagctgggcaccttccccagggcgttcaagaagctcctgcacacgatgaacgtgccctcgctctttagcaagtctgctccctcgaggccacagcaagccggctacgaagcccccgtcctgtttcggaccgaagactacttcccttgttgcagtgaaaggcctcagctctgacggcctgaccactgcggcaagaggaccccagctggggtgcttacctccagtatgaagtgaattgcaaatcctgcttatggacatatatgatgttggagtgtgggattttaaagtttactttctacaaactctccgtagtatattcatgattcagtgtagaatgtatagactttatgtcttccaagtttaaaaaaagagacagggtcttggtatgttgcccagactgttcggaaactcctgggctcaagtgatccttccacctcagcctccccagtagctgggactacggggtcgccactgcacccagcctgtgtcttccagctctaatcagaaagctgcttgtcgagggcatggggaatcaaactgaatgaacttttctctgcactgtggcaaaactgttatttttatggattttactaaatggcgttaccttttcaagatttatatgtttgtataatcataagaaaattgagccattaaagccttgttattcaatcctaatagtcagttttctagaacctacttttagggtaaatggtacattatttaatattatattaaacctcctatagcgtggattgtagaccaaaggaaatggtacaatttctgagaatatatgttgattttttgtgactaattccaaagttgtatttgaaagtatgacctcacagtcttcatttgtccatagcaaacatatgtgtgtgtgtgtgtatatatatatgtgggttgccaatgtttggtttataatttaaatgttaatagaaattttgagttttattggaaatgatttccttctg

SEQ ID NO: 4520 - DNA, 7114 bp, Homo sapiens
gcgcgcccgaggctcctacgctgccgcgcccggcttctctccagcgccccgcgccgttagccacgtggaccgactccggcgcgccgtcctcacgtggttccagtggagtttgcagtccttcccgcttctccgtactcgcccccgcctctgagctcccttcccatggcggccctagtgttggaggacgggtcggtcctgcggggccagccctttggggccgccgtgtcgactgccggggaagtggtgtttcaaaccggcatggtcggctaccccgaggccctcaccgatccctcctacaaggcacagatcttagtgctcacctatcctctgatcggcaactatggcatccccccagatgaaatggatgagttcggtctctgcaagtggtttgaatcctcgggcatccacgtagcagcactggtagtgggagagtgctgtcctactcccagccactggagtgccacccgcaccctgcatgagtggctgcagcagcatggcatccctggcttgcaaggagtagacactcgggagctgaccaagaagttgcgggaacaggggtctctgctggggaagctggtccagaatggaacagaaccttcatccctgccattcttggaccccaatgcccgccccctggtaccagaggtctccattaagactccacgggtattcaatacagggggtgcccctcggatccttgctttggactgtggcctcaagtataatcagatccgatgcctctgccagcgtggggctgaggtcactgtggtaccctgggaccatgcactagacagccaagagtatgagggtctcttcttaagtaatgggcctggtgaccctgcctcctatcccagtgtcgtatccacactgagccgtgttttatctgagcctaatccccgacctgtctttgggatctgcctgggacaccagctattggccttagccattggggccaagacttacaagatgagatatgggaaccgaggccataaccagccctgcttgttggtgggctctgggcgctgctttctgacatcccagaaccatgggtttgctgtggagacagactcactgccagcagactgggctcctctcttcaccaacgccaatgatggttccaatgaaggcattgtgcacaacagcttgcctttcttcagtgtccagtttcacccagagcaccaagctggcccttcagatatggaactgcttttcgatatctttctggaaactgtgaaagaggccacagctgggaaccctgggggccagacagttagagagcggctgactgagcgcctctgtccccctgggattcccactcccggctctggacttccaccaccacgaaaggttctgatcctgggctcagggggcctctccattggccaagctggagaatttgactactcgggctctcaggcaattaaggccctgaaggaggaaaacatccagacgttgctgatcaaccccaatattgccacagtgcagacctcccaggggctggccgacaaggtctattttcttcccataacacctcattatgtaacccaggtgatacgtaatgaacgccccgatggtgtgttactgacttttgggggccagactgctctgaactgtggtgtggagctgaccaaggccggggtgctggctcggtatggggtccgggtcctgggcacaccagtggagaccattgagctgaccgaggatcgacgggcctttgctgccagaatggcagagatcggagagcatgtggccccgagcgaggcagcaaattctcttgaacaggcccaggcagccgctgaacggctggggtaccctgtgctagtgcgtgcagcctttgccctgggtggcctgggctctggctttgcctctaacagggaggagctctctgctctcgtggccccagcttttgcccataccagccaagtgctagtagacaagtctctgaagggatggaaggagattgagtacgaggtggtgagagacgcctatggcaactgtgtcacggtgtgtaacatggagaacttggacccactgggcatccacactggtgagtccatagtggtggcccctagccagacactgaatgacagggagtatcagctcctgaggcagacagctatcaaggtgacccagcacctgggaattgttggggagtgcaatgtgcagtatgccttgaaccctgagtctgagcagtattacatcattgaagtgaatgccaggctctctcgcagctctgccctggccagtaaggccacaggttatccactggcttatgtggcagccaagctagcattgggcatccctttgcctgagctcaggaactctgtgacagggggtacagcagcctttgaacccagcgtggattattgtgtggtgaagattcctcgatgggaccttagcaagttcctgcgagtcagcacaaagattgggagctgcatgaagagcgttggtgaagtcatgggcattgggcgttcatttgaggaggccttccagaaggccctgcgcatggtggatgagaactgtgtgggctttgatcacacagtgaaaccagtcagcgatatggagttggagactccaacagataagcggatttttgtggtggcagctgctttgtgggctggttattcagtggaccgcctgtatgagctcacacgcatcgaccgctggttcctgcaccgaatgaagcgtatcatcgcacatgcccagctgctagaacaacaccgtggacagcctttgccgccagacctgctgcaacaggccaagtgtcttggcttctcagacaaacagattgcccttgcagttctgagcacagagctggctgttcgcaagctgcgtcaggaactggggatctgtccagcagtgaaacagattgacacagttgcagctgagtggccagcccagacaaattacctatacctaacgtattggggcaccacccatgacctcacctttcgaacacctcatgtcctagtccttggctctggcgtctaccgtattggctctagcgttgaatttgactggtgtgctgtaggctgcatccagcagctccgaaagatgggatataagaccatcatggtgaactataacccagagacagtcagcaccgactatgacatgtgtgatcgactctactttgatgagatctcttttgaggtggtgatggacatctatgagctcgagaaccctgaaggtgtgatcctatccatgggtggacagctgcccaacaacatggccatggcgttgcatcggcagcagtgccgggtgctgggcacctcccctgaagccattgactcggctgagaaccgtttcaagttttcccggctccttgacaccattggtatcagccagcctcagtggagggagctcagtgacctcgagtctgctcgccaattctgccagaccgtggggtacccctgtgtggtgcgcccctcctatgtgctgagcggtgctgctatgaatgtggcctacacggatggagacctggagcgcttcctgagcagcgcagcagccgtctccaaagagcatcccgtggtcatctccaagttcatccaggaggctaaggagattgacgtggatgccgtggcctctgatggtgtggtggcagccatcgccatctctgagcatgtggagaatgcaggtgtgcattcaggtgatgcgacgctggtgacccccccacaagatatcactgccaaaaccctggagcggatcaaagccattgtgcatgctgtgggccaggagctacaggtcacaggacccttcaatctgcagctcattgccaaggatgaccagctgaaagttattgaatgcaacgtacgtgtctctcgctccttccccttcgtttccaagacactgggtgtggacctagtagccttggccacgcgggtcatcatgggggaagaagtggaacctgtggggctaatgactggttctggagtcgtgggagtaaaggtgcctcagttctccttctcccgcttggcgggtgctgacgtggtgttgggtgtggaaatgaccagtactggggaggtggccggctttggggagagccgctgtgaggcatacctcaaggccatgctaagcactggctttaagatccccaagaagaatatcctgctgaccattggcagctataagaacaaaagcgagctgctcccaactgtgcggctactggagagcctgggctacagcctctatgccagtctcggcacagctgacttctacactgagcatggcgtcaaggtaacagctgtggactggcactttgaggaggctgtggatggtgagtgcccaccacagcggagcatcctggagcagctagctgagaaaaactttgagctggtgattaacctgtcaatgcgtggagctgggggccggcgtctctcttcctttgtcaccaagggctaccgcacccgacgcttggccgctgacttctccgtgcccctaatcatcgatatcaagtgcaccaaactctttgtggaggccctaggccagatcgggccagcccctcctttgaaggtgcatgttgactgtatgacctcccaaaagcttgtgcgactgccgggattgattgatgtccatgtgcacctgcgggaaccaggtgggacacataaggaggactttgcttcaggcacagccgctgccctggctgggggtatcaccatggtgtgtgccatgcctaatacccggccccccatcattgacgcccctgctctggccctggcccagaagctggcagaggctggcgcccggtgcgactttgcgctattccttggggcctcgtctgaaaatgcaggaaccttgggcaccgtggccgggtctgcagccgggctgaagctttacctcaatgagaccttctctgagctgcggctggacagcgtggtccagtggatggagcatttcgagacatggccctcccacctccccattgtggctcacgcagagcagcaaaccgtggctgctgtcctcatggtggctcagctcactcagcgctcagtgcacatatgtcacgtggcacggaaggaggagatcctgctaattaaagctgcaaaggcacggggcttgccagtgacctgcgaggtggctccccaccacctgttcctaagccatgatgacctggagcgcctggggcctgggaagggggaggtccggcctgagcttggctcccgccaggatgtggaagccctgtgggagaacatggctgtcatcgactgctttgcctcagaccatgctccccataccttggaggagaagtgtgggtccaggcccccacctgggttcccagggttagagaccatgctgccactactcctgacggctgtaagcgagggccggctcagcctggacgacctgctgcagcgattgcaccacaatcctcggcgcatctttcacctgcccccgcaggaggacacctatgtggaggtggatctggagcatgagtggacaattcccagccacatgcccttctccaaggcccactggacaccttttgaagggcagaaagtgaagggcaccgtccgccgtgtggtcctgcgaggggaggttgcctatatcgatgggcaggttctggtacccccgggctatggacaggatgtacggaagtggccacagggggctgttcctcagctcccaccctcagcccctgccactagtgagatgaccacgacacctgaaagaccccgccgtggcatcccagggcttcctgatggccgcttccatctgccgccccgaatccatcgagcctccgacccaggtttgccagctgaggagccaaaggagaagtcctctcggaaggtagccgagccagagctgatgggaacccctgatggcacctgctaccctccaccaccagtaccgagacaggcatctccccagaacctggggacccctggcttgctgcacccccagacctcacccctgctgcactcattagtgggccaacatatcctgtccgtccagcagttcaccaaggatcagatgtctcacctgttcaatgtggcacacacactgcgtatgatggtgcagaaggagcggagcctcgacatcctgaaggggaaggtcatggcctccatgttctatgaagtgagcacacggaccagcagctcctttgcagcagccatggcccggctgggaggtgctgtgctcagcttctcggaagccacatcgtccgtccagaagggcgaatccctggctgactccgtgcagaccatgagctgctatgccgacgtcgtcgtgctccggcacccccagcctggagcagtggagctggccgccaagcactgccggaggccagtgatcaatgctggggatggggtcggagagcaccccacccaggccctgctggacatcttcaccatccgtgaggagctgggaactgtcaatggcatgacgatcacgatggtgggtgacctgaagcacggacgcacagtacattccctggcctgcctgctcacccagtatcgtgtcagcctgcgctacgtggcacctcccagcctgcgcatgccacccactgtgcgggccttcgtggcctcccgcggcaccaagcaggaggaattcgagagcattgaggaggcgctgcctgacactgatgtgctctacatgactcgaatccagaaggaacgatttggctctacccaggagtacgaagcttgctttggtcagttcatcctcactccccacatcatgacccgggccaagaagaagatggtggtgatgcacccgatgccccgtgtcaacgagataagcgtggaagtggactcggatccccgcgcagcctacttccgccaggctgagaacggcatgtacatccgcatggctctgttagccaccgtgctgggccgtttctagggcctggcttcctcagcctcttctctttaggcccagctgctgggcaaggaattccagtgcctcctacgggggcagcacacttagatattcctggacatccagatagctcacatgtgctgaccacacttcaggctctggactggagctctctggcatgggggtggggcctcagatgctggggcccagtctgccccatcttcattcctgcaccttaaacctgtacagtcatttttctactgacttaataaacagccgagctgtcccttgatgctga

SEQ ID NO: 4521 - DNA, 6970 bp, Homo sapiens
gccttggacgcggttcaggaatccgccgccgctagccggctcgggcctgagcggggagggcgccaggcaggacctctcgcaggctcgctgcgcaggacggcgcccgcctggcgccgcttcccttccagcgtgccgaccggccccgcagcgcctccatccctccggcccgccccggagaagacgcacagctcgggccgcgcgggcgccggggccgcggaaccgcttctgccgggatcttccaggaggaaagcgaagttgcgagcggatgctgcccgcgccggaccccagccgcggagggtcggggccgccggtggagtctcggcggccggggacaagggtgtcccccacctgaagacggcaagctgggtcctgagtgatgcccctcagctgagtgtccaaggctggcccgaggagcccccacggccccacctttccccatggagaaaggactcactttgccccaggactgccgggactttgtgcacagcctgaagatgagaagcaaatacgcccttttcttggtttttgtggtgatagtttttgtcttcatcgaaaaggaaaataaaatcatatcaagggtctcagacaagctgaagcagattccccaagctctagcagatgccaacagcaccgacccagccctgatcttagctgagaacgcatctctcttgtccctgagcgagctcgattcagccttctcccagcttcagagccgtctccgcaacctcagcttgcagctgggcgtggagccagccatggaggccgcaggggaggaagaggaagagcagagaaaggaggaggagccgcccagaccggccgtggcggggccccggcgccacgtgctgctcatggccaccacgcgcaccggctcctcgttcgtgggcgagttcttcaaccagcagggcaacatcttctacctcttcgagccgctgtggcacatcgagcgcacagtgtccttcgagccggggggcgccaacgccgcgggctcggccctggtgtaccgcgacgtgctcaagcagctcttcctgtgcgacctgtacgtgctggagcacttcatcacgccgctgcccgaggaccacctgactcagttcatgttccgccggggctccagccgctccctgtgcgaggaccccgtctgtacgcccttcgtcaagaaggtcttcgagaagtaccactgcaagaaccgccgctgcggccccctcaacgtgacgctggccgcagaggcctgccgccgcaaggagcacatggccctcaaggcggtgcgcatccggcagctggagttcctgcagccgctggccgaggacccccgcctggacctgcgcgtcatccagctggtgcgcgacccccgggccgtgctggcctcgcgcatggtggccttcgccggcaagtataagacctggaagaagtggctggacgacgagggccaggacggcctgagggaagaggaggtgcagcggctgcggggcaactgcgagagcatccgcctgtccgcggagctggggctgcggcagcccgcctggctgcggggccgctacatgctggtgcgctacgaggacgtggcacgcgggccgctgcagaaggcccgcgagatgtaccgcttcgccggcatccccctgaccccgcaggtggaagactggatccaaaagaacacgcaggcggcccacgacggcagcggcatctactccacgcagaagaactcctcggagcagttcgagaagtggcgcttcagcatgcccttcaagctggcccaggtggtgcaggccgcctgcggccctgccatgcgcctcttcggctacaaactggcgcgggacgccgccgccctcaccaaccgctcagtcagcctgctggaggagaggggcaccttctgggtcacgtaggggggccggggccccgtatgcccctcctcgtgaaaggcctgccccgtctttctgccgcagccctcgcagagggcgggtgcacagcgccatgagcgggcagcgcctcctgtagcagtagggcccccagccagcgctccagccaaagcggcggccccagggttaattgcggagaacaggacagtgcccggtccccttgagggccatcacacccagacccaacgggttgcagcctcctgagcaggcctaggcaggcccgggcctgttggcaagcttcgatctcacacacacagaaacatacattcgtgcctggagaccctgcaggccagagtccaaatatttaacaatcagaaggggcaaggctctgaccagtgacagtcagacctcctgctttatttggtgttaaccgtttcttgtctggatggtgaagtctggaatctgggtgggtccttggaggaggggctaggacagccgtgggtgtcaaaggtggcatttgaggctcgtttgaggtgacagtggctgtttaccaactagtacagagcgattcagcgttttcatgaatgggttggctgtgctggttactgatgaatatgggccccttatagagctgcaaaacacacacatgcgtatagacatacatacatgtacaccatacatagacaagcatcataaaggcacaagtgcacacacatctatgcagacaagcttcctcgctgcttatgcccacagggtttttctgtatgacacacctcagaggagcctgtgcttaacatttgtaggattatttcgagggcagggcaggggaaagaaacgcgttaaagggccatgacatgacacagttccctggccgggtttggactgaacagtggattcagaactgcagcgttcaaagcccctgcccgccttagattctcatggctacctcctctgacccatccacatccttgcggctggcaggcaggatgttttgaaatggtgcagccaaaggccccgtctagcttggctggctcccgaacatgtccatatttgaaggctgcctcaggcctggcaggcagaagcagctgtggtccctggaggcaaaaggcagctcacggggccttccatttccagccaggcctcatctggggtagggccaagaggaaagtacagagtgcccgtgggggagaagtcccaccaggatgccccccctcccctgagaagcccgccttctccctcgtggacaggagtcagccagttggttgctgtggttacagccagtgcctggaattcctccttagggccctgggaagagtattgcttaacgcaggatgtgctgggtgttttgtttcgggcttttatttatggcttggtgtctttcttgtttcatggctgtgtttttgcttttgtttctgtaggagcgcctcttccaagcagtggaggcctgagggcttgagggaggctggggaaaaccagcagggagcacttggctcctggcagagggagaggacaggaggaggagccttccccaggaggaacgaggagaggtggccacgtggcaggccacagtgccctatgggcttttctgtttgaaccccatgtgggatgaatctcaaagccaccagcgttcttgcctagtgtccagagcagcagagatttgcagccctcgcccctccctgagaagaagctggatttgaaaatccctcacaggccctaacatgtttcctgggtgggcaggggcctcatgacaagcgacaagtgtacccagagtagaaggccttccccactcccacctcaaacccaggagcagaactcagtatccagagcttacaaggagctgcaagggtttgccgagggctgcccagctctgcttctggtttcctggacaatttctctgtcagatacggcccattgtaaacccagagggctgcattttgggttgagtaatatggacaccatggaagtacaggatctgagtccaacattgccatgggggagggaagagtgtgtcctggcaggaagccaccattggagaaggtgaggccagtaaccatctcatgggattcgctataatcagcctatttgagctgctgggtctctgtcactgtggactccagtcattcaaggaggtctccactcttgggttttttttattttcttttcttttgctattttgcctgaacaccccaacactcttggttttagagtccaagagtaagttgtgcagagacatggttctaatttggagttcaaaggaacaccagctctgaaaacatgaccgtggggccaggatgtttctggcaggcccagaagtgctggccgttcttccccagcctccccactgctccctcctctgttccccatgtggaggtcggaggggctgggactggggagggggcagccacctccatccaaggctcttcctaggggccctgctaatgtggacagtagactttatccctccttcttactctgggccaagacctcccactccgccctctgaggatggtaccaagaatgggcctttgggacttctcaggacattgacaatgtgcacactgcaggttgacttaatttatttattttttgaaaagaagagacagaaaataccttattatctgcagggactcaaagctgtacccaaatcaagaaagacaaaataacaatagaaaccattcacacactccgttcatgcatggacaccagaagacgattcagaacacaagaggagaatgagctggagcgccagcaccacgatggccccaggacgttgtttaagatctgagatcccttggtttctctcttgttgatctgagatgctacatcagggcccttgctgctgtattacctctgcccgggtgtttgagacaggtcacaagcgcgtggatgtttcctggaagtgtattcccctggggctcagcgatgctctgggaacccttggggtttggggaaggacagtgtggtgtgactattggcttgaaacgttatggatatggttggagtcacccatgtggatatgattttcagcttggagctgggatggagaagatggaagcactggtggccgggcctctttttccagcgaggccagccctggcttctcctctgttccagcttgtctgccagaagccttcccctgcaaggtgcccacctgcccggagacagagggagcagctgaggcctctctccactggccgccagcctccctagcacaaggggaccattcagcaatgagtgtttactcatgttctttcttgttgatgagttctgcggcccagcatatagaaatggctcagaacgttccaggccttggtgagacacagcagcgtccaatgctcacaggctgtccccactctgcctgttcccatcttcccctcgggacctgtttataaattgaggaatggatgagggccctggagggtccttgggagtagttagtggagggcaggattctcaggtccccatagagagggaaagagaagaccagatgtgcatagaagccagtctctgtcacatacaccgcaggtggtcaccgagttattttccaaaagctgaggaacataaagcaaatttaggcttttgtccttctgcaatacatgcacttgaaaataaacagaaaagagatgtttaataacaagtttacttccggtctgctagcaccctcagcctgggagctactgccagaggctggcgtagtggggcagctgctgaccaaaccccacagaacagagggcaccaggcatcacacgacatctttccctcccatctctgccatctgtctgtctggcaatggaaggagcttcagcaggaggtccttcccagaaggttgattcttggcctgggtggtagaggagatatcctgaccctaaagtcttccagccccgggtcatcctctcctatactagggcctattgaccgtagaggccaggtgcggtggctcatacctgtaatcccagcagttggggaggccaaggtgggaggattgcttgagcccaagagttggagaccagcctgggcaacatggtgagaccaattgactgtagggcttgtcccttgctaagacaggagcagaagactggatggctgtgtcctcaaggcagtcccctcccatccccattcccaaagtcagaaagtgaagccagatctcaagggctgatacctgaggcaaggagagctaaggggagagaaattggggctgagtggaagcagatgcctgcacaagccaagtgtgtcttattgatctgtacaagctgatagaaggaccatctgctgaaatccagggctcctgagttggtgggtttgcttgtgaagcttctaggacaaggcgcagccagatggaagggagagggtccagggcttcctaaatgcagccgcatcacctgtcaactcgctgcagtttcagagacagtggaagctgctctttacctcaaaagcacaaagcagaattggcaacttcacttgtctcaagagctccaagatcctttggtctcgtgtcctttggcaccccgtaactggactggggacaaatttgttacgtgtttccaaggctacagacatggcgccatcctcacaggcctagctcatgtcatggatcaggtgctttgctggggggatacaatgacccatgtggtctgcgtcttctgccattggcttgaactgggcaccccctgaagtctccatctcagctgtatattctagtccaaattttcctggctcccctgctccctcccaggtcctgcacactgtctttttgccaacacctcagccctgtttgctatttcatgtctgcatggtacgagacaccccttcacggcatacactgccatggtatgtacatatgcatccacgtgtgtgtatgtgtagcatgtagctcattctgctcagcctctggcgccgttccacattgctcccagccccattgctgtcactgtcgtcccagatgtccttgccatggccacagacaatctgccgtctcctggaaacgctggggctgcccttcagagagctggcagccccagcagtcagggcctgctttgcagaatagaatgtgaacccaactcctgatggcctacttgacttatttaattaaagatgaaatcatgcaatgagcaaaacctgca

SEQ ID NO: 4522 - DNA, 2718 bp, Homo sapiens
gctcggagctgtagccgccgctgccgccgctgctcttggctcggggacgcgggcgggcgctccgagaggctctggtgcctgcggctgctgctctcctccggcgcccggggctgcggcgctccgggtcccggcccctgtcccggcatctctcgggtccctgagccccggccccgggtcccgcgtccggccggagagaacgcactcagctgctcgagccgccccgggctcgcgcccccgggccatgaagaggggcccgtgaggcgcgcgcggagtcggaggaagaggagggaggagggaggccgaggaggagggcgcgggaggcggaggatgccgccgcggctgctgccgccgccgccacccgcgggtccccggcgaccctgactccagacccgaggatggagccggcgctgggcgctgcagctgctcccggcgcgtccccgaccaggtagctggtgtcacttcggtgtggttggaagaagactttctccccagctgcattcccggaggcgccctttcgacctggaggccgggtctgctggccacagggctgccgcactggctgggactgccagctgggcctggagacgctggtggctgtggactccccagcttggagcagtccctctttgacctcaccccttggagaagcagccccatgaaggtgcccagccatgcaatgttcctggaaggccgtcctcctccttgccctggcctccattgccatccagtacacggccatccgcaccttcaccgccaagtcctttcacacctgccccgggctggcagaggccgggctggccgagcgactgtgcgaggagagccccaccttcgcctacaacctctcccgcaagacccacatcctcatcctggccaccacgcgcagtggctcctccttcgtgggccagctcttcaaccagcacctggacgtcttctacctgtttgagcccctctaccacgtccagaacacgctcatcccccgcttcacccagggcaagagcccggccgaccggcgggtcatgctaggcgccagccgcgacctcctgcggagcctctacgactgcgacctctacttcctggagaactacatcaagccgccgccggtcaaccacaccaccgacaggatcttccgccgcggggccagccgggtcctctgctcccggcctgtgtgcgaccctccggggccagccgacctggtcctggaggagggggactgtgtgcgcaagtgcgggctactcaacctgaccgtggcggccgaggcgtgccgcgagcgcagccacgtggccatcaagacggtgcgcgtgcccgaggtgaacgacctgcgcgccctggtggaagacccgcgattaaacctcaaggtcatccagctggtccgagacccccgcggcattctggcttcgcgcagcgagaccttccgcgacacgtaccggctctggcggctctggtacggcaccgggaggaaaccctacaacctggacgtgacgcagctgaccacggtgtgcgaggacttctccaactccgtgtccaccggcctcatgcggcccccgtggctcaagggcaagtacatgttggtgcgctacgaggacctggctcggaaccctatgaagaagaccgaggagatctacgggttcctgggcatcccgctggacagccacgtggcccgctggatccagaacaacacgcggggcgaccccaccctgggcaagcacaaatacggcaccgtgcgaaactcggcggccacggccgagaagtggcgcttccgcctctcctacgacatcgtggcctttgcccagaacgcctgccagcaggtgctggcccagctgggctacaagatcgccgcctcggaggaggagctgaagaacccctcggtcagcctggtggaggagcgggacttccgccccttctcgtgacccgggcggtgcgggtgggggcgggaggcgcaaggtgtcggttttgataaaatggaccgtttttaactgttgccttattaacccctccctctcccacctcatcttcgtgtccttcctgcccccagctcaccccactcccttctgccccttttttgtctctgaaatttgcactacgtcttggacgggaatcactggggcagagggcgcctgaagtagggtcccgccccccccccccccattcagacacatggatgttgggtctctgtgcggacggtgacaatgtttacaagcaccacatttacacatccacacacgcacacgggcactcgcgaggcgacttctcaagcttttgaatgggtgagtggtcgggtatctagtttttgcactgtcttactattcaaggtaagaggatacaaacaagaggaccacttgtctctaatttatgaatggtgtccatcctttccccatccctgcctcctgcccctgacgcccatttccccccttagagcagcgaaactgccccctcctgcccgcccttgcctgtcggtgaggcaggtttttactgtgaggtgaacgtggacctgtttctgtttccagtctgtggtgatgctgtctgtctgtctgagtctcgtggccgcccctggaccagtgatgactgatgaatcttatgagcttctgattgatctcggggtccatctgtgatatttctttgtgccaaaaagaaaaaaaaagagtggatcagtttgctaaatgaacattgaaattgaaatgctttatctgtgttttctgtaaataaaagagtgcaataatc

SEQ ID NO: 4523 - DNA, 2194 bp, Homo sapiens
ctgcgaggccgggggtggagagcggccgggcgggacatccggcccgggtccctcgccgcgcccgccgcccgccgcccgcttcggcgccgcagcccgggagccggccacccctacacgcgccagggctgtcccctgccctcccctccccaactacccccggtcccagaccctcctcccgcccccagcccgagcccgccttccaggccgccctcggatcggccgggcccgcgcaggcccccaccccttgagcaccatgttcccccgcccgctgaccccgctggcggccccaaatggcgccgagcccctgggccgggcgctgaggcgggcccctctgggcagggcccgggcggggctgggtgggccgcccctgctgctgccgtccatgctgatgtttgcggtgatcgtggcctccagcgggctgctgctcatgatcgagcggggcatcctggccgagatgaagcccctgcccctgcacccgcccggccgcgagggcacagcctggcgcgggaaagcccccaagcctgggggcctgtccctcagggctggggacgcggacttgcaagtgcggcaggacgtccggaacaggaccctgcgggcggtgtgcggacagccaggcatgccccgggacccctgggacttgccggtggggcagcggcgcaccctgctgcgccacatcctcgtaagtgaccgttaccgcttcctctactgctacgtccccaaggtggcctgctctaactggaagcgggtgatgaaggtgctggcaggcgtcctggacagcgtggacgtccgcctcaagatggaccaccgcagtgacctggtgttcctggccgacctgcggcctgaggagattcgctaccgcctgcagcactactttaagttcctgtttgtgcgggagcccttggaacgcctcctctctgcctaccgcaacaagtttggcgagatccgagagtaccagcaacgctatggggctgagatagtgaggcggtacagggctggagcggggcccagccctgcaggcgacgatgtcacattccccgagttcctgagatacctggtggatgaggaccctgagcgcatgaatgagcattggatgcccgtgtaccacctgtgccagccttgtgccgtgcactatgactttgtgggctcctatgagaggctggaggctgatgcaaatcaggtgctggagtgggtacgggcaccacctcacgtccgatttccagctcgccaggcctggtaccggccagccagccccgaaagcctgcattaccacttgtgcagtgccccccgggccctgctgcaggatgtgctgcctaagtatatcctggacttctccctctttgcctacccactgcctaatgtcaccaaggaggcgtgtcagcagtgaccatgggtgtggggccagcagctggtggggactggtttcaacgccagctttctgtgcttctgcctgtcattcggagaaactctggctctggggcttggggcttctcaggatcctggatggcagagactgccctcagaagttccttgtccagggtgggcacccacagtgactcagaggacagggctaggcaggagacctgctgctcctcattggggggatctcttggggggcagacaccagtttgccaatgaagcaacacatctgatctaaagactggctccagaccccgggctgccaggattatgcagtccacttggtctaccttaatttaacctgtggccaaactcagagatggtaccagccaggggcaagcatgaccagagccagggaccctgtggctctgatcccccatttatccaccccatgtgcctcaggactagagtgagcaatcataccttataaatgacttttgtgcctttctgctccagtctcaaaatttcctacacctgccagttctttacatttttccaaggaaaggaaaacggaagcagggttcttgcctggtagctccaggacccagctctgcaggcacccaaagaccctctgtgcccagcctcttccttgagttctcggaacctcctccctaattctcccttccttccccacaaggcctttgaggttgtgactgtggctggtatatctggctgccatttttctgatgcatttatttaaaatttgtactttttgatagaacccttgtaagggctttgttttcctaatagctgactttttaataaagcagttttatat

SEQ ID NO: 4524 - DNA, 2478 bp, Homo sapiens
gggactcgtcccagagtttgctgccgccgccgccgctgccattagagcggttttaattagctgcaggatttttaatgagctgaaatcaagaagagccccatctcagaagtaagcgagagccgcgcgcagggaagaactagtctgacaaaacagaaggaggtggtgctctcgggggactgggctgtaggctcccaccgatcgatcggcgacgagcagatgagttcccgaggccaggaggctgaggagggaagccagggctcagagaccagcgcccggtgcagagtccccgctgctgccaccgcggcagaaggcacggtgccggattcaaggtgacggcagtgcctggctccattctcctcaagttgccatagcagcctctctcccaacaagcagcttctccgggagccctcagccgggagggacgtcattgttctctcctgcccgtgtggtgcaaggagacccaccggacagagaactttcccgagcccggggtccgctgaccacgtgggtgcacccatgctgcctggagccaggcacagggacaggtccccacggccacagggaatcctctgggcagctgaggggagcgtccaggcccagaagcagctgcagccaagcgtgtccttggagccgtccatgcgtctgtccgcctgctgccggtcgccactggagatctcggcctgatggacgcctggtgtggacgatgagggaagaacgtgccccccacacccaagaggtgacccctgagccagccccggatgaccctgcgacctggaacaatgcggctggcctgcatgttctcttccatcctgctgttcggagctgcaggcctcctcctcttcatcagcctgcaggaccctacggagctcgccccccagcaggtgccaggaataaagttcaacatcaggccaaggcagccccaccacgacctcccaccaggcggctcccaggatggtgacttgaaggaacccacagagagggtcactcgggacttatccagtggggccccgaggggccgcaacctgccagcgcctgaccagcctcaacccccgctgcagaggggaacccgtctgcggctccgccagcgccgtcgccgtctgctcatcaagaaaatgccagctgcggcgaccatcccggccaacagctcggacgcgcccttcatccggccgggacccgggacgctggatggccgctgggtcagcctgcaccggagccagcaggagcgcaagcgggtgatgcaggaggcctgcgccaagtaccgggcgagcagcagccgccgggccgtcacgccccgccacgtgtcccgtatcttcgtggaggaccgccaccgcgtgctctactgcgaggtgcccaaggccggctgctccaattggaagcgggtgctcatggtgctggccggcctggcctcgtccactgccgacatccagcacaacaccgtccactatggcagcgctctcaagcgcctggacaccttcgaccgccagggtatcttgcaccgtctcagcacctacaccaagatgctctttgtccgcgagcccttcgagaggctggtgtccgccttccgcgacaagtttgagcaccccaacagctactatcacccggtcttcggcaaggccatcctggcccggtaccgcgccaatgcctctcgggaggccctgcggaccggctctggggtgcgttttcccgagttcgtccagtacctgctggacgtgcaccggcccgtggggatggacattcactgggaccatgtcagccggctctgcagcccctgcctcatcgactacgatttcgtaggcaagttcgagagcatggaggacgatgccaacttcttcctgagcctcatccgcgcgccgcggaacctgaccttcccccggttcaaggaccggcactcgcaggaggcgcggaccacagcgaggatcgcccaccagtacttcgcccaactctcggccctgcaaaggcagcgcacctacgacttctactacatggattacctgatgttcaactattccaagccctttgcagatctgtactgaggggcgccgcagctggccggggccgccctgccccggtcactcacctgtgctcccgggcatcctcctgtccctggctcctcatcctgggagcaacagggctctgaggacgtgaggagccatcgctgtgggaggcagcaggccccgggtggggggcagaggcgcccagccttggatggggaccccagcccctggcctgtacctgtttcctcattccttggctgagggagaggctgagaactgggcagacacccctggagctcagccgacagttttgatgagcagggaagtctgaggcccagaggacggggggcccagcggtaagggatgtcccgcactcccttagccattgccttggaccaaaccacgtggtttgcagcttttctacgagccaggggggaggttcccttggattaaggttccaaataaagcacatggtttccagagc

SEQ ID NO: 4525 - DNA, 2225 bp, Homo sapiens
ttcgctgggagccttcccggcgcgcaagccggatccggcagtgctgcggggaggagagaggacgaggcggcggcggcagcaggaggtgggggaccgatcgcgccgggggccgaagaggaacgccgccccgcgccctctcgctccccgcacgctccggctgccggccccacgctgctcgcccacagatcgcactgggttccgcttggagcgggcggaggcaccgggcccgagctgggtcggaggtcctctccgccgcctgcgcgccccaagcagaggatccgccgcggagaaccgctcccggactggaggcgcccgcggcctcgggtgcgtccgctgcgccaggtttaaaggtcaacaagaatatcttaccttaatttgacaagtacgcaagaaataatgcaagactcgtttatgttcagatctcggcctgatggacgcctggtgtggacgatgagggaagaacgtgccccccacacccaagaggtgacccctgagccagccccggatgaccctgcgacctggaacaatgcggctggcctgcatgttctcttccatcctgctgttcggagctgcaggcctcctcctcttcatcagcctgcaggaccctacggagctcgccccccagcaggtgccaggaataaagttcaacatcaggccaaggcagccccaccacgacctcccaccaggcggctcccaggatggtgacttgaaggaacccacagagagggtcactcgggacttatccagtggggccccgaggggccgcaacctgccagcgcctgaccagcctcaacccccgctgcagaggggaacccgtctgcggctccgccagcgccgtcgccgtctgctcatcaagaaaatgccagctgcggcgaccatcccggccaacagctcggacgcgcccttcatccggccgggacccgggacgctggatggccgctgggtcagcctgcaccggagccagcaggagcgcaagcgggtgatgcaggaggcctgcgccaagtaccgggcgagcagcagccgccgggccgtcacgccccgccacgtgtcccgtatcttcgtggaggaccgccaccgcgtgctctactgcgaggtgcccaaggccggctgctccaattggaagcgggtgctcatggtgctggccggcctggcctcgtccactgccgacatccagcacaacaccgtccactatggcagcgctctcaagcgcctggacaccttcgaccgccagggtatcttgcaccgtctcagcacctacaccaagatgctctttgtccgcgagcccttcgagaggctggtgtccgccttccgcgacaagtttgagcaccccaacagctactatcacccggtcttcggcaaggccatcctggcccggtaccgcgccaatgcctctcgggaggccctgcggaccggctctggggtgcgttttcccgagttcgtccagtacctgctggacgtgcaccggcccgtggggatggacattcactgggaccatgtcagccggctctgcagcccctgcctcatcgactacgatttcgtaggcaagttcgagagcatggaggacgatgccaacttcttcctgagcctcatccgcgcgccgcggaacctgaccttcccccggttcaaggaccggcactcgcaggaggcgcggaccacagcgaggatcgcccaccagtacttcgcccaactctcggccctgcaaaggcagcgcacctacgacttctactacatggattacctgatgttcaactattccaagccctttgcagatctgtactgaggggcgccgcagctggccggggccgccctgccccggtcactcacctgtgctcccgggcatcctcctgtccctggctcctcatcctgggagcaacagggctctgaggacgtgaggagccatcgctgtgggaggcagcaggccccgggtggggggcagaggcgcccagccttggatggggaccccagcccctggcctgtacctgtttcctcattccttggctgagggagaggctgagaactgggcagacacccctggagctcagccgacagttttgatgagcagggaagtctgaggcccagaggacggggggcccagcggtaagggatgtcccgcactcccttagccattgccttggaccaaaccacgtggtttgcagcttttctacgagccaggggggaggttcccttggattaaggttccaaataaagcacatggtttccagagc

SEQ ID NO: 4526 - DNA, 2136 bp, Homo sapiens
cttcccggcgcgcaagccggatccggcagtgctgcggggaggagagaggacgaggcggcggcggcagcaggaggtgggggaccgatcgcgccgggggccgaagaggaacgccgccccgcgccctctcgctccccgcacgctccggctgccggccccacgctgctcgcccacagatcgcactgggttccgcttggagcgggcggaggcaccgggcccgagctgggtcggaggtcctctccgccgcctgcgcgccccaagcagaggatccgccgcggagaaccgctcccggactggaggcgcccgcggcctcgggtgcgtccgctgcgccagatctcggcctgatggacgcctggtgtggacgatgagggaagaacgtgccccccacacccaagaggtgacccctgagccagccccggatgaccctgcgacctggaacaatgcggctggcctgcatgttctcttccatcctgctgttcggagctgcaggcctcctcctcttcatcagcctgcaggaccctacggagctcgccccccagcaggtgccaggaataaagttcaacatcaggccaaggcagccccaccacgacctcccaccaggcggctcccaggatggtgacttgaaggaacccacagagagggtcactcgggacttatccagtggggccccgaggggccgcaacctgccagcgcctgaccagcctcaacccccgctgcagaggggaacccgtctgcggctccgccagcgccgtcgccgtctgctcatcaagaaaatgccagctgcggcgaccatcccggccaacagctcggacgcgcccttcatccggccgggacccgggacgctggatggccgctgggtcagcctgcaccggagccagcaggagcgcaagcgggtgatgcaggaggcctgcgccaagtaccgggcgagcagcagccgccgggccgtcacgccccgccacgtgtcccgtatcttcgtggaggaccgccaccgcgtgctctactgcgaggtgcccaaggccggctgctccaattggaagcgggtgctcatggtgctggccggcctggcctcgtccactgccgacatccagcacaacaccgtccactatggcagcgctctcaagcgcctggacaccttcgaccgccagggtatcttgcaccgtctcagcacctacaccaagatgctctttgtccgcgagcccttcgagaggctggtgtccgccttccgcgacaagtttgagcaccccaacagctactatcacccggtcttcggcaaggccatcctggcccggtaccgcgccaatgcctctcgggaggccctgcggaccggctctggggtgcgttttcccgagttcgtccagtacctgctggacgtgcaccggcccgtggggatggacattcactgggaccatgtcagccggctctgcagcccctgcctcatcgactacgatttcgtaggcaagttcgagagcatggaggacgatgccaacttcttcctgagcctcatccgcgcgccgcggaacctgaccttcccccggttcaaggaccggcactcgcaggaggcgcggaccacagcgaggatcgcccaccagtacttcgcccaactctcggccctgcaaaggcagcgcacctacgacttctactacatggattacctgatgttcaactattccaagccctttgcagatctgtactgaggggcgccgcagctggccggggccgccctgccccggtcactcacctgtgctcccgggcatcctcctgtccctggctcctcatcctgggagcaacagggctctgaggacgtgaggagccatcgctgtgggaggcagcaggccccgggtggggggcagaggcgcccagccttggatggggaccccagcccctggcctgtacctgtttcctcattccttggctgagggagaggctgagaactgggcagacacccctggagctcagccgacagttttgatgagcagggaagtctgaggcccagaggacggggggcccagcggtaagggatgtcccgcactcccttagccattgccttggaccaaaccacgtggtttgcagcttttctacgagccaggggggaggttcccttggattaaggttccaaataaagcacatggtttccagagc

SEQ ID NO: 4527 - DNA, 4810 bp, Homo sapiens
gtcccctccctgcgccccgccgcgtctcgggaggcggcgtgactcgggagttgccggcgcttcccggcggtggcggcgtctctggccggccttggtgcggcgagccgagcgaggcagctctgagccgcgcggaaatctggcattttttaaagtttgcgccccacaaagaggaaatattccaaaggtactcaggatgtaaaaggggagatcttcacagatgcctccgtggatggcatggcaatccatccatcaatgagaagaccatgatttcttttaattttctgtgtgtttccacattccccagtgagaattcttccacctttttttgtgccatgggaaaaacctgaagggcaggcagagctgctcccgaacttgtgaccttctctgaggttgcagcggctcttgtagaacatgactctgggacatcacttccttttgttttctttcggagctgaaccaaagaatgtgcaccctctttctctagtgctgtggtgtctgcttatttttgtatttgtgctttccatccatcttctgtgatcacaaggcattcttaaggttttctagcacgacttgcggacatccagactcgtggggggcccacccatggctcggtaagccagcagcccagggcactggcactaccatgaggcactgcattaattgctgcatacagctgttacccgacggcgcacacaagcagcaggtcaactgccaagggggcccccatcacggtcaccaggcgtgccccacgtgcaaaggagaaaacaaaattctgtttcgtgtggacagtaagcagatgaacttgcttgctgttctcgaagtgaggactgaagggaacgaaaactggggtgggtttttgcgcttcaaaaaggggaagcgatgtagcctcgtttttggactgataataatgaccttggtaatggcttcttacatcctttctggggcccaccaagagcttctgatctcatcacctttccattacggaggcttccccagcaaccccagcttgatggacagcgaaaacccaagtgacacaaaggagcatcaccaccaatcctctgtaaataatatttcatacatgaaggactatccaagcattaaattaattatcaacagcatcacaactaggattgagttcacgaccagacagctcccagacttagaagaccttaagaagcaggagttgcatatgttttcagtcatccccaacaaattccttccaaacagtaagagcccctgttggtacgaggagttctcggggcagaacaccaccgacccctacctcaccaactcctacgtgctctactccaagcgcttccgctccaccttcgacgccctgcgcaaggccttctggggccacctggcgcacgcgcacgggaagcacttccgcctgcgctgcctgccgcacttctacatcatagggcagcccaagtgcgggaccacagacctctatgaccgcctgcggctgcaccctgaggtcaagttctccgccatcaaggagccacactggtggacccggaagcgctttggaatcgtccgcctaagagatgggctgcgagaccgctatcccgtggaagattatctggacctctttgacctggccgcacaccagatccatcaaggactgcaggccagctctgcaaaggagcagagcaagatgaatacaatcattatcggggaggccagtgcctccacgatgtgggataataatgcctggacgttcttctacgacaacagcacggatggcgagccaccgtttctgacgcaggacttcatccacgcctttcagccaaatgccagactgattgtcatgctcagggaccctgtggagaggttgtactcagactatctctactttgcaagttcgaataaatccgcggacgacttccatgagaaagtgacagaagcactgcagctgtttgaaaattgcatgcttgattattcactgcgcgcctgcgtctacaacaacaccctcaacaacgccatgcctgtgaggctccaggttgggctctatgctgtgtaccttctggactggctcagcgtttttgacaagcaacagtttctcattcttcgcctggaagatcatgcatccaacgtcaagtacaccatgcacaaggtcttccagtttctgaacctagggcccttaagtgagaagcaggaggctttgatgaccaagagccccgcatccaatgcacggcgtcccgaggaccggaacctggggcccatgtggcccatcacacagaagattctgcgggatttctacaggcccttcaacgctaggctggcgcaggtcctcgcggatgaggcgtttgcgtggaagacgacgtgagagctgaattgttgctgcacgtgctgggcccgccaatgccgtcatcatcaggattttacaaatctctttgcggggaactgtttcactcatggtatggaaaaccccaggactctgccactctaggcacacatgaattataaccattttggaatttccttcgtgatgttcgagagctcagcaatggacccctcacagagctcctctatccgaggccattggagaccccagtttctcaagaattcagctctgctctgagcgtcctggagcttggggatgcagccagctggcctgcactgggtgtggagagaacacctagggaaggcagcctggccctgcccgcctccgccttctggagagcctctgggttctgagtcagcaagccagaggtcatgccacaggcctggctggaacttacacttcacgttccctttttttccccctagagatggggtctcgccgtgttgcacagactgtctgtattcaatggctatcttcacaggtgtgatcataccacattcacttctgaaacactcttgttgcgatcgctaacctcactgggacagagaaccgcagtctttcgagaatggaggctcttcattttttttttctcctttactccaaactcagccctccagtttcttcagatgtaaaccctgttaacgtcactgtttccaaaaggaaaaaaataagtcagtttttggcagcaccttcatctttctgacctcctcctattctgtccttgtggacttatgtttaacatagaaaatgaatgcgtttaaaacaaaaccactttctgcatttaaccagtcctggctctctctctgctgcctcttcatacgttttctcaagaacttcagtttataattggaagagaaatttttgctgttaatgccagaatgagcaacctcaaggaattgaacacttcttggaaaatctaggtaattcaagccctcatcaggtttacaagatcatcagagaaacagaggattttaatttttagttctggccggctacaggctccatttctctgccttcccattggaaatagtttatttccacattctccactgcgtgtggtcaaagttcctcacccagcaagggactatagatactcgtgtcccaattccaaaacacaatgcacaagctgaacttgggctgaacgtggcgtgttgagatttggaatgaggtttctaagagccgtgttcttcatggaattttccaggccacttggcagcttggtttaccgatggatgggctagagatcttgtcgtttcttggaagtcacagggaagattgaagagaacgcttgagcatccttggcaacagcccaggtgggacctggatgaagctttgcactcaagtattgtcaagggaagcttcctgtgaaccaaagttctcaggccaaggtctcgcccaccaaagccagaaagtgcaagcacccgtctacccagctctaacttgtatgtgtgagacagaccaggcttcgggggtaggaggatctgcagttgttcagccgtctttctgctggtgttgtctttctgccatcagagaagggacacacagcccgttcgaaggtgtgcagagggctctgagcgccaggatggccagggctgtttttgctactgaaggagcgtgtgtcctgaactcccacttgcagggacagtccccaccttctctatagccggcactgggagcagccgccagcagggaaatctggcctgagcacaaggatgctttagggagagatcacttcagtgtgtgtgtatatttatttgcagtacagtgcgcgcgtgtgtgtgtgtgtacgcgcacgtgtgggtgagtgcgtcttctgagtgggttctgttcagttgctaatgaggctcctccgctctggacacaacccttttatagattaatttctctgccaattaacttgtcattttcagtacatattttactattccacaccaaccataattacaacaagggatttttcttatgcactcctatgcatgtgaataacatgtggtgtaattctgcttcttacagaagtattactgaaggtattatttccaatattatttggtttattatgcggatcttttttatatatgcagtcccatcccttctgtgccactcaatgccatccagacatggtttttccctccaggggcctttctctccagagggcacttcggctgcctctgcttcctctcattcgaggcccggctcttgctgacagaataggttccgttctgggcggtggttctcgagcctgccattcaaaaccaaagcaaattggagcatttctcacaacatggtattgaagttcctttttgttctcaaaagttgtgaccgtgttaaattgtactcccttagtcctgtaaggtatgttaagtgaatcgcagttacgctgtacttttattaatatttaacataattaaagatggacccataagagtgacgcctgtggagcgcgtgctcttcctctgcagccaa

SEQ ID NO: 4528 - DNA, 2255 bp, Homo sapiens
attccagactggagctgatgtgtgtcagcgcgacatggggcggggggagggttctcctcggatgtttcattcgccgtctgcacgtcactcccaaacttttcctcccagcgctcggggagtcaggttgacgcgccctggatgcggggctagaggctcggggctgggcgcgctcccgcggagccggagccgcagaggctcccgggctggactcaggcttctcaggaaatctggcattttttaaagtttgcgccccacaaagaggaaatattccaaaggtactcaggatgtaaaaggggagatcttcacagatgcctccgtggatggcatggcaatccatccatcaatgagaagaccatgatttcttttaattttctgtgtgtttccacattccccagtgagaattcttccacctttttttgtgccatgggaaaaacctgaagggcaggcagagctgctcccgaacttgtgaccttctctgaggttgcagcggctcttgtagaacatgactctgggacatcacttccttttgttttctttcggagctgaaccaaagaatgtgcaccctctttctctagtgctgtggtgtctgcttatttttgtatttgtgctttccatccatcttctgtgatcacaaggcattcttaaggttttctagcacgacttgcggacatccagactcgtggggggcccacccatggctcggtaagccagcagcccagggcactggcactaccatgaggcactgcattaattgctgcatacagctgttacccgacggcgcacacaagcagcaggtcaactgccaagggggcccccatcacggtcaccaggcgtgccccacgtgcaaaggagaaaacaaaattctgtttcgtgtggacagtaagcagatgaacttgcttgctgttctcgaagtgaggactgaagggaacgaaaactggggtgggtttttgcgcttcaaaaaggggaagcgatgtagcctcgtttttggactgataataatgaccttggtaatggcttcttacatcctttctggggcccaccaagagcttctgatctcatcacctttccattacggaggcttccccagcaaccccagcttgatggacagcgaaaacccaagtgacacaaaggagcatcaccaccaatcctctgtaaataatatttcatacatgaaggactatccaagcattaaattaattatcaacagcatcacaactaggattgagttcacgaccagacagctcccagacttagaagaccttaagaagcaggagttgcatatgttttcagtcatccccaacaaattccttccaaacagtaagagcccctgttggtacgaggagttctcggggcagaacaccaccgacccctacctcaccaactcctacgtgctctactccaagcgcttccgctccaccttcgacgccctgcgcaaggccttctggggccacctggcgcacgcgcacgggaagcacttccgcctgcgctgcctgccgcacttctacatcatagggcagcccaagtgcgggaccacagacctctatgaccgcctgcggctgcaccctgaggtcaagttctccgccatcaaggagccacactggtggacccggaagcgctttggaatcgtccgcctaagagatgggctgcgagaccgctatcccgtggaagattatctggacctctttgacctggccgcacaccagatccatcaaggactgcaggccagctctgcaaaggagcagagcaagatgaatacaatcattatcggggaggccagtgcctccacgatgtgggataataatgcctggacgttcttctacgacaacagcacggatggcgagccaccgtttctgacgcaggacttcatccacgcctttcagccaaatgccagactgattgtcatgctcagggaccctgtggagaggttgtactcagactatctctactttgcaagttcgaataaatccgcggacgacttccatgagaaagtgacagaagcactgcagctgtttgaaaattgcatgcttgattattcactgcgcgcctgcgtctacaacaacaccctcaacaacgccatgcctgtgtgtaccccccccccccgtaccccccgagctggcccctggcagaaggagctggtttgttgttattatgcaagcggcattgtgggtttgcgtttcagcataggaacagagagaagcgttttaatgtgcaaatgctgttccccattattcatggatgtaaaagctgaaaactga

SEQ ID NO: 4529 - DNA, 1566 bp, Homo sapiens
aaacttttcctcccagcgctcggggagtcaggttgacgcgccctggatgcggggctagaggctcggggctgggcgcgctcccgcggagccggagccgcagaggctcccgggctggactcaggcttctcaggaaatctggcattttttaaagtttgcgccccacaaagaggaaatattccaaaggtactcaggatgtaaaaggggagatcttcacagatgcctccgtggatggcatggcaatccatccatcaatgagaagaccatgatttcttttaattttctgtgtgtttccacattccccagtgagaattcttccacctttttttgtgccatgggaaaaacctgaagggcaggcagagctgctcccgaacttgtgaccttctctgaggttgcagcggctcttgtagaacatgactctgggacatcacttccttttgttttctttcggagctgaaccaaagaatgtgcaccctctttctctagtgctgtggtgtctgcttatttttgtatttgtgctttccatccatcttctgtgatcacaaggcattcttaaggttttctagcacgacttgcggacatccagactcgtggggggcccacccatggctcggtaagccagcagcccagggcactggcactaccatgaggcactgcattaattgctgcatacagctgttacccgacggcgcacacaagcagcaggtcaactgccaagggggcccccatcacggtcaccaggcgtgccccacgtgcaaaggagaaaacaaaattctgtttcgtgtggacagtaagcagatgaacttgcttgctgttctcgaagtgaggactgaagggaacgaaaactggggtgggtttttgcgcttcaaaaaggggaagcgatgtagcctcgtttttggactgataataatgaccttggtaatggcttcttacatcctttctggggcccaccaagagcttctgatctcatcacctttccattacggaggcttccccagcaaccccagcttgatggacagcgaaaacccaagtgacacaaaggagcatcaccaccaatcctctgtaaataatatttcatacatgaaggactatccaagcattaaattaattatcaacagcatcacaactaggattgagttcacgaccagacagctcccagacttagaagaccttaagaagcaggagttgcatatgttttcagtcatccccaacaaattccttccaaaacacaatgcacaagctgaacttgggctgaacgtggcgtgttgagatttggaatgaggtttctaagagccgtgttcttcatggaattttccaggccacttggcagcttggtttaccgatggatgggctagagatcttgtcgtttcttggaagtcacagggaagattgaagagaacgcttgagcatccttggcaacagcccaggtgggacctggatgaagctttgcactcaagtattgtcaagggaagcttcctgtgaaccaaagttctcaggccaaggtctcgcccaccaaagccagaaagtgcaagcacccgtctacccagctctaacttgtatgtgtgagac

SEQ ID NO: 4530 - DNA, 4678 bp, Homo sapiens
ggaaatctggcattttttaaagtttgcgccccacaaagaggaaatattccaaaggtactcaggatgtaaaaggggagatcttcacagatgcctccgtggatggcatggcaatccatccatcaatgagaagaccatgatttcttttaattttctgtgtgtttccacattccccagtgagaattcttccacctttttttgtgccatgggaaaaacctgaagggcaggcagagctgctcccgaacttgtgaccttctctgaggttgcagcggctcttgtagaacatgactctgggacatcacttccttttgttttctttcggagctgaaccaaagaatgtgcaccctctttctctagtgctgtggtgtctgcttatttttgtatttgtgctttccatccatcttctgtgatcacaaggcattcttaaggttttctagcacgacttgcggacatccagactcgtggggggcccacccatggctcggtaagccagcagcccagggcactggcactaccatgaggcactgcattaattgctgcatacagctgttacccgacggcgcacacaagcagcaggtcaactgccaagggggcccccatcacggtcaccaggcgtgccccacgtgcaaaggagaaaacaaaattctgtttcgtgtggacagtaagcagatgaacttgcttgctgttctcgaagtgaggactgaagggaacgaaaactggggtgggtttttgcgcttcaaaaaggggaagcgatgtagcctcgtttttggactgataataatgaccttggtaatggcttcttacatcctttctggggcccaccaagagcttctgatctcatcacctttccattacggaggcttccccagcaaccccagcttgatggacagcgaaaacccaagtgacacaaaggagcatcaccaccaatcctctgtaaataatatttcatacatgaaggactatccaagcattaaattaattatcaacagcatcacaactaggattgagttcacgaccagacagctcccagacttagaagaccttaagaagcaggagttgcatatgttttcagtcatccccaacaaattccttccaaacagtaagagcccctgttggtacgaggagttctcggggcagaacaccaccgacccctacctcaccaactcctacgtgctctactccaagcgcttccgctccaccttcgacgccctgcgcaaggccttctggggccacctggcgcacgcgcacgggaagcacttccgcctgcgctgcctgccgcacttctacatcatagggcagcccaagtgcgggaccacagacctctatgaccgcctgcggctgcaccctgaggtcaagttctccgccatcaaggagccacactggtggacccggaagcgctttggaatcgtccgcctaagagatgggctgcgagaccgctatcccgtggaagattatctggacctctttgacctggccgcacaccagatccatcaaggactgcaggccagctctgcaaaggagcagagcaagatgaatacaatcattatcggggaggccagtgcctccacgatgtgggataataatgcctggacgttcttctacgacaacagcacggatggcgagccaccgtttctgacgcaggacttcatccacgcctttcagccaaatgccagactgattgtcatgctcagggaccctgtggagaggttgtactcagactatctctactttgcaagttcgaataaatccgcggacgacttccatgagaaagtgacagaagcactgcagctgtttgaaaattgcatgcttgattattcactgcgcgcctgcgtctacaacaacaccctcaacaacgccatgcctgtgaggctccaggttgggctctatgctgtgtaccttctggactggctcagcgtttttgacaagcaacagtttctcattcttcgcctggaagatcatgcatccaacgtcaagtacaccatgcacaaggtcttccagtttctgaacctagggcccttaagtgagaagcaggaggctttgatgaccaagagccccgcatccaatgcacggcgtcccgaggaccggaacctggggcccatgtggcccatcacacagaagattctgcgggatttctacaggcccttcaacgctaggctggcgcaggtcctcgcggatgaggcgtttgcgtggaagacgacgtgagagctgaattgttgctgcacgtgctgggcccgccaatgccgtcatcatcaggattttacaaatctctttgcggggaactgtttcactcatggtatggaaaaccccaggactctgccactctaggcacacatgaattataaccattttggaatttccttcgtgatgttcgagagctcagcaatggacccctcacagagctcctctatccgaggccattggagaccccagtttctcaagaattcagctctgctctgagcgtcctggagcttggggatgcagccagctggcctgcactgggtgtggagagaacacctagggaaggcagcctggccctgcccgcctccgccttctggagagcctctgggttctgagtcagcaagccagaggtcatgccacaggcctggctggaacttacacttcacgttccctttttttccccctagagatggggtctcgccgtgttgcacagactgtctgtattcaatggctatcttcacaggtgtgatcataccacattcacttctgaaacactcttgttgcgatcgctaacctcactgggacagagaaccgcagtctttcgagaatggaggctcttcattttttttttctcctttactccaaactcagccctccagtttcttcagatgtaaaccctgttaacgtcactgtttccaaaaggaaaaaaataagtcagtttttggcagcaccttcatctttctgacctcctcctattctgtccttgtggacttatgtttaacatagaaaatgaatgcgtttaaaacaaaaccactttctgcatttaaccagtcctggctctctctctgctgcctcttcatacgttttctcaagaacttcagtttataattggaagagaaatttttgctgttaatgccagaatgagcaacctcaaggaattgaacacttcttggaaaatctaggtaattcaagccctcatcaggtttacaagatcatcagagaaacagaggattttaatttttagttctggccggctacaggctccatttctctgccttcccattggaaatagtttatttccacattctccactgcgtgtggtcaaagttcctcacccagcaagggactatagatactcgtgtcccaattccaaaacacaatgcacaagctgaacttgggctgaacgtggcgtgttgagatttggaatgaggtttctaagagccgtgttcttcatggaattttccaggccacttggcagcttggtttaccgatggatgggctagagatcttgtcgtttcttggaagtcacagggaagattgaagagaacgcttgagcatccttggcaacagcccaggtgggacctggatgaagctttgcactcaagtattgtcaagggaagcttcctgtgaaccaaagttctcaggccaaggtctcgcccaccaaagccagaaagtgcaagcacccgtctacccagctctaacttgtatgtgtgagacagaccaggcttcgggggtaggaggatctgcagttgttcagccgtctttctgctggtgttgtctttctgccatcagagaagggacacacagcccgttcgaaggtgtgcagagggctctgagcgccaggatggccagggctgtttttgctactgaaggagcgtgtgtcctgaactcccacttgcagggacagtccccaccttctctatagccggcactgggagcagccgccagcagggaaatctggcctgagcacaaggatgctttagggagagatcacttcagtgtgtgtgtatatttatttgcagtacagtgcgcgcgtgtgtgtgtgtgtacgcgcacgtgtgggtgagtgcgtcttctgagtgggttctgttcagttgctaatgaggctcctccgctctggacacaacccttttatagattaatttctctgccaattaacttgtcattttcagtacatattttactattccacaccaaccataattacaacaagggatttttcttatgcactcctatgcatgtgaataacatgtggtgtaattctgcttcttacagaagtattactgaaggtattatttccaatattatttggtttattatgcggatcttttttatatatgcagtcccatcccttctgtgccactcaatgccatccagacatggtttttccctccaggggcctttctctccagagggcacttcggctgcctctgcttcctctcattcgaggcccggctcttgctgacagaataggttccgttctgggcggtggttctcgagcctgccattcaaaaccaaagcaaattggagcatttctcacaacatggtattgaagttcctttttgttctcaaaagttgtgaccgtgttaaattgtactcccttagtcctgtaaggtatgttaagtgaatcgcagttacgctgtacttttattaatatttaacataattaaagatggacccataagagtgacgcctgtggagcgcgtgctcttcctctgcagcc

SEQ ID NO: 4531 - DNA, 2289 bp, Homo sapiens
gactcgggagttgccggcgcttcccggcggtggcggcgtctctggccggccttggtgcggcgagccgagcgaggcagctctgagccgcgcggaaatctggcattttttaaagtttgcgccccacaaagaggaaatattccaaaggtactcaggatgtaaaaggggagatcttcacagatgcctccgtggatggcatggcaatccatccatcaatgagaagaccatgatttcttttaattttctgtgtgtttccacattccccagtgagaattcttccacctttttttgtgccatgggaaaaacctgaagggcaggcagagctgctcccgaacttgtgaccttctctgaggttgcagcggctcttgtagaacatgactctgggacatcacttccttttgttttctttcggagctgaaccaaagaatgtgcaccctctttctctagtgctgtggtgtctgcttatttttgtatttgtgctttccatccatcttctgtgatcacaaggcattcttaaggttttctagcacgacttgcggacatccagactcgtggggggcccacccatggctcggtaagccagcagcccagggcactggcactaccatgaggcactgcattaattgctgcatacagctgttacccgacggcgcacacaagcagcaggtcaactgccaagggggcccccatcacggtcaccaggcgtgccccacgtgcaaaggagaaaacaaaattctgtttcgtgtggacagtaagcagatgaacttgcttgctgttctcgaagtgaggactgaagggaacgaaaactggggtgggtttttgcgcttcaaaaaggggaagcgatgtagcctcgtttttggactgataataatgaccttggtaatggcttcttacatcctttctggggcccaccaagagcttctgatctcatcacctttccattacggaggcttccccagcaaccccagcttgatggacagcgaaaacccaagtgacacaaaggagcatcaccaccaatcctctgtaaataatatttcatacatgaaggactatccaagcattaaattaattatcaacagcatcacaactaggattgagttcacgaccagacagctcccagacttagaagaccttaagaagcaggagttgcatatgttttcagtcatccccaacaaattccttccaaacagtaagagcccctgttggtacgaggagttctcggggcagaacaccaccgacccctacctcaccaactcctacgtgctctactccaagcgcttccgctccaccttcgacgccctgcgcaaggccttctggggccacctggcgcacgcgcacgggaagcacttccgcctgcgctgcctgccgcacttctacatcatagggcagcccaagtgcgggaccacagacctctatgaccgcctgcggctgcaccctgaggtcaagttctccgccatcaaggagccacactggtggacccggaagcgctttggaatcgtccgcctaagagatgggctgcgagaccgctatcccgtggaagattatctggacctctttgacctggccgcacaccagatccatcaaggactgcaggccagctctgcaaaggagcagagcaagatgaatacaatcattatcggggaggccagtgcctccacgatgtgggataataatgcctggacgttcttctacgacaacagcacggatggcgagccaccgtttctgacgcaggacttcatccacgcctttcagccaaatgccagactgattgtcatgctcagggaccctgtggagaggttgtactcagactatctctactttgcaagttcgaataaatccgcggacgacttccatgagaaagtgacagaagcactgcagctgtttgaaaattgcatgcttgattattcactgcgcgcctgcgtctacaacaacaccctcaacaacgccatgcctgtgtgtacccccccccccgtaccccccgagctggcccctggcagaaggagctggtttgttgttattatgcaagcggcattgtgggtttgcgtttcagcataggaacagagagaagcgttttaatgtgcaaatgctgttccccattattcatggatgtaaaagctgaaaactgatgggctcttggtctggctcctgccttcctccctgctggtcacctgccacctccccctcctccctcagcaggaggatgagggtgcctttaggaagattaccatttagcaagacacccagcaattagaatcggcagacatgaggacacccaactctcaaattgtctta

SEQ ID NO: 4532 - DNA, 3248 bp, Homo sapiens
ctctggctgctgctccagctctggcagacacgccaagctttgagaaagctcccagtgaggaactggtcttctggagactctgtgtggcatagagtgattcaaccaccttaagaagacctctggctttcctggaacacagatgtcgagacatctcccatggatttgtgatcagcgttgcagctctcccagcagccctggacggtggtgagtcccctcagctggccaggacagtactctgctctcacctctctgcttcttgggctccatcccagctccccatcaactgatcttcttgcaaacccacagggctccaggacaccctccttctggagcccatgctgcctacagcacttcactccccaccagtgatgacaacagttgctgttctttgtccactttatttacttgtttatctttaatgacaaaagttttttttttgttgtttttttttttttttttgaaacggagtctcactcttcactcaggctgcagtgcagtggcgcaatctcagctcactgccacctctgcctcccaggttcacgccattctcctgcctcagcctcccgagtagctgggactacaggcgcccaccatcacgcctggctaattttttgtatttttagtagagatggggtctcactgtgttagccaggatggtctcgatctcctgacctcgtgatccgcccgcctcggcctcccataatgctgggattacaggcgtgagccaccgcgcctggctgacaaaagttttatacctgcctgttaaaaaaattatataatacagaagcacaccttgtaaaaggtgcaatcctcagttatgggcatgactgcgtgttcccttcccccatcttcattataataaccccccaatccccccagatcctgtgagccaggtaccggaattatccctctttcacacacgggtaaagtgatccgtcacagagagatttaagtgatcttcataagcaagatcataggctaggaagtggcagagccaggattcaacctcggcgagcctggtggtgctctgacatccaccgaagcccccatcaagcccttttagctccacaacctaaaagggtctctctaagaggtatcctgaagcaaaagacaggagttctctttgaaacatagtatttctctctacagatagatagcctgtaggtatgtaagtaggtgggtgggtgggtaggtagacagtttgatgatatcccacattattctgcaactggacttctgctgtgagcacagactatattctggcctatgtcttgactccgtattcctgggaaagtgctcgactgagaccttgggagtcttgggaagtccaatgggtagggtagccgaatctgagggctgatccctgagggcactgggcagtaattggggcatgggatgggcatgagggcccgggtccctaaagttgcccactccacccgaaggcccccagccgcccgcatgtggctgccacggttctccagcaagacagtgacagtgctcctcctggcacagaccacctgcctcctgctcttcatcatctcccggccagggccctcatccccagccggcggcgaggatcgtgtgcacgtgctggtgctgtcctcgtggcgctcgggctcatccttcttgggccagctcttcagccagcaccccgacgtcttctacctgatggagcccgcgtggcatgtgtggaccaccctgtcgcagggcagcgcggcaacgctgcacatggccgtgcgcgacctgatgcgctctatctttttgtgcgacatggacgtgtttgatgcctacatgccacagagccgaaacctgtccgcctttttcaactgggcaacgagccgcgcgctgtgctcgccgcccgcctgcagcgcctttccccgaggcaccatcagcaagcaggacgtatgcaagacactgtgcacgcggcagccattcagcctggcccgggaggcctgccgctcctacagccacgtggtgctcaaggaggtgcgcttcttcaacctgcaggtgctctacccgctgctcagcgaccccgcgctcaacctgcgcatcgtgcacctggtgcgcgacccgcgggccgtgctgcgctcccgggaggcggcgggcccgatactggcacgcgacaacggcatcgtgctgggcaccaacggcaagtgggtggaggccgaccctcacctgcgcctgattcgcgaggtgtgccgcagccacgtgcgcatcgccgaggccgccacactcaagccgccacccttcctgcgcggccgctaccgcctggtgcgcttcgaggacctggcgcgggagccgctggcagagatccgcgcactctacgccttcaccggcctgaccctcacgccacagctcgaggcctggatccacaacatcacccacgggtcggggatcggcaagccaatcgaggccttccatacttcgtctaggaatgcgcgcaacgtctcccaggcctggcgccacgcgttgcccttcactaagatcctgcgcgtgcaggaggtgtgcgccggcgcgctgcagctgctgggctaccggcctgtgtactctgcggaccagcagcgtgacctcaccctggatctggtgctgccacgaggcccagaccacttcagctgggcatcgcctgactgagaactctgggccttagagcaggccccgaactgtggtcgccaggcccaggaggcgactgcatggtggagagggagctggggcgcatggggaagcaggtccctactatcaaccgggagtttggggtcctcccctgaagtaggcaaggactgcacgtttctttctctcctgattctcggttttcctttgagtcttctggagctgccttctcatcaggtgcactcttcatggaaagcaactcttgcccctacctcttctgggcgcagggagtaagttactgctaaattaaattaaatgtgtgccaggccgggtgcggtggctcatgcctgtaatcccagcattttgagaggctgaggcgggtggatcacctgaggtcaggagttcgaaaccagcctggccaacatagtgaaaccccctctctactaaaaatgcaaaaattagtccggcgtggtggcacactcctgtaatcccagctacttaggaggctgaggtgggagaatcacttggactccagaggtggaggttgcagtaagctgagatcatgccactgcaccctagcttgggtggcagagcaagactctatcaaaaaaataagtaataaatttgttcaaaagtcctgc

SEQ ID NO: 4533 - DNA, 1254 bp, Homo sapiens
atgtcgagacatctcccatggatttgtgatcagcgttgcagctctcccagcagccctggacggtggcccccagccgcccgcatgtggctgccacggttctccagcaagacagtgacagtgctcctcctggcacagaccacctgcctcctgctcttcatcatctcccggccagggccctcatccccagccggcggcgaggatcgtgtgcacgtgctggtgctgtcctcgtggcgctcgggctcatccttcttgggccagctcttcagccagcaccccgacgtcttctacctgatggagcccgcgtggcatgtgtggaccaccctgtcgcagggcagcgcggcaacgctgcacatggccgtgcgcgacctgatgcgctctatctttttgtgcgacatggacgtgtttgatgcctacatgccacagagccgaaacctgtccgcctttttcaactgggcaacgagccgcgcgctgtgctcgccgcccgcctgcagcgcctttccccgaggcaccatcagcaagcaggacgtatgcaagacactgtgcacgcggcagccattcagcctggcccgggaggcctgccgctcctacagccacgtggtgctcaaggaggtgcgcttcttcaacctgcaggtgctctacccgctgctcagcgaccccgcgctcaacctgcgcatcgtgcacctggtgcgcgacccgcgggccgtgctgcgctcccgggaggcggcgggcccgatactggcacgcgacaacggcatcgtgctgggcaccaacggcaagtgggtggaggccgaccctcacctgcgcctgattcgcgaggtgtgccgcagccacgtgcgcatcgccgaggccgccacactcaagccgccacccttcctgcgcggccgctaccgcctggtgcgcttcgaggacctggcgcgggagccgctggcagagatccgcgcactctacgccttcaccggcctgaccctcacgccacagctcgaggcctggatccacaacatcacccacgggtcggggatcggcaagccaatcgaggccttccatacttcgtctaggaatgcgcgcaacgtctcccaggcctggcgccacgcgttgcccttcactaagatcctgcgcgtgcaggaggtgtgcgccggcgcgctgcagctgctgggctaccggcctgtgtactctgcggaccagcagcgtgacctcaccctggatctggtgctgccacgaggcccagaccacttcagctgggcatcgcctgactga

SEQ ID NO: 4534 - DNA, 6885 bp, Homo sapiens
gacgacgtttgggagcctttgctgagtccagggagagaggcgtcccccaccgtgccgctgcagctcgggcagagccgccaagctttggggtgctgaggaacctctaatcatctcccatggatttgtgatcagcgttgcagctctcccagcagccctggacagtggcccccagcagtcagcatgtggctgccgcgcgtctccagcacagcagtgaccgcgctcctcctggcgcagaccttcctcctcctctttctggtttcccggccagggccctcgtccccagcaggcggcgaggcgcgcgtgcatgtgctggtgctgtcctcgtggcgctcgggctcgtccttcgtgggccaactcttcaaccagcaccccgacgtcttctacctaatggagcccgcgtggcacgtgtggaccaccctgtcgcagggcagcgccgcaacgctgcacatggctgtgcgcgacctggtgcgctccgtcttcctgtgcgacatggacgtgtttgatgcctatctgccttggcgccgcaacctgtccgacctcttccagtgggccgtgagccgtgcactgtgctcgccacccgcctgcagtgcctttccccgaggcgccatcagcagcgaggccgtgtgcaagccactgtgcgcgcggcagtccttcaccctggcccgggaggcctgccgctcctacagccacgtggtgctcaaggaggtgcgcttcttcaacctgcaggtgctctacccgctgctcagcgaccccgcgctcaacctacgcatcgtgcacctggtgcgcgacccgcgggccgtgctgcgctcccgggagcagacagccaaggctctggcgcgtgacaacggcatcgtgctgggcaccaacggcacgtgggtggaggccgaccccggcctgcgcgtggtgcgcgaggtgtgccgtagccacgtacgcatcgccgaggccgccacactcaagccgccaccctttctgcgcggccgctaccgcctggtgcgcttcgaggacctggcgcgggagccgctggcagaaatccgtgcgctctacgccttcactgggctcagtctcacgccacagctcgaggcctggatccataacatcacccacggatctggacctggtgcgcgccgcgaagccttcaagacttcgtccaggaatgcgctcaacgtctcccaggcctggcgccatgcgctgccctttgccaagatccgccgcgtgcaggaactgtgcgctggtgcgctgcagctgctgggctaccggcctgtgtactctgaggacgagcagcgcaacctcgcccttgatctggtgctgccacgaggcctgaacggcttcacttgggcatcatccaccgcctcgcacccccgaaattagtggaggccacagttgtagcaggcgctaggcccgggaggagagtgcatggtgcagagggggctggggcgcacggagaagcaggtccctatattgaccaaggagtttgtggtacgacccctccccctccccaagtaggcaaggactgcacgtttctttctctcttgattcttggttttcctttgagtcctctggagctgccttctcatcaggtgcactcttcatggaaagcaactcttgcccctcctcctctgggcacagggtgtgcgttcagatgacttggctcctactcaagggctttcttcccctttaactctctccttctggtgacacatcctgcagcagctgagggggtgccctggcactggctgggagtggagaggcactgtggtgaaatggctccagaggtctgtacatcacatacatatgcacacaggcacacatggcaaaactcggaagtgaaaggacttgtctgaaatcacatggtgagaaggaggatgaagggaggagagagcttttgctctgggtctccagtggataggagaggacctgcctcctgggtgagaagggtcagattttcctattttaattgctttagggaagagcaagcagagtcatgaccagggacacagctgagagatagaggaggctgtgaatgctgagaccagagtttatcatgctggacaagcctggaaggaggcaataagtgggaaaggtaggaggagagaaggctggggagggctgggcagcaagccaggcacagtgagtggcagagcaagagggggaaagcaggatcagtgcctggaaggcaggtgtgcccgtcagcggggagtggaactcatcaggcttgccaagaggttggaagggaaatggctctgggctggaactgtcttcccttggtccttctggtccaggccttggaggaaagcagaggatgatccctgcctgtgagccacacctcctagctctgggggcaaaggggcttagtaaaggaatgctggatgtgtagagggtttagtcccgagctcaggaaatgagagcctataagtgcccagtacatgtttaaaagaagagctcatggaacctctggaaaggacagggaagttgagttagccacataaatgaacccaagtcacattggaacacagagctggtctgggaactgtgttggctgccaacagaacttctgaccctgttacctgtgaaatgaggcagtttccctcacgttgccatcagctaccaggagcgatgctggtggtcactagcttctgatcctcatcctgggtgtggccacagattgggggaacctggattgtggagtcacatcctccctgcaaagcaagcagggcaagggagatctggcattttctgctttacgtggagggagaacaggcacattagccttgaagctgaagctcattttaggttccttccaggtttagaagcttcaaccaaatgaaacttgaatctgtccctcgtgacaattataggaggaaggtatttaaaaccccagatttatgaatgtgtactacatggcttagagaatgtctttgttcttgttcaggtggttataacaaaataccttaagagtgggtaacttggctggatgcagtggctcatgcctgtaatcccagcactgtgggaggccgagggggatgaatcacctgaggtcaggcattcaagaacagcctggccaacatggcgaagcccctcctctactaaaaatacaaaattagcgaggcatggtcgcacatacctgtaatcccagctcctcgggaagctgaggcaggagaatcgcttgaacccaggaggcggaggttgcagtgagccaagatcacgccattgcactccagcctgggtgacagagcaagactccatctcaaaaaaaaaaaaaagactgggtaacttataaacaaatgttcttctcacaagtctggagactgggaagtccaagatcaagccaccagtgctgtctgatgagggcccactttttcaaagacagtgccttctagctgtgtcctcttatcgtagaagatgggagacagctctccagggccatttttttttttttttttttttttttgagatggagtctggctctgtcgcccaggctggagtgcagtggcacaatctcggctcactgcaacctctgcctctctctgcctcctgagttcaagcaattctcctgcctcagcctcctgaggagctgggactacagggatgcaccaccatgcccagctaatttttgtatttttgtagacactgggtttcaccatattggccaggttggtctcaaactcctgacctcaagtgatctgcccacctcagcctcccaaagtgctgagattacaggcatgagccactgtacccagtctccagggccttttaaagaatgtcactaatcccattcttgaggtctccaccttcattatctaatcacctcccaaaggctccacatcccaacaccatcatattgtgggttaagatttcaaccacaagccaggcgtggtggctcatgcctgtaatcccagcattttggaaggctgaggcaggtggatcacttgaggtcaggagtttgagaccagcctggccaacatggtgaaaccccatctctactaaaaataaaaaaaattagccgggtgtggtggtgcacacctgtaattccagctactcaggaggctgaggcaggagaatcccttgaatccaggaggcggacagtgcagtgagccgagataatgccactgcactccagcctggatgacagagcaagactccatctcatgcccagccagcatgcccaacaagcttcatttgcccctgtttaggtcacaaattttattgatggctgcaattaatggcctcttggtatccaagtcctttgttgtatgacccatccattctcccctgactcccaaggtgtcaggacatgcttgactggctcctgaatttgctctctgcgcatgggcagtacagtcaagcctcacagtgaacccaggtcagctttcaggacaaagaaagtggcctggctgactaggcacagtaaagccagggctgggtaggtacatacttgtgctgatcacgtatgtcttatatctctgtgagagtgcagtcccaacaggaaggtttaatcactggggactgcccaatgctgtgacagggcacagagctctgggttgctgtgggggtgactgcattgaccactgttagtggtttgctgtgttgacactctgtgctgtgtgaccatggctcctgccatcaagaagtagagtctgtttctccacctctgaatccaggctggtcctgtgacttgctttgtcctgtagacaagtgtagtgcaacttcctgtgagccagtttgaagcataggccttggaagcaaaactttacctccacctgtcttaggttttcagctggggctctgctgtgatttgattgtgtctcccaaagttggaaccttgatccccagtgttgtgaggtgaggcttgatggaaagtaaattacgccgtgcgggttatgcccttgtgaatgggtagagaacattatttctgggcgcaggcatggtagctcatgtctgtaatcccagcattttgggaggttgaggtgtgcggattacttgaggtcaggagtttgagaccagcctggccaacaaggtaaaacaccatttctagttaaaatacaaaaattagccaggtgtggtggcacatgcctgtaaggccagctacttgggaggctgagacaggagaatcgcttgaacccaggaggcagagattgcagtgagctgagatcgcaccactgtactccagcctgggcaacaaagcgagagtctgtcttaaaaaaaaccaccattatttcaggagtgagttggttatcctgagagtggtgccttttaaatgaaggagttcattctttgtctttctctcgccctcactttgcccttctgccatatgatgccttccatcatgctaggacacagcaagaaggctctcgctagatgctggctccttgatcttgggcttcccagcctccagaactgtaagccaatacacttctatttattatatatgacccttgctgggttcagtggctcacgcctgtaatcccaatactttgcaaggctgaggcaggaggatcacttgagaccaggcactcaagaccagcctgggcaacatagtgagaccccatctctacaaagttaaaaaaaaattagcagggcatggtgtcgtgcacctgtagtcctagctacttgggaggctgagttgggaggactgcttgaccctgggaggttgaggctacattgaaccatgatcatgccagtgcactccagcctgagtgacagagcaagacacctatctctaaataaatgaccccatctgtggtattgttatagcaaaacaaaacagattaagagagactttttaatgaaaagacagattcacaaagaaaaacaatgtttttgtttctgtttttttgaggcagagtcttgctcttgtcccccaggctggagtgcagtggcgccatcttggctcactgcaacctccgcctcccagtttcaagcgattctcctgcctcagcctcccgagtagctgggattacagatgtacaccaccacgcccggctaattttttttgtatttttagtagagatggggtttcaccatgtcgatcaggctgggctggaactcctgacctcaggtgatccacctgccttggcctcccaatgtgctaggattacaggcatgagccactgtacctggcgaaaaacagtttgttaacacaggcagccaacatcactcaggataagcctcaatgaaaagtaacaaagtgatggcttggaacactgtcttacacagcatttttaaaaaatacaataaatttgtagagataggatgaccaaggacaacagttttaggcttccaaaggtggtaaactatgggatggtaaatatccgagaggaagctgatgcaacaggatttgtctgcagcagcctctggtaccacctctgagtcaagggttgtgtccagtgatggagagtttatatcgtgcctttaggcagaaaaggggagggaaacctgaacttttcctgcactttctgcttcttaattgccttcagctgaaaatcattttttatgtgaaaaaggcatagtctgagctgacgcctctgctttcctccacctgaagagaacctgcgtgctgctcctttgcttcggacctccgcctctgcccgggagaaagcccaggccagcctgctggacaagcagagaccatgagaaggagagttcaggggtcccaaaccaggccatcctagaccagccagctccagctgatccgcacgcagccacttcggctaccttctactggccaaagggagtcccagggctcacccagattcagaggtggggaaactgagtccaccacttgagaagagtagctataaagacatatgagcgaggccagctgagcccagcactgcggccaagtcgaagactttaggagcaataaaagtgcttattgtgtttcagtca

SEQ ID NO: 4535 - DNA, 2093 bp, Homo sapiens
caccgggcagcgccgagggttgccggccggcgcgcggggagtagagggcgcgggccgcagtgccgggttccagagggagctctgcgccgggtccttccctgtggtagccccaggacacccccagcctcaacatcccattctgggactcctgccctgttcccacattcgttctacctcgagtctccaggagcttccagtggcttggtcaccgccaactctcgtccatgcctcttagagcccctttcccggcctcaccgggtgtcgcttaatagtcttgggaccttaaggagcaagtcagcccctgcggaccctcccagtgaagagaaagagctggctgtgcggtggaatttggaagagacgacgtttgggagcctttgctgagtccagggagagaggcgtcccccaccgtgccgctgcagctcgggcagagccgccaagctttgggttctctagggtgtgtacccaggagtggatctgctgtatcatatggtcactctattcaacctttcgagaaaccaccaaattgtttcttcaggaaatgcaccatctgacatccccattttatgaggatccccacgtctctgtcatctcaccaacacttgtgctgaggaacctctaatcatctcccatggatttgtgatcagcgttgcagctctcccagcagccctggacagtggcccccagcagtcagcatgtggctgccgcgcgtctccagcacagcagtgaccgcgctcctcctggcgcagaccttcctcctcctctttctggtttcccggccagggccctcgtccccagcaggcggcgaggcgcgcgtgcatgtgctggtgctgtcctcgtggcgctcgggctcgtccttcgtgggccaactcttcaaccagcaccccgacgtcttctacctaatggagcccgcgtggcacgtgtggaccaccctgtcgcagggcagcgccgcaacgctgcacatggctgtgcgcgacctggtgcgctccgtcttcctgtgcgacatggacgtgtttgatgcctatctgccttggcgccgcaacctgtccgacctcttccagtgggccgtgagccgtgcactgtgctcgccacccgcctgcagtgcctttccccgaggcgccatcagcagcgaggccgtgtgcaagccactgtgcgcgcggcagtccttcaccctggcccgggaggcctgccgctcctacagccacgtggtgctcaaggaggtgcgcttcttcaacctgcaggtgctctacccgctgctcagcgaccccgcgctcaacctacgcatcgtgcacctggtgcgcgacccgcgggccgtgctgcgctcccgggagcagacagccaaggctctggcgcgtgacaacggcatcgtgctgggcaccaacggcacgtgggtggaggccgaccccggcctgcgcgtggtgcgcgaggtgtgccgtagccacgtacgcatcgccgaggccgccacactcaagccgccaccctttctgcgcggccgctaccgcctggtgcgcttcgaggacctggcgcgggagccgctggcagaaatccgtgcgctctacgccttcactgggctcagtctcacgccacagctcgaggcctggatccataacatcacccacggatctggacctggtgcgcgccgcgaagccttcaagacttcgtccaggaatgcgctcaacgtctcccaggcctggcgccatgcgctgccctttgccaagatccgccgcgtgcaggaactgtgcgctggtgcgctgcagctgctgggctaccggcctgtgtactctgaggacgagcagcgcaacctcgcccttgatctggtgctgccacgaggcctgaacggcttcacttgggcatcatccaccgcctcgcacccccgaaattagtggaggccacagttgtagcaggcgctaggcccgggaggagagtgcatggtgcagagggggctggggcgcacggagaagcaggtccctatattgaccaaggagtttgtggtacgacccctccccctccccaagtaggcaaggactgcacgtttctttctctcttgattcttggttttcctttgagtcctctggagctgccttctcatcaggtgc

SEQ ID NO: 4536 - DNA, 2289 bp, Homo sapiens
aagtttccccttgtggatgcgcggccccgcggctctgctcctcccggcgcagaggggccgggagaggccacaggagcggacctggcacgggatttctgaggaacgggagaagactggcgcccgacccgctctggagggtcggtgaacgatgaagggccggcggcggcgacgccgagagtactgcaagttcgcgctgctgttggtgctgtacacgctggtgctgttgctcgtcccctccgtattggacggcggccgcgacggggacaagggcgccgagcactgccccggcctgcagcgcagcctgggagtgtggagcctggaggcggcggcggccggcgaacgcgagcagggagcggaggcgcgggccgccgaggaagggggcgcgaaccagtctcctcggttcccaagcaacctcagcggcgctgtcggggaggcagtgtctcgcgagaagcagcacatctacgtgcatgccacctggcgcaccggctcgtccttcctgggcgaactctttaaccagcacccggacgttttctacttgtatgagcccatgtggcatctatggcaggcgctgtatccgggcgacgccgagagcttgcagggcgcgctgcgcgacatgctgcgttcgctcttccgctgcgacttctccgtgctgcggctgtacgcgccgccgggggaccccgctgcgcgcgccccggacacggccaatcttaccacggccgccctcttccgctggcggactaacaaggtcatctgctcgccgccactgtgtcctggcgcaccccgtgcccgggccgaggtgggcctcgtcgaggacaccgcctgcgagcgcagctgcccacccgtggcgatacgcgccctggaggccgagtgccgaaagtacccggtggtggtcatcaaggacgtgcgcctgctcgatctgggcgtgctggtgcccctgttgcgtgatccaggcctcaacctgaaggtggtgcagcttttccgcgacccgagggcggtgcacaactcgcgcctcaagtctaggcagggactgctgcgcgagagcatccaggtgctgcgcacccgccagaggggcgaccgcttccaccgtgtgctgctggcgcacggcgtgggtgctcgccccgggggccagtctcgcgcgctgcccgccgcgccgcgcgccgatttcttcctgaccggtgcgctcgaggtgatctgcgaagcctggctgcgcgatctgcttttcgcgcgcggcgcgcccgcctggctgcggcgccgctacctgaggctgcgctatgaggacctggtgcggcagccacgcgcccagctgcgccgcctgctgcgcttctccgggctacgcgcgctcgcagcgctcgatgccttcgcgctcaacatgactcgcggcgcggcctacggcgccgaccggcccttccacctgtcagcgcgcgacgcccgggaggcggtgcacgcctggcgcgagcgcctgagccgagagcaggtgcgccaggtggaggccgcctgcgctccagccatgcgtctgctcgcctaccctcgcagcggagaggagggcgacgcggagcagcccagggaaggggagacgccgctggagatggatgccgacggcgccacgtagcctcccatccctgtccccggcacggatccgggtcagtcaccacgaacaggggcactcggcatgctgccccagcactggagaagcagcgctgtgggggcaatctgtcacactctcagagtctgggacttgacttgctaccaacaactgctgtgcaattctgctgagcaggaatatcatgagctgttcaataatgacggacgcattggttgagatgaagtttccagtaaggaagtgacagtgcaatgtggatatttatggctgtaaaataggaagagctttagttcccaggctgaacctgccactgctggagccatttcaacaaggcatcctcacaacaaagaagagatgtgatttggtaccatttcacaccagcaggtgtctggacgaaaacatcaatgtgaataagggccaagtgcagtcctgtcttgattaaattacttaataatattattaaataataataggtctgggcagtattgtttttaacctgactcatccagctgtccttcaaatagctccgtctccctctacccagaactgatttttaaaaagaagtaatttttctccctgggctgggaaaaccctaatgaactgaaacacacttttactttaaaatttttctgtctggcgtttttgtaatcatactattaaatgactctggagtcatgttaatgacagga

SEQ ID NO: 4537 - DNA, 3526 bp, Homo sapiens
cgcagaggtgtcctcagtgcccggagaggttggcagtgtcggccccgagggaagcgtggagcggacggccgacaggggatttctgcccaaacttcatcaccaactctttctgagagcaaaaacatggggccgagtccggcagctgcacgcagaatccaactctctggcagctctcggcaccgacgagctccagatcccgcgttcgcatcccggcgctttgcgcgcagagctaagccttcggacccgtggactgcagcccccgcgcgtcgcggtaaagcgggtcgcgtctccagcccccgaggcgcagcgacggtgggagccggctcggcgttgggggcgggggcggggccggcgaagggggagggctgcgcggcggaggggaggagccgcggcgacagacggcggcgcgcaccaaccgggcgccggctggcaggagccgcgcagaggctggtccgagcgcgttgcgggcgcccggcgtaaggggagtcgggtagcagcatcctcctgggcgccgctttcgcgcggcggcggcggctgcggcggggtctttctttgcttaaatacctcgttggccagaagcgctggtaccgggggcgggttgggtcgggtcgggcagtgctgcacacctgggtttccttgcctagagctgtgtgttcggggtcctttggtccagtcggaggctgcggagcggcgggggttgcctgcgctgtccgcccgggcatcctcccggtgatggaagcagccgccgccgccgctgcggggtcgcgctgtgccccatccaccgctgccagagaggtgggaaaattcgccgcacggaggccgaaagcgagaggggctgcgccgctatgccgggagctgagtcccatataagccgcccccagccatcgcccccagccggcttcgttcccctgagcgagacaggaagctgcggtcccgagaaagcggaggagacgtcgctggagccgggaggcgccgggttcggcggagcgcggagcggggctctgggccgcgtgaaagtttttcttcccgagccgcagggcgcccgctgcccggaaactgcccagggataagtcggccgactccccagacccctcgaaggtgcggggacccccagcggaagcgagagggagcgaaatcgaggaacgagtgacagccggacagtccgccgggcggtgatccggggccgctcccgggcgcgccctcggctccaggtcctacccggagccgctgccatgggagagccagccttgggcgctggggaccagccgccgcgcccgcctcggagtcgcggcccgagtcccggcgccagcagccagcccgctgcgtccccttcccgggctgcagggctgcctccgccgcgccgccggcccggattgtgcctgtgatgagccgcagcccgcagcgagctctgcccccgggcgcgctccctcggctgctccaggctgcgcctgcagccgcgccgcgtgccctgctcccgcagtggccccggcgcccaggacgccgctggcccgcgtcccctctcggaatgaaggtgttccgtaggaaggcgctggtgttgtgcgcgggctatgcactgctgctggtgctcactatgctcaacctcctggactacaagtggcacaaggagccgctgcagcagtgcaaccccgatgggccgctgggtgccgcagcgggggcagccggaggcagctgggggcgcccagggccgcctccggccgggccgccccgtgctcatgcccgtttggacctccgcactccttaccgccctcccgctgccgccgtcggggcggctcctgcagccgcggcagggatggcgggggttgcggcccctccaggcaatggcactcggggcaccgggggcgtcggggacaagcggcagctggtgtacgtgttcaccacgtggcgctctggctcgtcgttcttcggcgagctattcaaccagaatcccgaggtgttctttctctacgagccagtgtggcatgtatggcaaaaactgtatccgggggacgccgtttccctgcagggggcagcgcgggacatgctgagcgctctttaccgctgcgacctctctgtcttccagttgtatagccccgcgggcagcggggggcgcaacctcaccacgctgggcatcttcggcgcagccaccaacaaggtggtgtgctcgtcaccactctgccccgcctaccgcaaggaggtcgtggggttggtggacgaccgcgtgtgcaagaagtgcccgccacagcgcctggcgcgtttcgaggaggagtgccgcaagtaccgcacactagtcataaagggtgtgcgcgtcttcgacgtggcggtcttggcgccactgctgcgagacccggccctggacctcaaggtcatccacttggtgcgtgatccccgcgcggtggcgagttcacggatccgctcgcgccacggcctcatccgtgagagcctacaggtggtgcgcagccgagacccgcgagctcaccgcatgcccttcttggaggccgcgggccacaagcttggcgccaagaaggagggcgtgggcggccccgcagactaccacgctctgggcgctatggaggtcatctgcaatagtatggctaagacgctgcagacagccctgcagccccctgactggctgcagggccactacctggtggtgcggtacgaggacctggtgggagaccccgtcaagacactacggagagtgtacgattttgtgggactgttggtgagccccgaaatggagcagtttgccctgaacatgaccagtggctcgggctcctcctccaagcctttcgtggtatctgcacgcaatgccacgcaggccgccaatgcctggcggaccgccctcaccttccagcagatcaaacaggtggaggagttttgctaccagcccatggccgtcctgggctatgagcgggtcaacagccctgaggaggtcaaagacctcagcaagaccctgcttcggaagccccgtctctaaaaggggttcccaggagacctgattccctgtggtgatacctataaagaggatcgtagtgtgtttaaataaacacagtccagactcaaacggaggaagcccacatattctattatagatatataaataatcacacacacacttgctgtcaatgttttgagtcagtgcatttcaaggaacagccacaaaatacacacccctaagaaaaggcaagacttgaacgttctgaccaggtgcccctcttcttctttgccttctcttgtcctctttctcctatttcttaccctgtcctccacctgccttccattttgaagtgggatgttaatgaaatcaagttccagtaacccaaatcttgtttacaaaatattcgtggtatctgtgaacatgttaagagtaatttggatgtgggggtgggggtggagaaaggggaagtggtccagaaacaaaaagccccattgggcatgataagccgaggaggcattcttctaaagcagacttttgtgtaaaaagcaaaggttacatgtgagtattaataaagaagataataaataa

SEQ ID NO: 4538 - DNA, 2837 bp, Homo sapiens
cggccggataggcgcgagggggccgcgtgaggcggtgccggcgttctggcccccaaagccggtctagcgcgccgggcgtcttccttacttccgctgccgccgccgccacatcccgggacccgacgggccgcggcgcggaggcctcggggcaaggtggggcgggcctcccgagctcccaggaccccgcgcgcttcgcccacaggcccggcgaagcccgacccgcgcggcgcccccagggccaggggaggagcctaaggacccggacgagcgccgctccagtaggtgacaagaggaaccaagaacctcagttcaggggaaacacagcaaggaaatgtgagccccaggctgcagaaggaagagtcagtgaatggctgcggtgtgacaacatgcaccaccagtggcttctgctggccgcatgcttttgggtgattttcatgttcatggtggctagcaagttcatcacgttgacctttaaagacccagatgtgtacagtgccaaacaggagtttctgttcctgacaaccatgccggaagtgaggaagttgccagaagagaagcacattcctgaggaactgaagccaactgggaaggagcttccagacagccagctcgttcagcccctggtctacatggagcgcctggaactcatcagaaacgtctgcagggatgatgccctgaagaatctctcgcacactcctgtctccaagtttgtcctggaccgaatatttgtctgtgacaagcacaagattcttttctgccagactcccaaagtgggcaacacccagtggaagaaagtgctgattgttctaaatggagcattttcttccattgaggagatccccgaaaacgtggtgcacgaccacgagaagaacggccttcctcggctctcttccttcagtgatgcagaaattcagaagcgattgaaaacatacttcaagttttttattgtaagagatcccttcgaaagacttatttctgcatttaaggataaatttgttcacaatccccggtttgagccttggtacaggcatgagattgctcctggcatcatcagaaaatacaggaggaaccggacagagacccgggggatccagtttgaagatttcgtgcgctacctcggcgatccgaaccacagatggctagaccttcagtttggggaccacatcattcactgggtgacgtatgtagagctctgtgctccctgtgagataatgtacagtgtgattggacaccacgagaccctggaggacgatgccccatacatcttaaaagaggctggcattgaccacctggtgtcatacccgactatccctccgggcattaccgtgtataacagaaccaaggtggagcactatttcctgggcatcagcaaacgagacatccgacgcctgtatgcccgtttcgaaggggactttaagctctttgggtaccagaaaccagactttttgctaaactaatgcataagacctatgaattcaaatatctttattagacctggggctaaccaggtgaagatctgagcccagaaatgacccttcctccaccacacccctcctttgaggacgcccggggtctcccacaggcctgtgagttgcctcggcatatgacgcagaaccccaactgttacaacttagtttggatgtaagatgctctgaggaccctgcccacacccctgcgtgcattaggatgtcgctggcctttgctcacctcagaggggagaaaaggctaaagatttgcagtttgacagcccagcagggaggaagcatcacacagcgttaggagccgtttccttcaggtgttaaggaaggggatgcccctgaggttctcctggctagtcagggtggcttcacccatcactggtgggttgcaggaacagcacccaggactctgaggagggacagagaagcaagggggctgctgaaatcgcagagacttttgcagcatcagatctgaggagtaaaacggcacctctggccttcatcttggtgctgcgacaattgtggaggcaaagcattctttctgtgactattttgttcctgtagacagtcagcgatggccagagggtggtgtggtgtccaggggtccatctttccagaatccatgcctgtgtaatgctggtccatgcttctgaacctgtgtctgccaagcgcctatttcattcagcacaagacatacgattttagaaggtgaggggaggggaggctttttctacctgagaaggggagtgtctttgagggccttaaaaggaccatggcccaggaatgggggcgctggttgggcttggagctcaggctgctgtggatcccggcgcatcagttctgacttgccttacctgggtggacagcagtgaatctccacctgtcttctccagggagctcccatgttggggctgaagacgagcaggggcaacctgccagcatcacagaattcagtgtagtttatacatttcgattcctttcatctcagcaaaatgggcactgccagagccatttctgatcacaccaccatcctggaccatgtgactggaaggtgggtaaccaagttcaccagcaataaaacccagcgcccaggtagcctccagcagtgcggcttcctggcaacaaggtaggccctggtgcagggcaagccgcagcgaccatttcagataccgtccacagccaggaccgctgagaactgggacagtttcctgggatgagtgccagcctgagcctgcatggtgccgccgagcccggggtggaggagggagccaggcttcgcttcaaggcggcctctaccttttctcagaatggtttcctgattgtgtcaatgtgaaagttaaataaaatttatgtgccaaa

SEQ ID NO: 4539 - DNA, 604 bp, Homo sapiens
tgggcccctctccccgccgcggggcgcacggaaaaaccggggaacccgcgggttttgtcctggcgagccacatcccgtgacaagaggaaccaagaacctcagttcaggggaaacacagcaaggaaatgtgagccccaggctgcagaaggaagagtcagtgaatggctgcggtgtgacaacatgcaccaccagtggcttctgctggccgcatgcttttgggtgattttcatgttcatggtggctagcaagttcatcacgttgacctttaaagacccagatgtgtacagtgccaaacaggagtttctgttcctgacaaccatgccggaagtgaggaagttgccagaagagaagcacattcctgaggaactgaagccaactgggaaggagcttccagacagccagctcgttcagcccctggtctacatggagcgcctggaactcatcagaaacgtctgcagggatgatgccctgaagaatctctcgcacactcctgtctccaagtttgtcctggaccgaatatttgtctgtgacaagcacaagattcttttctgccagactcccaaagtgggcaacacccagtggaagaaagtgctgattgttctaa

SEQ ID NO: 4540 - DNA, 1338 bp, Homo sapiens
aagaaggagcatgtgcagcttcggtgcgaggggagtcaggggtgggaatgcacgttccctgcctgaggggccccggggtgccctgagcctctgatcttcgctgtcaggaggcctgtccgaagttggaggttgaggcatgcagttctgcacttctggctgggaagtgacaagaggaaccaagaacctcagttcaggggaaacacagcaaggaaatgtgagccccaggctgcagaaggaagagtcagtgaatggctgcggtgtgacaacatgcaccaccagtggcttctgctggccgcatgcttttgggtgattttcatgttcatggtggctagcaagttcatcacgttgacctttaaagacccagatgtgtacagtgccaaacaggagtttctgttcctgacaaccatgccggaagtgaggaagttgccagaagagaagcacattcctgaggaactgaagccaactgggaaggagcttccagacagccagctcgttcagcccctggtctacatggagcgcctggaactcatcagaaacgtctgcagggatgatgccctgaagaatctctcgcacactcctgtctccaagtttgtcctggaccgaatatttgtctgtgacaagcacaagattcttttctgccagactcccaaagtgggcaacacccagtggaagaaagtgctgattgttctaaatggagcattttcttccattgaggagatccccgaaaacgtggtgcacgaccacgagaagaacggccttcctcggctctcttccttcagtgatgcagaaattcagaagcgattgaaaacatacttcaagttttttattgtaagagatcccttcgaaagacttatttctgcatttaaggataaatttgttcacaatccccggtttgagccttggtacaggcatgagattgctcctggcatcatcagaaaatacaggaggaaccggacagagacccgggggatccagtttgaagatttcgtgcgctacctcggcgatccgaaccacagatggctagaccttcagtttggggaccacatcattcactgggtgacgtatgtagagctctgtgctccctgtgagataatgtacagtgtgattggacaccacgagaccctggaggacgatgccccatacatcttaaaagaggctggcattgaccacctggtgtcatacccgactatccctccgggcattaccgtgtataacagaaccaaggtggagcactatttcctgggcatcagcaaacgagacatccgacgcctgtatgcccgtttcgaaggggactttaagctctttgggtaccagaaaccagactttttgctaaactaa

SEQ ID NO: 4541 - DNA, 692 bp, Homo sapiens
gggtgggtttcagcgcctgggcccctctccccgccgcggggcgcacggaaaaaccggggaacccgcgggttttgtcctggcgagccacatcccgtgactgggttaaaatgaaaagacacaaagagagaagtggtcttttcccttccctccccattataattaagagcttagtccatcttggctcagaattggaattcagaattcagaattgctcttgaccctgaagaatagaatctcaaagaaatacctgagcagaaaattctcttcttcgctgaaatgaaaattggagtgtttgcaaaactgaacaaagaaaggaaagaatttgtaaacatcacaggcaacttgcagttatattcggatcatttttcagtgtttgaggagttcatacaataaaaagtgacaagaggaaccaagaacctcagttcaggggaaacacagcaaggaaatgtgagccccaggctgcagaaggaagagtcagtgaatggctgcggtgtgacaacatgcaccaccagtggcttctgctggccgcatgcttttgggtgattttcatgttcatggtggctagcaagttcatcacgttgacctttaaagacccagatgtgtacagtgccaaacaggagtttctgttcctgacaaccatgccggaagtgaggaagttgccagaagagaagcacattcctgaggaactgaag

SEQ ID NO: 4542 - DNA, 574 bp, Homo sapiens
actatctaggtttatgtaagaacgctctgatgtttgcagaagaacatcgcctaacgatacatttctcagaagtgacaagaggaaccaagaacctcagttcaggggaaacacagcaaggaaatgtgagccccaggctgcagaaggaagagtcagtgaatggctgcggtgtgacaacatgcaccaccagtggcttctgctggccgcatgcttttgggtgattttcatgttcatggtggctagcaagttcatcacgttgacctttaaagacccagatgtgtacagtgccaaacaggagtttctgttcctgacaaccatgccggaagtgaggaagttgccagaagagaagcacattcctgaggaactgaagccaactgggaaggagcttccagacagccagctcgttcagcccctggtctacatggagcgcctggaactcatcagaaacgtctgcagggatgatgccctgaagaatctctcgcacactcctgtctccaagtttgtcctggaccgaatatttgtctgtgacaagcacaagattcttttctgccagactcccaaagtgggcaacacccag

SEQ ID NO: 4543 - DNA, 559 bp, Homo sapiens
agcgcctgggcccctctccccgccgcggggcgcacggaaaaaccggggaacccgcgggttttgtcctggcgagccacatcccgtgacaagaggaaccaagaacctcagttcaggggaaacacagcaaggaaatgtgagccccaggctgcagaagaccctactgtcgcattaatttctggcaaccacactgagaaaggtgtagattaagctggaaaatcacgaagagtgccaagggattggtcagtttttactgggggtctgcaccaggccaggaagagtcagtgaatggctgcggtgtgacaacatgcaccaccagtggcttctgctggccgcatgcttttgggtgattttcatgttcatggtggctagcaagttcatcacgttgacctttaaagacccagatgtgtacagtgccaaacaggagtttctgttcctgacaaccatgccggaagtgaggaagttgccagaagagaagcacattcctgaggaactgaagccaactgggaaggagcttccagacagccagctcgttcagcccctggtctacatggagcgcctg

SEQ ID NO: 4544 - DNA, 673 bp, Homo sapiens
agtagggtgagctcggggacgcgcaggcgggtgggtttcagcgcctgggcccctctccccgccgcggggcgcacggaaaaaccggggaacccgcgggttttgtcctggcgagccacatcccgatggagagaggaagaaagggttcagcttgggtccaaggagcatgcagaggaaggcagggaagaaggagcatgtgcagcttcggtgcgaggggagtcaggggtgggaatgcacgttccctgcctgaggggccccggggtgccctgagcctctgatcttcgctgtcaggaggcctgtccgaagttggaggttgaggcatgcagttctgcacttctggctgggaaggtgaaccaggttttccaaaatgtcatttttgctttccaagtctgcaaggcaggaaagggttgggcagtgaatggaaagtagtgcagccaggttctggttagctcagcggcaggactgtcataacgtgacaagaggaaccaagaacctcagttcaggggaaacacagcaaggaaatgtgagccccaggctgcagaaggaagagtcagtgaatggctgcggtgtgacaacatgcaccaccagtggcttctgctggccgcatgcttttgggtgattttcatgttcatggtggctagcaagttcatcacgttgacctttaaagacccagatg

SEQ ID NO: 4545 - DNA, 1476 bp, Homo sapiens
atgcaataagaaggcgtccttgtgcgggatgctgtgacccgcggaattattgatattgtgcgagcctacaatttacttctttcatccttggctgagaatttgcgtttgtaattgtagatggagagaggaagaaagggttcagcttgggtccaaggagcatgcagaggaaggcagggaagaaggagcatgtgcagcttcgtgacaagaggaaccaagaacctcagttcaggggaaacacagcaaggaaatgtgagccccaggctgcagaaggaagagtcagtgaatggctgcggtgtgacaacatgcaccaccagtggcttctgctggccgcatgcttttgggtgattttcatgttcatggtggctagcaagttcatcacgttgacctttaaagacccagatgtgtacagtgccaaacaggagtttctgttcctgacaaccatgccggaagtgaggaagttgccagaagagaagcacattcctgaggaactgaagccaactgggaaggagcttccagacagccagctcgttcagcccctggtctacatggagcgcctggaactcatcagaaacgtctgcagggatgatgccctgaagaatctctcgcacactcctgtctccaagtttgtcctggaccgaatatttgtctgtgacaagcacaagattcttttctgccagactcccaaagtgggcaacacccagtggaagaaagtgctgattgttctaaatggagcattttcttccattgaggagatccccgaaaacgtggtgcacgaccacgagaagaacggccttcctcggctctcttccttcagtgatgcagaaattcagaagcgattgaaaacatacttcaagttttttattgtaagagatcccttcgaaagacttatttctgcatttaaggataaatttgttcacaatccccggtttgagccttggtacaggcatgagattgctcctggcatcatcagaaaatacaggaggaaccggacagagacccgggggatccagtttgaagatttcgtgcgctacctcggcgatccgaaccacagatggctagaccttcagtttggggaccacatcattcactgggtgacgtatgtagagctctgtgctccctgtgagataatgtacagtgtgattggacaccacgagaccctggaggacgatgccccatacatcttaaaagaggctggcattgaccacctggtgtcatacccgactatccctccgggcattaccgtgtataacagaaccaaggtggagcactatttcctgggcatcagcaaacgagacatccgacgcctgtatgcccgtttcgaaggggactttaagctctttgggtaccagaaaccagactttttgctaaactaatgcataagacctatgaattcaaatatctttattagacctggggctaaccaggtgaagatctgagcccagaaatgacccttcctccaccacacccctcctttga

SEQ ID NO: 4546 - DNA, 1195 bp, Homo sapiens
gttttccacagaggtagtgaaaagaactggattttcaagttcactttgcaagagaaaaagaaaactcagtagaagataatggcaagtccagactggggatatgatgacaaaaatggtcctgaacaatggagcaagctgtatcccattgccaatggaaataaccagtcccctgttgatattaaaaccagtgaaaccaaacatgacacctctctgaaacctattagtgtctcctacaacccagccacagccaaagaaattatcaatgtggggcattccttccatgtaaattttgaggacaacgataaccgatcagtgctgaaaggtggtcctttctctgacagctacaggctctttcagttccattttcactggggcagtacaaatgagcatggttcagaacatacagtggatggagtcaaatattctgccgagcttcacgtagctcactggaattctgcaaagtactccagccttgctgaagctgcctcaaaggctgatggtttggcagttattggtgttttgatgaaggttggtgaggccaacccaaagctgcagaaagtacttgatgccctccaagcaattaaaaccaagggcaaacgagccccattcacaaattttgacccctctactctccttccttcatccctggatttctggacctaccctggctctctgactcatcctcctctttatgagagtgtaacttggatcatctgtaaggagagcatcagtgtcagctcagagcagctggcacaattccgcagccttctatcaaatgttgaaggtgataacgctgtccccatgcagcacaacaaccgcccaacccaacctctgaagggcagaacagtgagagcttcattttgatgattctgagaagaaacttgtccttcctcaagaacacagccctgcttctgacataatccagtaaaataataatttttaagaaataaatttatttcaatattagcaagacagcatgccttcaaatcaatctgtaaaactaagaaacttaaattttagttcttactgcttaattcaaataataattagtaagctagcaaatagtaatctgtaagcataagcttatgcttaaattcaagtttagtttgaggaattctttaaaattacaactaagtgatttgtatgtctatttttttcagtttatttgaaccaataaaataattttatctctttc

SEQ ID NO: 4547 - DNA, 1232 bp, Homo sapiens
ctcctccctattctagaaatagaagggaggaggacctattttgttccatcctgtaggctgatcctttacacctaggactggaagaaataagaaaaagaaaactcagtagaagataatggcaagtccagactggggatatgatgacaaaaatggtcctgaacaatggagcaagctgtatcccattgccaatggaaataaccagtcccctgttgatattaaaaccagtgaaaccaaacatgacacctctctgaaacctattagtgtctcctacaacccagccacagccaaagaaattatcaatgtggggcattccttccatgtaaattttgaggacaacgataaccgatcagtgctgaaaggtggtcctttctctgacagctacaggctctttcagttccattttcactggggcagtacaaatgagcatggttcagaacatacagtggatggagtcaaatattctgccgagcttcacgtagctcactggaattctgcaaagtactccagccttgctgaagctgcctcaaaggctgatggtttggcagttattggtgttttgatgaaggttggtgaggccaacccaaagctgcagaaagtacttgatgccctccaagcaattaaaaccaagggcaaacgagccccattcacaaattttgacccctctactctccttccttcatccctggatttctggacctaccctggctctctgactcatcctcctctttatgagagtgtaacttggatcatctgtaaggagagcatcagtgtcagctcagagcagctggcacaattccgcagccttctatcaaatgttgaaggtgataacgctgtccccatgcagcacaacaaccgcccaacccaacctctgaagggcagaacagtgagagcttcattttgatgattctgagaagaaacttgtccttcctcaagaacacagccctgcttctgacataatccagtaaaataataatttttaagaaataaatttatttcaatattagcaagacagcatgccttcaaatcaatctgtaaaactaagaaacttaaattttagttcttactgcttaattcaaataataattagtaagctagcaaatagtaatctgtaagcataagcttatgcttaaattcaagtttagtttgaggaattctttaaaattacaactaagtgatttgtatgtctatttttttcagtttatttgaaccaataaaataattttatctctttc

SEQ ID NO: 4548 - DNA, 1196 bp, Homo sapiens
atctcctgcatgcacagttgcagttagttattccaggtattatttttgttttcagaaaaagaaaactcagtagaagataatggcaagtccagactggggatatgatgacaaaaatggtcctgaacaatggagcaagctgtatcccattgccaatggaaataaccagtcccctgttgatattaaaaccagtgaaaccaaacatgacacctctctgaaacctattagtgtctcctacaacccagccacagccaaagaaattatcaatgtggggcattccttccatgtaaattttgaggacaacgataaccgatcagtgctgaaaggtggtcctttctctgacagctacaggctctttcagttccattttcactggggcagtacaaatgagcatggttcagaacatacagtggatggagtcaaatattctgccgagcttcacgtagctcactggaattctgcaaagtactccagccttgctgaagctgcctcaaaggctgatggtttggcagttattggtgttttgatgaaggttggtgaggccaacccaaagctgcagaaagtacttgatgccctccaagcaattaaaaccaagggcaaacgagccccattcacaaattttgacccctctactctccttccttcatccctggatttctggacctaccctggctctctgactcatcctcctctttatgagagtgtaacttggatcatctgtaaggagagcatcagtgtcagctcagagcagctggcacaattccgcagccttctatcaaatgttgaaggtgataacgctgtccccatgcagcacaacaaccgcccaacccaacctctgaagggcagaacagtgagagcttcattttgatgattctgagaagaaacttgtccttcctcaagaacacagccctgcttctgacataatccagtaaaataataatttttaagaaataaatttatttcaatattagcaagacagcatgccttcaaatcaatctgtaaaactaagaaacttaaattttagttcttactgcttaattcaaataataattagtaagctagcaaatagtaatctgtaagcataagcttatgcttaaattcaagtttagtttgaggaattctttaaaattacaactaagtgatttgtatgtctatttttttcagtttatttgaaccaataaaataattttatctctttc

SEQ ID NO: 4549 - DNA, 696 bp, Homo sapiens
gtggtacccagtcctcaggtgcaaccccctgcgtggtcctctgtggcagccttctctcattcagagctgggttgcagcagctcagacaatccttaccatgtgaaaggaggaatgactgtcatggcatgaaaaaagcatcactatgaaaaagaaaactcagtagaagataatggcaagtccagactggggatatgatgacaaaaatggtcctgaacaatggagcaagctgtatcccattgccaatggaaataaccagtcccctgttgatattaaaaccagtgaaaccaaacatgacacctctctgaaacctattagtgtctcctacaacccagccacagccaaagaaattatcaatgtggggcattccttccatgtaaattttgaggacaacgataaccgatcagtgctgaaaggtggtcctttctctgacagctacaggctctttcagttccattttcactggggcagtacaaatgagcatggttcagaacatacagtggatggagtcaaatattctgccgagcttcacgtagctcactggaattctgcaaagtactccagccttgctgaagctgcctcaaaggctgatggtttggcagttattggtgttttgatgaaggttggtgaggccaacccaaagctgcagaaagtacttgatgccctccaagcaattaaaaccaagggcaaacgagcccc

SEQ ID NO: 4550 - DNA, 832 bp, Homo sapiens
atctcctgcatgcacagttgcagttagttattccaggtattatttttgttttcagaaaaagaaaactcagtagaagataatggcaagtccagactggggatatgatgacaaaaatggtcctgaacaatggagcaagctgtatcccattgccaatggaaataaccagtcccctgttgatattaaaaccagtgaaaccaaacatgacacctctctgaaacctattagtgtctcctacaacccagccacagccaaagaaattatcaatgtggggcattccttccatgtaaattttgaggacaacgataaccgatcagtgctgaaaggtggtcctttctctgacagctacaggctctttcagttccattttcactggggcagtacaaatgagcatggttcagaacatacagtggatggagtcaaatattctgccgagcttcacgtagctcactggaattctgcaaagtactccagccttgctgaagctgcctcaaaggctgatggtttggcagttattggtgttttgatgaaggttggtgaggccaacccaaagctgcagaaagtacttgatgccctccaagcaattaaaaccaagggcaaacgagccccattcacaaattttgacccctctactctccttccttcatccctggatttctggacctaccctggctctctgactcatcctcctctttatgagagtgtaacttggatcatctgtaaggagagcatcagtgtcagctcagagcagctggcacaattccgcagccttctatcaaatgttgaaggtgataacgctgtccccatgcagcacaacaaccgcccaacccaacct

SEQ ID NO: 4551 - DNA, 491 bp, Homo sapiens
gtggtacccagtcctcaggtgcaaccccctgcgtggtcctctgtggcagccttctctcattcagagctgttttccacagaggtagtgaaaagaactggattttcaagttcactttgcaagagaaatagaagggaggaggacctattttgttccatcctgtaggctgatcctttacacctaggactggaagaaataagaaacagagtatcactatgtggcccaagctggtctggacctcctaggtgcaagagatcctcccacctcagcctaaaacacagattttaatgcccaattttgttataataagaattaaataagttaatgggttgcagcagctcagacaatccttaccatgtgaaaggaggaatgactgtcatggcatgaaaaaagcatcactatgaaaaagaaaactcagtagaagataatggcaagtccagactggggatatgatgacaaaaatggtcctgaacaatggagcaagctgtatccca

SEQ ID NO: 4552 - DNA, 666 bp, Homo sapiens
acccagtcctcaggtgcaaccccctgcgtggtcctctgtggcagccttctctcattcagagctgttttccacagaggtagtgaaaagaactggattttcaagttcactttgcaagaggggttgcagcagctcagacaatccttaccatgtgaaaggaggaatgactgtcatggcatgaaaaaagcatcactatgaaaaagaaaactcagtagaagataatggcaagtccagactggggatatgatgacaaaaatggtcctgaacaatggagcaagctgtatcccattgccaatggaaataaccagtcccctgttgatattaaaaccagtgaaaccaaacatgacacctctctgaaacctattagtgtctcctacaacccagccacagccaaagaaattatcaatgtggggcattccttccatgtaaattttgaggacaacgataaccgatcagtgctgaaaggtggtcctttctctgacagctacaggctctttcagttccattttcactggggcagtacaaatgagcatggttcagaacatacagtggatggagtcaaatattctgccgagcttcacgtagctcactggaattctgcaaagtactccagccttgctgaagctgcctcaaaggctgatggtttggcagttattggtgttttgatga

SEQ ID NO: 4553 - DNA, 614 bp, Homo sapiens
gtggtacccagtcctcaggtgcaaccccctgcgtggtcctctgtggcagccttctctcattcagagctaaatagaagggaggaggacctattttgttccatcctgtaggctgatcctttacacctaggactggaagaaataagaaaaagaaaactcagtagaagataatggcaagtccagactggggatatgatgacaaaaatggtcctgaacaatggagcaagctgtatcccattgccaatggaaataaccagtcccctgttgatattaaaaccagtgaaaccaaacatgacacctctctgaaacctattagtgtctcctacaacccagccacagccaaagaaattatcaatgtggggcattccttccatgtaaattttgaggacaacgataaccgatcagtgctgaaaggtggtcctttctctgacagctacaggctctttcagttccattttcactggggcagtacaaatgagcatggttcagaacatacagtggatggagtcaaatattctgccgagcttcacgtagctcactggaattctgcaaagtactccagccttgctgaagctgcctcaaaggctgatggtttggcagttattggtgttttgatg

SEQ ID NO: 4554 - DNA, 501 bp, Homo sapiens
gtggtacccagtcctcaggtgcaaccccctgcgtggtcctctgtggcagccttctctcattcagagctatatgtgtacttcctgataagcagagatgatgaaataatggcctattaaaagcaaaaaaagaaaactcagtagaagataatggcaagtccagactggggatatgatgacaaaaatggtcctgaacaatggagcaagctgtatcccattgccaatggaaataaccagtcccctgttgatattaaaaccagtgaaaccaaacatgacacctctctgaaacctattagtgtctcctacaacccagccacagccaaagaaattatcaatgtggggcattccttccatgtaaattttgaggacaacgataaccgatcagtgctgaaaggtggtcctttctctgacagctacaggctctttcagttccattttcactggggcagtacaaatgagcatggttcagaacatacagtggatggagtcaaatattctgccgag

SEQ ID NO: 4555 - DNA, 618 bp, Homo sapiens
gtggtacccagtcctcaggtgcaaccccctgcgtggtcctctgtggcagccttctctcattcagagctaattttttacaacaccttttttttagatatgtgtacttcctgataagcagagatgatgaaataatggcctattaaaagcaaaaaaagaaaactcagtagaagataatggcaagtccagactggggatatgatgacaaaaatggtcctgaacaatggagcaagctgtatcccattgccaatggaaataaccagtcccctgttgatattaaaaccagtgaaaccaaacatgacacctctctgaaacctattagtgtctcctacaacccagccacagccaaagaaattatcaatgtggggcattccttccatgtaaattttgaggacaacgataaccgatcagtgctgaaaggtggtcctttctctgacagctacaggctctttcagttccattttcactggggcagtacaaatgagcatggttcagaacatacagtggatggagtcaaatattctgccgagcttcacgtagctcactggaattctgcaaagtactccagccttgctgaagctgcctcaaaggctgatggtttggcagttattggtgttttga

SEQ ID NO: 4556 - DNA, 1208 bp, Homo sapiens
gtggtacccagtcctcaggtgcaaccccctgcgtggtcctctgtggcagccttctctcattcagagctaaaaagaaaactcagtagaagataatggcaagtccagactggggatatgatgacaaaaatggtcctgaacaatggagcaagctgtatcccattgccaatggaaataaccagtcccctgttgatattaaaaccagtgaaaccaaacatgacacctctctgaaacctattagtgtctcctacaacccagccacagccaaagaaattatcaatgtggggcattccttccatgtaaattttgaggacaacgataaccgatcagtgctgaaaggtggtcctttctctgacagctacaggctctttcagttccattttcactggggcagtacaaatgagcatggttcagaacatacagtggatggagtcaaatattctgccgagcttcacgtagctcactggaattctgcaaagtactccagccttgctgaagctgcctcaaaggctgatggtttggcagttattggtgttttgatgaaggttggtgaggccaacccaaagctgcagaaagtacttgatgccctccaagcaattaaaaccaagggcaaacgagccccattcacaaattttgacccctctactctccttccttcatccctggatttctggacctaccctggctctctgactcatcctcctctttatgagagtgtaacttggatcatctgtaaggagagcatcagtgtcagctcagagcagctggcacaattccgcagccttctatcaaatgttgaaggtgataacgctgtccccatgcagcacaacaaccgcccaacccaacctctgaagggcagaacagtgagagcttcattttgatgattctgagaagaaacttgtccttcctcaagaacacagccctgcttctgacataatccagtaaaataataatttttaagaaataaatttatttcaatattagcaagacagcatgccttcaaatcaatctgtaaaactaagaaacttaaattttagttcttactgcttaattcaaataataattagtaagctagcaaatagtaatctgtaagcataagcttatgcttaaattcaagtttagtttgaggaattctttaaaattacaactaagtgatttgtatgtctatttttttcagtttatttgaaccaataaaataattttatctcttt

SEQ ID NO: 4557 - DNA, 518 bp, Homo sapiens
gtggtacccagtcctcaggtgcaaccccctgcgtggtcctctgtggcagccttctctcattcagagctgttttccacagaggtagtgaaaagaactggattttcaagttcactttgcaagagaaatagaagggaggaggacctattttgttccatcctgtaggctgatcctttacacctaggactggaagaaataagaaaaagaaaactcagtagaagataatggcaagtccagactggggatatgatgacaaaaatggtcctgaacaatggagcaagctgtatcccattgccaatggaaataaccagtcccctgttgatattaaaaccagtgaaaccaaacatgacacctctctgaaacctattagtgtctcctacaacccagccacagccaaagaaattatcaatgtggggcattccttccatgtaaattttgaggacaacgataaccgatcagtgctgaaaggtggtcctttctctgacagctacaggctctttcagttccattttcactggggc

SEQ ID NO: 4558 - DNA, 2785 bp, Homo sapiens
ctttagcccaacagtcaaaaataattgatgctaccctacaaatgtccaaaactctagtatatcatatttctaagttacagcaaatattagtcctgctaaaccagggagctttggcaaaaatgttttttgacagtaaatttgtccttgattatatattaactagtcaaagaggtgtttgtaacattattagagcttcttgttgtaggtgggttaacaccaccaatcaagaggtcattctaacagaaagcctggatcagaaaaccatcaccctaaaaaaacatgccttacatatttaacacactctgaaatccagtcaaaatatgactaaaggcccttgccatgactgatgtattctcctggccaacgccaaacaaatgggagcctggttacgagtcagccttcagggacttgtcacatttctacttggtttcttccttgttattgtcataataaaatgttttctatgctgtttagtgcaacttaggccctattctgtagaagtctcctctactattcaggccactcaaacaccccaaataattgagttcaaaatcgacatcaagatataaaggaatcagtgactaaatatatttcatatatggtatttttattgattattgtgctgtcttgacctagtatggaggccttggctagaggctggtcagtttcctctcttgagcagctgattaaatccacaccccaaccacttcccttatcaggttctcacactctggggccactatgtacccactctaatcaccacagggccagacatcagacaattaaggacagcgcccatgccccaaagcccgccaaaattatgcaaattattcaaaattattcaacctagctaaccccaccctttttgctgtacataagctgcccattccccctccagcctgtggtacccagtcctcaggtgcaaccccctgcgtggtcctctgtggcagccttctctcattcagagctgttttccacagaggtagtgaaaagaactggattttcaagttcactttgcaagagaaaaagaaaactcagtagaagataatggcaagtccagactggggatatgatgacaaaaatggtcctgaacaatggagcaagctgtatcccattgccaatggaaataaccagtcccctgttgatattaaaaccagtgaaaccaaacatgacacctctctgaaacctattagtgtctcctacaacccagccacagccaaagaaattatcaatgtggggcattccttccatgtaaattttgaggacaacgataaccgatcagtgctgaaaggtggtcctttctctgacagctacaggctctttcagttccattttcactggggcagtacaaatgagcatggttcagaacatacagtggatggagtcaaatattctgccgagcttcacgtagctcactggaattctgcaaagtactccagccttgctgaagctgcctcaaaggctgatggtttggcagttattggtgttttgatgaaggttggtgaggccaacccaaagctgcagaaagtacttgatgccctccaagcaattaaaaccaagggcaaacgagccccattcacaaattttgacccctctactctccttccttcatccctggatttctggacctaccctggctctctgactcatcctcctctttatgagagtgtaacttggatcatctgtaaggagagcatcagtgtcagctcagagcagctggcacaattccgcagccttctatcaaatgttgaaggtgataacgctgtccccatgcagcacaacaaccgcccaacccaacctctgaagggcagaacagtgagagcttcattttgatgattctgagaagaaacttgtccttcctcaagaacacagccctgcttctgacataatccagtaaaataataatttttaagaaataaatttatttcaatattagcaagacagcatgccttcaaatcaatctgtaaaactaagaaacttaaattttagttcttactgcttaattcaaataataattagtaagctagcaaatagtaatctgtaagcataagcttatgcttaaattcaagtttagtttgaggaattctttaaaattacaactaagtgatttgtatgtctatttttttcagtttatttgaaccaataaaataattttatctctttctttctgttgtgcattcagtttctaaaaccattaagtttctactccatttacattcaaaaatcttaaatactttacttgcaagagtattttgcttcaaatacaacaacctaagagcagctggagatgaaatattgggaaattcatttgcttactcctgaagacaaaaatatagctgagatgaccactggatttaatatcgttatgctggcccaacattgctaccatttgtgttgtctgtgatcaaaatgattatcttttatataggaagatgacgcttctggatattgctttcacttcttctccccacgttagcaaggacaatgcttctctgccattattacaactagttagtttgcatggagaatctttactttaaaattggaagaaaagtcacaagtgaatggtttataaaaatgctaaagaagtcattcttgcttagaatcatatagaaacatcatgcaatcttttagtcagatgtgcgcttcaccttatgctatttttatctttaattgacacacaataattgtacatgtttatggagtatagtgtggtgttttctgtttgtttgtttgttttttgagacaaggtctcactctgccagtcagggtggagtgcgatggt

SEQ ID NO: 4559 - DNA, 1236 bp, Homo sapiens
atccctctcttctttcaggggttgcagcagctcagacaatccttaccatgtgaaaggaggaatgactgtcatggcatgaaaaaagcatcactatgaaaaagaaaactcagtagaagataatggcaagtccagactggggatatgatgacaaaaatggtcctgaacaatggagcaagctgtatcccattgccaatggaaataaccagtcccctgttgatattaaaaccagtgaaaccaaacatgacacctctctgaaacctattagtgtctcctacaacccagccacagccaaagaaattatcaatgtggggcattccttccatgtaaattttgaggacaacgataaccgatcagtgctgaaaggtggtcctttctctgacagctacaggctctttcagttccattttcactggggcagtacaaatgagcatggttcagaacatacagtggatggagtcaaatattctgccgagcttcacgtagctcactggaattctgcaaagtactccagccttgctgaagctgcctcaaaggctgatggtttggcagttattggtgttttgatgaaggttggtgaggccaacccaaagctgcagaaagtacttgatgccctccaagcaattaaaaccaagggcaaacgagccccattcacaaattttgacccctctactctccttccttcatccctggatttctggacctaccctggctctctgactcatcctcctctttatgagagtgtaacttggatcatctgtaaggagagcatcagtgtcagctcagagcagctggcacaattccgcagccttctatcaaatgttgaaggtgataacgctgtccccatgcagcacaacaaccgcccaacccaacctctgaagggcagaacagtgagagcttcattttgatgattctgagaagaaacttgtccttcctcaagaacacagccctgcttctgacataatccagtaaaataataatttttaagaaataaatttatttcaatattagcaagacagcatgccttcaaatcaatctgtaaaactaagaaacttaaattttagttcttactgcttaattcaaataataattagtaagctagcaaatagtaatctgtaagcataagcttatgcttaaattcaagtttagtttgaggaattctttaaaattacaactaagtgatttgtatgtctatttttttcagtttatttgaaccaataaaataattttatctctttc

SEQ ID NO: 4560 - DNA, 1688 bp, Homo sapiens
cccggcccgccccgccccgagcgcggggagttcacctccgcccgtcaccacctccccttgtcgcctaggtccacccgagccccctcccccgggccgcccccgagcacgaagttggcgggagcctataaaagctggtgccggcgcgacccgcggacacacagtgcaggcgcccaagccgccgccgccagatcggtgccgattcctgccctgccccgaccgccagcgcgaccatgtcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccttggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaataagatggtcccatagtctgtatccaaataatgaatcttcgggtgtttccctttagctaagcacagatctaccttggtgatttggaccctggttgctttgtgtctagttttctagacccttcatctcttacttgatagacttactaataaaatgtgaagactagaccaattgtcatgcttgacacaactgctgtggctggttggtgctttgtttatggtagtagtttttctgtaacacagaatataggataagaaataagaataaagtaccttgactttgttcacagcatgtagggtgatgagcactcacaattgttgactaaaatgctgcttttaaaacataggaaagtagaatggttgagtgcaaatccatagcacaagataaattgagctagttaaggcaaatcaggtaaaatagtcatgattctatgtaatgtaaaccagaaaaaataaatgttcatgatttcaagatgttatattaaagaaaaactttaaaaattattatatatttatagcaaagttatcttaaatatgaattctgttgtaatttaatgacttttgaattacagagatataaatgaagtattatctgtaaaaattgttataattagagttgtgatacagagtatatttccattcagacaatatatcataacttaataaatattgtattttaga

SEQ ID NO: 4561 - DNA, 1753 bp, Homo sapiens
acataaaagcgcgggctcgcggcgactctgcaccacgcaggggaagagaaagcaggagccgtccagcacggaggaaggcgaccatggccaaggagtggggctacgccagtcacaacggtcctgaccactggcatgaacttttcccaaatgccaagggggaaaaccagtcgcccgttgagctgcatactaaagacatcaggcatgacccttctctgcagccatggtctgtgtcttatgatggtggctctgccaagaccatcctgaataatgggaagacctgccgagttgtatttgatgatacttatgataggtcaatgctgagagggggtcctctccctggaccctaccgacttcgccagtttcatcttcactggggctcttcggatgatcatggctctgagcacaccgtggatggagtcaagtatgcagcggagcttcatttggttcactggaacccgaagtataacacttttaaagaagccctgaagcagcgcgatgggatcgctgtgattggcatttttctgaagataggacatgagaatggcgagttccagattttccttgatgcattggacaagattaagacaaagggcaaggaggcgcccttcacaaagtttgacccatcctgcctgttcccggcatgccgggactactggacctaccagggctcattcaccacgccgccctgcgaggaatgcattgtgtggctgctgctgaaggagcccatgaccgtgagctctgaccagatggccaagctgcggagcctcctctccagtgctgagaacgagcccccagtgcctcttgtgagcaactggcgacctccacagcctatcaataacagggtggtgagagcttccttcaaatgaggctgctggatcttgccctcttcaggaaaggaaacctaccattggagagcttggttccttgcctccttctggtgctccttactccaagtctatttcatttttccacactgagcaatgaatgtgagagatgtggtcaccaagatctaagttacttgttgaaagaaagttactttcgacaagatctaatatgaaagcatagatttcacatttgatctctgtaataatcatctttcctataaaagtagcatttttggtaaagtttcaaagaagaagaaacagagatggaagagtaaagatatttttaaaatggctagctattgggcaccagtttttctgttatctaaaatttcacacaacttcattgtttttatttttatattatgagttgtccatcttaaagaaatatgagtaattctacatgtagtagaggtgtatgaagatcatataacaattaaacataagccagaaattaaaatgactatagacagcaagaattgagctaataatatgttttaactcttaacaccagcaagaagtcagtcatttattgaagttttagctactaagattacttggttttgattaccagtgaaaagaaaacacaatacaatcaggagttttcaaatttttgattcagtatttgaatttcttcttcataaatgtagttgaatttatcctagtatttttctttacctgaaggagggccatttatttttaatttcactacatttttctttgcatgattattaaaataaaaactgcctctgttgtgtttctcactggaggctggaatgaatgatcactagaacacaaaagagtgaatgatgacacttgaagtcaaagcagttgtactgatcaccagaaccaataaagacataaatggaaaa

SEQ ID NO: 4562 - DNA, 1151 bp, Homo sapiens
accacgcaggggaagagaaagcaggagccgtccagcacggaggaaggcgaccatggccaaggagtggggctacgccagtcacaacggtcctgaccactggcatgaacttttcccaaatgccaagggggaaaaccagtcgccatggtctgtgtcttatgatggtggctctgccaagaccatcctgaataatgggaagacctgccgagttgtatttgatgatacttatgataggtcaatgctgagagggggtcctctccctggaccctaccgacttcgccagtttcatcttcactggggctcttcggatgatcatggctctgagcacaccgtggatggagtcaagtatgcagcggagcttcatttggttcactggaacccgaagtataacacttttaaagaagccctgaagcagcgcgatgggatcgctgtgattggcatttttctgaagataggacatgagaatggcgagttccagattttccttgatgcattggacaagattaagacaaagggcaaggaggcgcccttcacaaagtttgacccatcctgcctgttcccggcatgccgggactactggacctaccagggctcattcaccacgccgccctgcgaggaatgcattgtgtggctgctgctgaaggagcccatgaccgtgagctctgaccagatggccaagctgcggagcctcctctccagtgctgagaacgagcccccagtgcctcttgtgagcaactggcgacctccacagcctatcaataacagggtggtgagagcttccttcaaatgaggctgctggatcttgccctcttcaggaaaggaaacctaccattggagagcttggttccttgcctccttctggtgctccttactccaagtctatttcatttttccacactgagcaatgaatgtgagagatgtggtcaccaagatctaagttacttgttgaaagaaagttactttcgacaagatctaatatgaaagcatagatttcacatttgatctctgtaataatcatctttcctataaaagtagcatttttggtaaagtttcaaagaagaagaaacagagatggaagagtaaagatatttttaaaatggctagctattgggcaccagtttttctgttatctaaaatttcacacaacttcattg

SEQ ID NO: 4563 - DNA, 6050 bp, Homo sapiens
gtagcttcgatggccggacgtgcaggctgcggatccccgtaggcgagcgagcggctaggttcgtgatctggagagacgctcagattattaagttcctgcaacttaactgggaactgatcaagatttcaagctaaagatggtggtgatgaacagcctgagggtcattcttcaagcctctccaggcaaattgctgtggagaaagttccagattccgagattcatgccagcgaggccctgcagcctctatacttgtacttacaaaacccggaaccgagccttgcatccactctgggagagcgtggacctggttcctgggggcgatcgccagtcacccatcaacattcggtggagggacagtgtttatgatcccggcttaaaaccactgaccatctcttatgacccagccacctgcctccacgtctggaataatgggtactctttcctcgtggaatttgaagattctacagataaatcagtgatcaagggaggacccctggaacacaactaccgattgaagcagttccattttcactggggggccatcgatgcctggggttctgagcacaccgtggacagcaaatgcttcccagcagagctgcacttagtgcattggaacgcagtcagatttgaaaactttgaggatgcagcactggaagaaaatggtttggctgtgataggagtatttttaaagctaggcaaacatcataaggagctacagaaattagtggatactttgccgtcaattaagcataaggacgcccttgtggaatttgggtcatttgacccttcctgcctgatgcctacctgcccagattactggacctactcagggtctctgactaccccacccctctccgagtctgtcacctggatcattaagaagcaaccagtagaggttgatcatgatcagcttgagcaatttcggaccctgcttttcacttccgaaggggagaaagagaaaagaatggtggacaacttccgcccccttcagccactgatgaatcgcactgttcgttcatccttccggcatgattatgtgctgaatgtacaagcgaaacccaagccggccaccagccaagcaaccccctaaaacattcatatctaggcagtattttgcttttgctttaatatatactagcttactataaattgttaactagactattctaagtgcctgcatttgataatatttacagatgtgcatttcttagcatgagagtgcttcatcagtctttgaggaaggctattcggtaccagcaagagacacaagtttctcttacagatacctgttggtaattgtaatgccttttttttttctttaagagactaggtcttgctctgctgcccaggctagagtgcagtggccaaatgatagctcactgcagccttgaactcctaggctcaagcagtcctcctgccttagcctctagagtagctggggctacaggtgctggccgcctggcccagcttgtaatatctttttatgtctgacatttttgagctatctttttatgtttatccattagtggttctatagcactatacatagggattataatcaaaatttttaacatgtggtaaggcacagacactgaccagaactcaggccttgcagaaacagcctatgggcccagactggtacttcctggctgaatattggccatggttttagatgtattttattttataacatgaatgtgtattctttcataagggcttatcagtcagtatatttgccccagtgtttagttgttacaaggacatgatatgcttacttactatcagtttatgatgtagaaaatatattttgtaattataagaaaacaagacttttcctatacccagaaatccctttgcatttccgaagatcagatattttgcttaaaggtctgatcatataggaaatatatgcagaacattttaaagaaaatgcctggctgggcacagtggctcacacctgtaatcccagcactttgggaggctgaggcgggtagctcacttgaggtcaggagtttgagaccagcctggccaacatgatgaaaccctgtcactactacaaataaaaaattagccaggcatggtggtgagcacctgtaatgccagctactcgggaagctgaggctggagaatcgcttgaacccaggaggtggtggttgtagtgaaccaagatcacaccactgcactccagcctgggcaacagagtgagactctgtgtctaataaaaaaaaaaaaagaaaagaaaagaaaaaatgcttaaagtgcctagaacttagaattctttcattgcacatttccagaaatatttttcttttcttttttttttttttttttgagatggagtctcgctctgtcccccaggctggagtgcagtggcactatcttggctcactgcaacctccacctcccgggtttaagcgattctcctgcctcagcctcctgagtaactgggactacaggcacatgccaccacgcccagctaatttttgtatttttagtagagatggggtttcactatgttggccaggctggtcttgaactcctgacctcaggtgatccacccgccttggcctcccaaagtgctgggattacaggcgtgagccaccgtgcccggccttccagaaatatttttcaaaggactagtaatctaatagcctatagtttatattattattttgtattatttgcacgctgttacatagtatataatgataatgttttctacagtgaaagagctatcccgtcttccctttacaactgtctgaactttatttactcattagtcaaggttctttgcaaggcaggtgattaacttaaatatctcagtttatacagtggtttaaaagacttttgttatggtaatagggagagaaacttgtcagataggctaaaatctagataattctacatattctgaggaattcatgctcctgtggctcttgcttataaatatcttggaatgtttctgaatgcctctaagcctatgttcagactctgttgcgtcaatgactggtagtatttctttcattaatatgtttgtcatctggtctgcaagatagggttggatgaatatacttaacactactgaactgtacacttaaagatcgttaggaaggaaacgggactacatcaaacttaaaaatgtctgtgtgtcaaaggaagcaatcaacaaagtgaaaacgcaagctctagaatgagagaaaataattgcaaatcgtctatcttataaggagcccaaatccagaatatatgaggaacttctacaactcaacaacaaaaaaccaaataactcaatttttaaaaatgggcaaaggacttgcacagacatttctccaaagaagttatacaattggccaataagaacatgaaaatatgctcaacattgccaattattagggaaatgcaaatcaaaaccacaatgagatatcgtctcacgcccatcatgatggccactatcagaagaacaaaaaaataacaagtattggggaggatgcagagaagttgaaacccttgtgcactgttggtggtaatgtaaaacggtgcagtcattacggaaaacagtacacaggtttcccaaataactgaaaacagaattaccataagaattaccaccaaagcgggatctcaaagagatatttgtacacccatgttcatagcagcattattcacaatagccaagaggttctggaagcatcccaaatgtccatcaacagatgaatagataaaggaaatgtggtatatacagtcaatggaatattattcagcctttaaaaagaaggaaatcctgtcaaatgtacaatgtggatgaaccttgaaggcattatgccaagtgaaataagccagccaacaaaagaacaaatgctatatgattcctccatgtgaagtatgcaaagtagtcaaaatcatacaatagaaagtagaaaggtggttgccaagcaacggttgggggaaggggagagggtgaatttgtatttagtgggtacagagcttgtgttgcaagaattctagagatctgttgcaaaacaagtgtgattgtacttaacactactgaactgtatacgtataagtttgagaaatatctcttttaaaaagggggaaatgtgaaggcttttgcatgtatgccctaggaaatgcatagaattcttagaaaggtaaacatggtaaaaaaagaagtctttgttaactttctgcagttcacctgtttcaaagtatagttacctttaaaagggtaaacacacaagatatgcattttccaaagcatacaggctttcctcctagctgtcttgttttttatttttttttattttttttatttttttgagacagagtcgcgctgtcacccgggctggagtgcagtggcgcgatctcggctcactgcaagctccgcctcccgggttcacgccattctcctgcctcagcctcctgagtagctgggactacaggcgcccgccaccacacccggctattttttgtattttaagtagagacagggtttcaccgtgttaaccaggatggtctcgatctgacctcgtgatccacccgtcttggcctcccaaagtgctgggattacaggtgtgagccactgtgcctggccttcctagctgtcttgtgaaacgataagtcaaaaccctactgcagtgagttttccaaactgaagggagaagcaatgtacagaatgcctgacttgcccttacatcttatacctggtgttctggcatgattattaaccacactctttttcactttgaaccatgtcctggtttgcatggccagcttccctgcagaggtgatagaaactgacttgaggcagtttctttctccatgccttagttagatgaccctcaaaggggcacagcagatttccctggctactgatacaccttaacaagaagcttgtgttttttatgccctcaaaagtgttttacttatactttcctagacataaaggtggaaaatgggcctaaggtctgtcaaaggtcttggaaaagaagattgtattaaaattgctgtccgtcttcattaaataatactagatcgatacaatgctttctttacagtattagtggttggtgaaagacttccttcctattgttacagtatatgtatatatctgtaaaattaatgagatatcctttaacttgtagattagaaagcgactaaaaactcataggggatttactaaagaagcaacaatgggaagaagcagccgatcctcctcagtgcacctttttctgttgcacagtacagtgcacagtgtgctggcatcaccatatagggcaagctgtgaccgcctttctcctttcccagggctacatggtgccaagcaggttcagtgtacactggttaccaacctgtctgattccattgtgacagaacacactcacacccaatacattacatgaagcagatttattacttacagacaggaagcaagggacaaaagaggccctggctccattgtgagccagtcccccagggctcaagaaagctgcccagggcggggctgatggagtcttgattgtacgtgccccacttgcaccacagcctgccttgggttatataccataggagccacataactcattgggcaaagctttaaagtacatcctccttccaggggaaagaggaacacaacctcgctgtctcaaacagttccctaaatcaagatgttacattccctaggagggacaacaacaaggccaacctgtttcaggcagttcctccatatcaggatattgcattcccagtgcattctacagttattcttaagaactacaagcaaggaagaagggagaactgggtcagtccaaggccacctggagaactgtcttgtacatgggttagggtaaagttggctattctaaaactaagcatccgcccaaaagaagtcttggaagatgtctttccctgttaaattcagatgatggtaattatagtttggaagtggaattggcttttagagttacttcctgtaatgaaattaacaagcaattcaggcctatttctgaaaatgaattcagtggttaattgttaaaaataaatgtctaactcct

SEQ ID NO: 4564 - DNA, 2205 bp, Homo sapiens
gattattaagttcctgcaacttaactgggaactgatcaagatttcaagctaaagatggtggtgatgaacagcctgagggtcattcttcaagcctctccaggcaaattgctgtggagaaagttccagattccgagattcatgccagcgaggccctgcagcctctatacttgtacttacaaaacccggaaccgagccttgcatccactctgggagagcgtggacctggttcctgggggcgatcgccagtcacccatcaacattcggtggagggacagtgtttatgatcccggcttaaaaccactgaccatctcttatgacccagccacctgcctccacgtctggaataatgggtactctttcctcgtggaatttgaagattctacagataaatcagtgatcaagggaggacccctggaacacaactaccgattgaagcagttccattttcactggggggccatcgatgcctggggttctgagcacaccgtggacagcaaatgcttcccagcagagctgcacttagtgcattggaacgcagtcagatttgaaaactttgaggatgcagcactggaagaaaatggtttggctgtgataggagtatttttaaagctaggcaaacatcataaggagctacagaaattagtggatactttgccgtcaattaagcataaggacgcccttgtggaatttgggtcatttgacccttcctgcctgatgcctacctgcccagattactggacctactcagggtctctgactaccccacccctctccgagtctgtcacctggatcattaagaagcaaccagtagaggttgatcatgatcagcttgagcaatttcggaccctgcttttcacttccgaaggggagaaagagaaaagaatggtggacaacttccgcccccttcagccactgatgaatcgcactgttcgttcatccttccggcatgattatgtgctgaatgtacaagcgaaacccaagccggccaccagccaagcaaccccctaaaacattcatatctaggcagtattttgcttttgctttaatatatactagcttactataaattgttaactagactattctaagtgcctgcatttgataatatttacagatgtgcatttcttagcatgagagtgcttcatcagtctttgaggaaggctattcggtaccagcaagagacacaagtttctcttacagatacctgttggtaattgtaatgccttttttttttctttaagagactaggtcttgctctgctgcccaggctagagtgcagtggccaaatgatagctcactgcagccttgaactcctaggctcaagcagtcctcctgccttagcctctagagtagctggggctacaggtgctggccgcctggcccagcttgtaatatctttttatgtctgacatttttgagctatctttttatgtttatccattagtggttctatagcactatacatagggattataatcaaaatttttaacatgtggtaaggcacagacactgaccagaactcaggccttgcagaaacagcctatgggcccagactggtacttcctggctgaatattggccatggttttagatgtattttattttataacatgaatgtgtattctttcataagggcttatcagtcagtatatttgccccagtgtttagttgttacaaggacatgatatgcttacttactatcagtttatgatgtagaaaatatattttgtaattataagaaaacaagacttttcctatacccagaaatccctttgcatttccgaagatcagatattttgcttaaaggtctgatcatataggaaatatatgcagaacattttaaagaaaatgcctggccttccagaaatatttttcaaaggactagtaatctaatagcctatagtttatattattattttgtattatttgcacgctgttacatagtatataatgataatgttttctacagtgaaagagctatcccgtcttccctttacaactgtctgaactttatttactcattagtcaaggttctttgcaaggcaggtgattaacttaaatatctcagtttatacagtggtttaaaagacttttgttatggtaatagggagagaaacttgtcagataggctaaaatctagataattctacatattctgaggaattcatgctcctgtggctcttgcttataaatatcttggaatgtt

SEQ ID NO: 4565 - DNA, 529 bp, Homo sapiens
agaggtttctccatcatcttaagtttctgttgtttacagctttccctcctctgccctcatccctctagattattaagttcctgcaacttaactgggaactgatcaagatttcaagctaaagatggtggtgatgaacagcctgagggtcattcttcaagcctctccaggcaaattgctgtggagaaagttccagattccgagattcatgccagcgaggccctgcagcctctatacttgtacttacaaaacccggaaccgagccttgcatccactctgggagagcgtggacctggttcctgggggcgatcgccagtcacccatcaacattcggtggagggacagtgtttatgatcccggcttaaaaccactgaccatctcttatgacccagccacctgcctccacgtctggaataatgggtactctttcctcgtggaatttgaagattctacagataaatcagtgatcaagggaggacccctggaacacaactaccgattgaagcagttccattttcactggggggccatc

SEQ ID NO: 4566 - DNA, 488 bp, Homo sapiens
ggaatttgaagattctacagataaatcagtggcactatcacaacagagtgacataatggtgggataacatggacacttgtcttcttccttactgtaatgggactatttctactccacataatctgcacagtgctcgacatgagataatcactcactgttccttcagttcaggactggaaatcaatggaaaggaagaacagttaagattattaagttcctgcaacttaactgggaactgatcaagatttcaagctaaagatggtggtgatgaacagcctgagggtcattcttcaagcctctccaggcaaattgctgtggagaaagttccagattccgagattcatgccagcgaggccctgcagcctctatacttgtacttacaaaacccggaaccgagccttgcatccactctgggagagcgtggacctggttcctgggggcgatcgccagtcacccatcaacattcggtggagggacagtgtttatga

SEQ ID NO: 4567 - DNA, 564 bp, Homo sapiens
tcttcattacagatgtgcagcaccatgagggccctggtgcttctgctgtccctgttcctgctgggtggccaggcccagcatgtgtctgactggacctactcagaaggggcactggacgaagcgcactggccacagcactaccccgcctgtgggggccagagacagtcgcctatcaacctacagaggacgaaggtgcggtacaacccctccttgaaggggctcaatatgacaggctatgagacccaggcaggggagttccccatggtcaacaatggccacacagattggcaggcggaactcttcctcccctccttgtcctctccttgtggagaaggggcgaagcacaaaggccaaaggcagtggctttgttcaccctccctggacagctggtgggaagcaatcattgatggaggatctctatgggcaacgcttgctgagtgcgggcttcgtgctgagggcccagaagagggaaggcatatggaagagaagagcccagcttcccaaggggcttgcagcggctcccgcctcccaatttccagaggaccctgtaccttcttcctttag

SEQ ID NO: 4568 - DNA, 942 bp, Homo sapiens
atgagggccctggtgcttctgctgtccctgttcctgctgggtggccaggcccagcatgtgtctgactggacctactcagaaggggcactggacgaagcgcactggccacagcactaccccgcctgtgggggccagagacagtcgcctatcaacctacagaggacgaaggtgcggtacaacccctccttgaaggggctcaatatgacaggctatgagacccaggcaggggagttccccatggtcaacaatggccacacagtgcagatcagcctgccctccaccatgcgcatgacagtggctgacggcactgtatacatagcccagcagatgcactttcactggggaggtgcgtcctcggagatcagcggctctgagcacaccgtggacgggatcagacatgtgatcgagattcacattgttcactacaattctaaatacaagagctatgatatagcccaagatgcgccggatggtttggctgtactggcagccttcgttgaggtgaagaattaccctgaaaacacttattacagcaacttcatttctcatctggccaacatcaagtacccaggacaaagaacaaccctgactggccttgacgttcaggacatgctgcccaggaacctccagcactactacacctaccatggctcactcaccacgcctccctgcactgagaacgtccactggtttgtgctggcagattttgtcaagctctccaggacacaggtttggaagctggagaattccttactggatcaccgcaacaagaccatccacaacgattaccgcaggacccagcccctgaaccacagagtggtggaatccaacttcccgaatcagggcaagggccacggggggcatcgtgggagaagccaaaatccaagagtacagcccacctcaacacgccaccccttggctctgggcagcttagaagcctga

SEQ ID NO: 4569 - DNA, 1319 bp, Homo sapiens
caccatgagggccctggtgcttctgctgtccctgttcctgctgggtggccaggcccagcatgtgtctgactggacctactcagaaggggcactggacgaagcgcactggccacagcactaccccgcctgtgggggccagagacagtcgcctatcaacctacagaggacgaaggtgcggtacaacccctccttgaaggggctcaatatgacaggctatgagacccaggcaggggagttccccatggtcaacaatggccacacagtgcagatcagcctgccctccaccatgcgcatgacagtggctgacggcactgtatacatagcccagcagatgcactttcactggggaggtgcgtcctcggagatcagcggctctgagcacaccgtggacgggatcagacatgtgatcgagattcacattgttcactacaattctaaatacaagagctatgatatagcccaagatgcgccggatggtttggctgtactggcagccttcgttgaggtgaagaattaccctgaaaacacttattacagcaacttcatttctcatctggccaacatcaagtacccaggacaaagaacaaccctgactggccttgacgttcaggacatgctgcccaggaacctccagcactactacacctaccatggctcactcaccacgcctccctgcactgagaacgtccactggtttgtgctggcagattttgtcaagctctccaggacacaggtttggaagctggagaattccttactggatcaccgcaacaagaccatccacaacgattaccgcaggacccagcccctgaaccacagagtggtggaatccaacttcccgaatcaggaatacactctaggctctgaattccagttttacctacataagattgaggaaattcttgactacttaagaagagcattgaactgaggaaagctaagaggaagattcaatattaactagcttgaagcctgacctagccagaagtgcctgtccgctgcagccgcaccctaccttgtctaagaaaccatgtgtgtctggaacacgctgctccccctggggcagctgttgggattctgattaaaagaggggaaacgatcatcctggacaggaagtgagatggcttcagttcatgagacgggatctgagttagacatcaccagtggaaattgattggaatagaaacttaaaggaaatggaaccctaactattctcccatcaaatcatatatgttgacctgtctgaattataaaccagcctgacctttcctttagcattagatgtaataaaataactttggaaatttgtcatttaaaaa

SEQ ID NO: 4570 - DNA, 1555 bp, Homo sapiens
ccgctgctttaagaggctgctccgcggtagcgagcggggccggagccgcagcccgaacgagcggaccgagccgaccgggcaggtgcacggctgcggggacggcagcggcatgaccggccaccacggctggggctacggccaggacgacggcccctcgcattggcacaagctgtatcccattgcccagggagatcgccaatcacccatcaatatcatctccagccaggctgtgtactctcccagcctgcaaccactggagctttcctatgaggcctgcatgtccctcagcatcaccaacaatggccactctgtccaggtagacttcaatgacagcgatgaccgaaccgtggtgactgggggccccctggaagggccctaccgcctcaagcagtttcacttccactggggcaagaagcacgatgtgggttctgagcacacggtggacggcaagtccttccccagcgagctgcatctggttcactggaatgccaagaagtacagcacttttggggaggcggcctcagcacctgatggcctggctgtggttggtgtttttttggagacaggagacgagcaccccagcatgaatcgtctgacagatgcgctctacatggtccggttcaagggcaccaaagcccagttcagctgcttcaaccccaagtgcctcctgcctgccagccggcactactggacctacccgggctctctgacgactcccccactcagtgagagtgtcacctggattgtgctccgggagcccatctgcatctctgaaaggcagatggggaagttccggagcctgctttttacctcggaggacgatgagaggatccacatggtgaacaacttccggccaccacagccactgaagggccgcgtggtaaaggcctccttccgggcctgagctgcccatctgcctagccggccactagggcaccatcttctcaagggcttccatgtcagcagacaccaaaccatctgaggcttcctccctggggggtgctggggaccctccttcagccagtttgctccttggtcaccctggaggcttctggatgggacccttgagtctggggcacccttcagctgccctggggacaggaaggacaggagctaagcagggtccaagcctggggctgcctctgctctccaagacccaaagaccctgggaacctcctctggtcttccccactggcagtggcagcagccccaccccgagcgcacactgtgatggaggagactgagctccctggggcgggcagctgacactaccagagagactcaagcaataattagaggtgggcagagctgccctctcggcattacctcttctgcaggctctgccatgcacgcacctcactgccaggccattaaaatcagcacccagcatgctggaggtgacgtggccttctccctccagccacctgctgccacgggcaggccctggctatagcttatacagtatctccccttgtccccacccagtcaccaaagccacctacatgacagtccatccctgttgaattaataaattaatgtatccatgcaacaaata

SEQ ID NO: 4571 - DNA, 1713 bp, Homo sapiens
cggcaagtgagcggggacctcgggggagcggggctccgcgtggcaagggcgcagtgtcccccggagagaatttccccgcagaagtggccgagctgccttctcggccggtacgtgagggaagggggcacttgggggcgcaagcatgtgtctgggtgtctacaccgagcagggtgtttgcgcacgtccgggtgtgagtcgtgggagcccgtggcccacaccagcctcctgggctgacgcggaagagagctccttcatcctgcctcagtttccttaggactcagagaaagggagaagaggcagaaggcccctcgcattggcacaagctgtatcccattgcccagggagatcgccaatcacccatcaatatcatctccagccaggctgtgtactctcccagcctgcaaccactggagctttcctatgaggcctgcatgtccctcagcatcaccaacaatggccactctgtccaggtagacttcaatgacagcgatgaccgaaccgtggtgactgggggccccctggaagggccctaccgcctcaagcagtttcacttccactggggcaagaagcacgatgtgggttctgagcacacggtggacggcaagtccttccccagcgagctgcatctggttcactggaatgccaagaagtacagcacttttggggaggcggcctcagcacctgatggcctggctgtggttggtgtttttttggagacaggagacgagcaccccagcatgaatcgtctgacagatgcgctctacatggtccggttcaagggcaccaaagcccagttcagctgcttcaaccccaagtgcctcctgcctgccagccggcactactggacctacccgggctctctgacgactcccccactcagtgagagtgtcacctggattgtgctccgggagcccatctgcatctctgaaaggcagatggggaagttccggagcctgctttttacctcggaggacgatgagaggatccacatggtgaacaacttccggccaccacagccactgaagggccgcgtggtaaaggcctccttccgggcctgagctgcccatctgcctagccggccactagggcaccatcttctcaagggcttccatgtcagcagacaccaaaccatctgaggcttcctccctggggggtgctggggaccctccttcagccagtttgctccttggtcaccctggaggcttctggatgggacccttgagtctggggcacccttcagctgccctggggacaggaaggacaggagctaagcagggtccaagcctggggctgcctctgctctccaagacccaaagaccctgggaacctcctctggtcttccccactggcagtggcagcagccccaccccgagcgcacactgtgatggaggagactgagctccctggggcgggcagctgacactaccagagagactcaagcaataattagaggtgggcagagctgccctctcggcattacctcttctgcaggctctgccatgcacgcacctcactgccaggccattaaaatcagcacccagcatgctggaggtgacgtggccttctccctccagccacctgctgccacgggcaggccctggctatagcttatacagtatctccccttgtccccacccagtcaccaaagccacctacatgacagtccatccctgttgaattaataaattaatgtatccatgcaacaaataccaa

SEQ ID NO: 4572 - DNA, 3812 bp, Homo sapiens
cgctcgctccccaggccacagccgctccctcgctctgctggggcctccggacgcgcttcccacgcgggtctctggaacactcggtccgaacgcacgcctgcttgcactcacactgcggttcacacccggaggcgctctcgcactcacactgccgctcacgcgtgctcacactcccccacgcgcgctccgctccggctccagccccgcgcccagcgaaggcgcaggcactgctgccgagagcgccgaggggccccgcggccttcccatggcggacctgagcttcatcgaagataccgtcgccttccccgagaaggaagaggatgaggaggaagaagaggagggtgtggagtggggctacgaggaaggtgttgagtggggtctggtgtttcctgatgctaatggggaataccagtctcctattaacctaaactcaagagaggctaggtatgacccctcgctgttggatgtccgcctctccccaaattatgtggtgtgccgagactgtgaagtcaccaatgatggacataccattcaggttatcctgaagtcaaaatcagttctttcgggaggaccattgcctcaagggcatgaatttgaactgtacgaagtgagatttcactggggaagagaaaaccagcgtggttctgagcacacggttaatttcaaagcttttcccatggagctccatctgatccactggaactccactctgtttggcagcattgatgaggctgtggggaagccgcacggaatcgccatcattgctctgtttgttcagataggaaaggaacatgttggcttgaaggctgtgactgaaatcctccaagatattcagtataaggggaagtccaaaacaataccttgctttaatcctaacactttattaccagaccctctgctgcgggattactgggtgtatgaaggctctctcaccatcccaccttgcagtgaaggtgtcacctggatattattccgataccctttaactatatcccagctacagatagaagaatttcgaaggctgaggacacatgttaagggggcagaacttgtggaaggctgtgatgggattttgggagacaactttcggcccactcagcctcttagtgacagagtcattagagctgcatttcagtagccaaagaggacaggaacaagtctgtcttcatgagggaggaagacaatggtcctataatgcccttggataagaaaaggaaacttttgagctgcaccttcagtttatcctcaaagcctgcgttgtttgtcttcatctaatccagctttgatggacatctgtgatggttgcctgtacacttgctgaaatgaaatattagaaatggctgtatattccaaagaaaccctatattatatatccacattactgctgctaggattcatagttgcacatactgtttattgcttatgtgtagaaggaatgaaactagtttccagagttgttattaatatgaatatatatcatgtgttaatattgagaaaggaaaaatacattcccggtgttagtagttcttcatttcctgtctccaacagaaaattcactcattttagaactagtgtaattcttgataataaaataagagttttgattaagaacagcatagagcttcaaaatgcaaagtgaatgattagtaaaattatgtctcattttattttttcagcacccataccacaattaatattaggctggattgccatgggaaacattttttggcattaatgcagcaacataatactcactttaggtattactacatagttgaaggatttaactgaatgtatggatcaaatttatttatttgacatattcgaagctgtggtttaataggaatttgagaaaggtgtaagaaataggataaaaagaaggtcagcaccatgtaccaggaatagctttactttccatacatagaaatataaatttagtggtatcctatattactttagtgtcgtacgctttgtaagacttaaatattttattctattgattccactactttggtatgttaagacatttctttaaagatgaccaacaatatccttattttaggtgccactagcagatgtaagcgtatacttagttgccgttagatgtgacagaatgagataatttatgtaaagcagtagagtacctggcacaaagcaaacaataaatattattgttattgttgttataattgtaaaatgaatgacttcaaaaacatagtcccagtttggagggattttgtgatgcagaatatctaagtcatagaaatagaagacaggtggaataagtatatgttcagagtttttagatgtgttgagtagagacggtaataatggaagcattaaatacaaatgaaaatcacaccagatatccctgaaattcaagcaaagaaagttcatcatgtattcttgggcagcaagagaaaggactagggttatggcaatgtgtggaaaagttgaggcttgctaagggttgagatctgttggtagccctggatcacatggggtcagcaccaggcagtgcctctgaaagcggagagaggtcctggacttcccttgtgtataacagttcctagtgtccaacaatgaggaaacggtgaagcatggttacaaaactgtgacaaaaatatttacatctagcactgttaccactcacatgccaaacattggctgcacacgtgcagccttatttgtaattaacatcaaaagactagatctgaagccttccataaatgagaggccattcatatggcattcctggaacaaaacactgcacaggtaccagcctctccactcctgaccgggttggtgctgaacagtcagggattgttcttgaactagacttctgatgcttcttgcaatcttctttcatctttccctgaaatacacaaaataaacaaatacaataacaaatagtaattaaatgactttcaggataacatctagttgttcagacttcacccttcacaggtgtgtgtgtatgtgtgtttatgtctgtatattgaagcaatttgaatttatttactgtatattttctgagtaaaagactgaaatgaactacttggttcagatcatggtgtccattggtgacattgtttggaggcataatattctttatatggaaaatcctttaattccacagttagttacctcagattcagaatatgaatactgtttataatacgcttttgtaggaatgaatttgaaaggtagtttgtcagtaaacgaaagcacaacaactaatctcaaatctgttttgatggtgtgataggaaagaaagtaaaacctatgtgatggaccctgtaattggggcaggaatctcccaaagaaaaaggggagaattaatgacaaatgtcatagatcttgaaatttaatttagggtgcattttgtttatgaaacaatttaataaggcaacaaagtgaaatgatttttcatgtagcttatacacatgtaagtgcctctgattcatggtaactaacgtacctgatggtgtgtaaagtaatactgttgtcagaaggtttgccaattaagataatttgagtttactctttttttgttggttagtttagctgaaggcttgtcaattttattgatttttttcaaggagccaaagtggattttggggttttctctattgtgtttgtattctctatgtcatcaaactctgctcaaatcttacaaaatagtaagattagtaagaaagcagactaacttctgcttgctttgtatttagtttgtgtcttttccagtattttaaggtggaaggttaggttattgatttgaattcttttttgaataaaggcattaacagtta

SEQ ID NO: 4573 - DNA, 3369 bp, Homo sapiens
ttcaattcccctgcatccacactgcaaccgggtgcaagtctttcctaggttatagacagcccgcctccccacgagaccttctgcggactggctgcccctggcctcggcctgggtgggtgggtggtgctcgcgccgcccctactttcccctggggccctggagagccgcgcgctgggtgtgtgtgtgtgtgcgcgcgcgggtttggtggggaaatctccttcagtggaagctgctgagtgtcgttggcggaaagtatcctggagcccagcaaaagcctccaaagcactagagcttccctaaagaaaagcagaataaaagaaagacaagaagggaagcccgttcctctaaagcccgggtttccaatagtcccggatcctcctggagttgggcgaaggcgcagttggcagcagccgctgctggcacccggacttggaaaggcggtgttcccccttttcgggaggagggaggcagggacttgcaggcaagagttgcacctggtctaggaacctgcagagaaaagaactctggggagaagaactgccccggagcgcagcagccaccctccgaccatgccccggtgaggggggcggacttcgagggcaacttgccgcggactgcctgggcttagccagcgagctacgcgctcccgggagcccggaattgcacggcgcagcccggcggggggctatcgtctatgtcttcttggggcgccagacgaatcggggtctcgtttttgctggaagagcccagtgttggtggcttcaggtggctgctgccgccgccgccgccgccgccgctgctagtgcggtttccgccgctggtgcgaagagaagagacacgcgagcggggagacctccaaggcagcgaggcatcggacatgtgtcagcacatctggggcgcacatccgtcgagcccgaggggagatttgccggaacaattcaaactgcgatattgatcttgggggtgactgtccctggccggctgtcgggtgggagtgcgagtgtgcactcgctcggaagtgtgtgcgagtgtgtatgtgtgtgtgccgtgtcgggctccccccttccccccgttttcccgtcgagtgatgcacttggaatgagaatcagaggatggaaatagtctgggaggtgctttttcttcttcaagccaatttcatcgtctgcatatcagctcaacagaattcaccaaaaatccatgaaggctggtgggcatacaaggaggtggtccagggaagctttgttccagttccttctttctggggattggtgaactcagcttggaatctttgctctgtggggaaacggcagtcgccagtcaacatagagaccagtcacatgatcttcgacccctttctgacacctcttcgcatcaacacggggggcaggaaggtcagtgggaccatgtacaacactggaagacacgtatcccttcgcctggacaaggagcacttggtcaacatatctggagggcccatgacatacagccaccggctggaggagatccgactacactttgggagtgaggacagccaagggtcggagcacctcctcaatggacaggccttctctggggaggtgcagctcatccactataaccatgagctatatacgaatgtcacagaagctgcaaagagtccaaatggattggtggtagtttctatatttataaaagtttctgattcatcaaacccatttcttaatcgaatgctcaacagagatactatcacaagaataacatataaaaatgatgcatatttactacaggggcttaatatagaggaactatatccagagacctctagtttcatcacttacgatgggtcgatgactatcccaccctgctatgagacagcaagttggatcataatgaacaaacctgtctatataaccaggatgcagatgcattccttgcgcctgctcagccagaaccagccatctcagatctttctgagcatgagtgacaacttcaggcctgtccagccactcaacaaccgctgcatccgcaccaatatcaacttcagtttacaggggaaggactgtccaaacaaccgagcccagaagcttcagtatagagtaaatgaatggctcctcaagtagggaacaaagccaagaagaatcccacctcagtgaaatgctacaactgtgaattgacgtaacctagaatgtcccccttcttgcttctctctccttctttcccccaagcctcattcattcttgggattggccctttcttcatgaaaagtgtctgcaaaaccatggcagaggaatacatctctcacacatactcacaaacacacacacaagcacttgcacatacatacaaacacatgcaaacatacctacacacacacacactcttacaacctccatcatgggaagtcaagtttcagaaacaaaagtctcattcataagaggtcttagaagaaaataaccagttaacctgatttcaattttgataccgttttcctgaactaataaatctacccaatgagacttttcagcctttgtacatacaaaattcttccaaaagagagaggagaaaatacagctctgatggcatcaaacggactttgcatcaagtaatttcagatagtgtcctaggatcctttgagggtgctggtagcaggtgagcaggacaaagttgaccaaggacacttatttctagattatgattcttctgtttactcaacaatttacaaagaaaaaaaggacagacattgaagagctacacattgtatatatatcaccacagactataaggaaatggaattatttccctctttgtcacatatctgtagtaggatttgccaagatcagaaatgatccatttgctgtttcttgttttccaaaggtcatacattgtgtttggttattgttaccagctcaataaatgtgtttaacgagttaatttcatttttctggctttggtctgttctccttccttacaggctaagccctggctccatgcaactgcattctttgatttcacttgttccttcatctacatgttttgttcatttgcagccagtttttactgagtttgtggcaatcaggaatgcatttgctaagcaagtatgactttaattccactccatggctcaatcattcacatgaggtgagcttcagcctgagatagcaggcgacagacttcttgcgtttcaaaactgccatgcccccctgtgatgctcccgtgaaggaatgcactttgccttgtaagttcctgggaaaggggtatgttttctctccaggtgcagccagatctcacaaagtacaaaacgaatgcctttcttttcttgtttataatggtcactcactgtgtttggttactgtcaagaaatcaataaatgtgtttaacaagttacccagt

SEQ ID NO: 4574 - DNA, 2698 bp, Homo sapiens
acacgcgagcggggagacctccaaggcagcgaggcatcggacatgtgtcagcacatctggggcgcacatccgtcgagcccgaggggagatttgccggaacaattcaaactgcgatattgatcttgggggtgactgtccctggccggctgtcgggtgggagtgcgagtgtgcactcgctcggaagtgtgtgcgagtgtgtatgtgtgtgtgccgtgtcgggctccccccttccccccgttttcccgtcgagtgatgcacttggaatgagaatcagaggatggaaatagtctgggaggtgctttttcttcttcaagccaatttcatcgtctgcatatcaggcgacctcaggagggcagtcaggaggctctggtggcagtctgggttggagatgcaggtaacctgttgaaggtgatggcacacatggagagcaatggccagcatcaggagccgttcaggatgtggattcacagagcctgatgaactgtgtatggtgggggtgagggagaatgctcaacagaattcaccaaaaatccatgaaggctggtgggcatacaaggaggtggtccagggaagctttgttccagttccttctttctggggattggtgaactcagcttggaatctttgctctgtggggaaacggcagtcgccagtcaacatagagaccagtcacatgatcttcgacccctttctgacacctcttcgcatcaacacggggggcaggaaggtcagtgggaccatgtacaacactggaagacacgtatcccttcgcctggacaaggagcacttggtcaacatatctggagggcccatgacatacagccaccggctggaggagatccgactacactttgggagtgaggacagccaagggtcggagcacctcctcaatggacaggccttctctggggaggtgcagctcatccactataaccatgagctatatacgaatgtcacagaagctgcaaagagtccaaatggattggtggtagtttctatatttataaaagtttctgattcatcaaacccatttcttaatcgaatgctcaacagagatactatcacaagaataacatataaaaatgatgcatatttactacaggggcttaatatagaggaactatatccagagacctctagtttcatcacttacgatgggtcgatgactatcccaccctgctatgagacagcaagttggatcataatgaacaaacctgtctatataaccaggatgcagatgcattccttgcgcctgctcagccagaaccagccatctcagatctttctgagcatgagtgacaacttcaggcctgtccagccactcaacaaccgctgcatccgcaccaatatcaacttcagtttacaggggaaggactgtccaaacaaccgagcccagaagcttcagtatagagtaaatgaatggctcctcaagtagggaacaaagccaagaagaatcccacctcagtgaaatgctacaactgtgaattgacgtaacctagaatgtcccccttcttgcttctctctccttctttcccccaagcctcattcattcttgggattggccctttcttcatgaaaagtgtctgcaaaaccatggcagaggaatacatctctcacacatactcacaaacacacacacaagcacttgcacatacatacaaacacatgcaaacatacctacacacacacacactcttacaacctccatcatgggaagtcaagtttcagaaacaaaagtctcattcataagaggtcttagaagaaaataaccagttaacctgatttcaattttgataccgttttcctgaactaataaatctacccaatgagacttttcagcctttgtacatacaaaattcttccaaaagagagaggagaaaatacagctctgatggcatcaaacggactttgcatcaagtaatttcagatagtgtcctaggatcctttgagggtgctggtagcaggtgagcaggacaaagttgaccaaggacacttatttctagattatgattcttctgtttactcaacaatttacaaagaaaaaaaggacagacattgaagagctacacattgtatatatatcaccacagactataaggaaatggaattatttccctctttgtcacatatctgtagtaggatttgccaagatcagaaatgatccatttgctgtttcttgttttccaaaggtcatacattgtgtttggttattgttaccagctcaataaatgtgtttaacgagttaatttcatttttctggctttggtctgttctccttccttacaggctaagccctggctccatgcaactgcattctttgatttcacttgttccttcatctacatgttttgttcatttgcagccagtttttactgagtttgtggcaatcaggaatgcatttgctaagcaagtatgactttaattccactccatggctcaatcattcacatgaggtgagcttcagcctgagatagcaggcgacagacttcttgcgtttcaaaactgccatgcccccctgtgatgctcccgtgaaggaatgcactttgccttgtaagttcctgggaaaggggtatgttttctctccaggtgcagccagatctcacaaagtacaaaacgaatgcctttcttttcttgtttataatggtcactcactgtgtttggttactgtcaagaaatcaataaatgtgtttaacaagtt

SEQ ID NO: 4575 - DNA, 2934 bp, Homo sapiens
acagttcccaatcgggacaagcgcgccgagaaatcctggatcttcccagggattccctctacgctccctcctcttcttcaataaccccaaagaggagaagaactgccccggagcgcagcagccaccctccgaccatgccccggtgaggggggcggacttcgagggcaacttgccgcggactgcctgggcttagccagcgagctacgcgctcccgggagcccggaattgcacggcgcagcccggcggggggctatcgtctatgtcttcttggggcgccagacgaatcggggtctcgtttttgctggaagagcccagtgttggtggcttcaggtggctgctgccgccgccgccgccgccgccgctgctagtgcggtttccgccgctggtgcgaagagaagagacacgcgagcggggagacctccaaggcagcgaggcatcggacatgtgtcagcacatctggggcgcacatccgtcgagcccgaggggagatttgccggaacaattcaaactgcgatattgatcttgggggtgactgtccctggccggctgtcgggtgggagtgcgagtgtgcactcgctcggaagtgtgtgcgagtgtgtatgtgtgtgtgccgtgtcgggctccccccttccccccgttttcccgtcgagtgatgcacttggaatgagaatcagaggatggaaatagtctgggaggtgctttttcttcttcaagccaatttcatcgtctgcatatcagctcaacagaattcaccaaaaatccatgaaggctggtgggcatacaaggaggtggtccagggaagctttgttccagttccttctttctggggattggtgaactcagcttggaatctttgctctgtggggaaacggcagtcgccagtcaacatagagaccagtcacatgatcttcgacccctttctgacacctcttcgcatcaacacggggggcaggaaggtcagtgggaccatgtacaacactggaagacacgtatcccttcgcctggacaaggagcacttggtcaacatatctggagggcccatgacatacagccaccggctggaggagatccgactacactttgggagtgaggacagccaagggtcggagcacctcctcaatggacaggccttctctggggaggtgcagctcatccactataaccatgagctatatacgaatgtcacagaagctgcaaagagtccaaatggattggtggtagtttctatatttataaaagtttctgattcatcaaacccatttcttaatcgaatgctcaacagagatactatcacaagaataacatataaaaatgatgcatatttactacaggggcttaatatagaggaactatatccagagacctctagtttcatcacttacgatgggtcgatgactatcccaccctgctatgagacagcaagttggatcataatgaacaaacctgtctatataaccaggatgcagatgcattccttgcgcctgctcagccagaaccagccatctcagatctttctgagcatgagtgacaacttcaggcctgtccagccactcaacaaccgctgcatccgcaccaatatcaacttcagtttacaggggaaggactgtccaaacaaccgagcccagaagcttcagtatagagtaaatgaatggctcctcaagtagggaacaaagccaagaagaatcccacctcagtgaaatgctacaactgtgaattgacgtaacctagaatgtcccccttcttgcttctctctccttctttcccccaagcctcattcattcttgggattggccctttcttcatgaaaagtgtctgcaaaaccatggcagaggaatacatctctcacacatactcacaaacacacacacaagcacttgcacatacatacaaacacatgcaaacatacctacacacacacacactcttacaacctccatcatgggaagtcaagtttcagaaacaaaagtctcattcataagaggtcttagaagaaaataaccagttaacctgatttcaattttgataccgttttcctgaactaataaatctacccaatgagacttttcagcctttgtacatacaaaattcttccaaaagagagaggagaaaatacagctctgatggcatcaaacggactttgcatcaagtaatttcagatagtgtcctaggatcctttgagggtgctggtagcaggtgagcaggacaaagttgaccaaggacacttatttctagattatgattcttctgtttactcaacaatttacaaagaaaaaaaggacagacattgaagagctacacattgtatatatatcaccacagactataaggaaatggaattatttccctctttgtcacatatctgtagtaggatttgccaagatcagaaatgatccatttgctgtttcttgttttccaaaggtcatacattgtgtttggttattgttaccagctcaataaatgtgtttaacgagttaatttcatttttctggctttggtctgttctccttccttacaggctaagccctggctccatgcaactgcattctttgatttcacttgttccttcatctacatgttttgttcatttgcagccagtttttactgagtttgtggcaatcaggaatgcatttgctaagcaagtatgactttaattccactccatggctcaatcattcacatgaggtgagcttcagcctgagatagcaggcgacagacttcttgcgtttcaaaactgccatgcccccctgtgatgctcccgtgaaggaatgcactttgccttgtaagttcctgggaaaggggtatgttttctctccaggtgcagccagatctcacaaagtacaaaacgaatgcctttcttttcttgtttataatggtcactcactgtgtttggttactgtcaagaaatcaataaatgtgtttaacaagttacccagt

SEQ ID NO: 4576 - DNA, 3243 bp, Homo sapiens
ctctctgagttgggaagcgtagggatccgtaggcgaggaaataacgacccctgcagttgtattgcggaaaatctcgacagcggcgctagttgcgggcgatggaagccaggcaactgggggttctggggagttcaggaaaatagcagaggagcaggaagggcgcgcgcgacctggagagtctgtgtgcccccaccgcgccccagtccccggggcccagcccttcccctcggcgccctggacgcactgccggaacccggctgagaggctgcaggctgcgcgcggacctggggagcagggagggtcggcggaggctgccggcggctggcggtttcgggcaataatccctgcctctctttctctgtgtgtctgctgtgtctgctccttccccgccccccggaagcaggagaagaactgccccggagcgcagcagccaccctccgaccatgccccggtgaggggggcggacttcgagggcaacttgccgcggactgcctgggcttagccagcgagctacgcgctcccgggagcccggaattgcacggcgcagcccggcggggggctatcgtctatgtcttcttggggcgccagacgaatcggggtctcgtttttgctggaagagcccagtgttggtggcttcaggtggctgctgccgccgccgccgccgccgccgctgctagtgcggtttccgccgctggtgcgaagagaagagacacgcgagcggggagacctccaaggcagcgaggcatcggacatgtgtcagcacatctggggcgcacatccgtcgagcccgaggggagatttgccggaacaattcaaactgcgatattgatcttgggggtgactgtccctggccggctgtcgggtgggagtgcgagtgtgcactcgctcggaagtgtgtgcgagtgtgtatgtgtgtgtgccgtgtcgggctccccccttccccccgttttcccgtcgagtgatgcacttggaatgagaatcagaggatggaaatagtctgggaggtgctttttcttcttcaagccaatttcatcgtctgcatatcagctcaacagaattcaccaaaaatccatgaaggctggtgggcatacaaggaggtggtccagggaagctttgttccagttccttctttctggggattggtgaactcagcttggaatctttgctctgtggggaaacggcagtcgccagtcaacatagagaccagtcacatgatcttcgacccctttctgacacctcttcgcatcaacacggggggcaggaaggtcagtgggaccatgtacaacactggaagacacgtatcccttcgcctggacaaggagcacttggtcaacatatctggagggcccatgacatacagccaccggctggaggagatccgactacactttgggagtgaggacagccaagggtcggagcacctcctcaatggacaggccttctctggggaggtgcagctcatccactataaccatgagctatatacgaatgtcacagaagctgcaaagagtccaaatggattggtggtagtttctatatttataaaagtttctgattcatcaaacccatttcttaatcgaatgctcaacagagatactatcacaagaataacatataaaaatgatgcatatttactacaggggcttaatatagaggaactatatccagagacctctagtttcatcacttacgatgggtcgatgactatcccaccctgctatgagacagcaagttggatcataatgaacaaacctgtctatataaccaggatgcagatgcattccttgcgcctgctcagccagaaccagccatctcagatctttctgagcatgagtgacaacttcaggcctgtccagccactcaacaaccgctgcatccgcaccaatatcaacttcagtttacaggggaaggactgtccaaacaaccgagcccagaagcttcagtatagagtaaatgaatggctcctcaagtagggaacaaagccaagaagaatcccacctcagtgaaatgctacaactgtgaattgacgtaacctagaatgtcccccttcttgcttctctctccttctttcccccaagcctcattcattcttgggattggccctttcttcatgaaaagtgtctgcaaaaccatggcagaggaatacatctctcacacatactcacaaacacacacacaagcacttgcacatacatacaaacacatgcaaacatacctacacacacacacactcttacaacctccatcatgggaagtcaagtttcagaaacaaaagtctcattcataagaggtcttagaagaaaataaccagttaacctgatttcaattttgataccgttttcctgaactaataaatctacccaatgagacttttcagcctttgtacatacaaaattcttccaaaagagagaggagaaaatacagctctgatggcatcaaacggactttgcatcaagtaatttcagatagtgtcctaggatcctttgagggtgctggtagcaggtgagcaggacaaagttgaccaaggacacttatttctagattatgattcttctgtttactcaacaatttacaaagaaaaaaaggacagacattgaagagctacacattgtatatatatcaccacagactataaggaaatggaattatttccctctttgtcacatatctgtagtaggatttgccaagatcagaaatgatccatttgctgtttcttgttttccaaaggtcatacattgtgtttggttattgttaccagctcaataaatgtgtttaacgagttaatttcatttttctggctttggtctgttctccttccttacaggctaagccctggctccatgcaactgcattctttgatttcacttgttccttcatctacatgttttgttcatttgcagccagtttttactgagtttgtggcaatcaggaatgcatttgctaagcaagtatgactttaattccactccatggctcaatcattcacatgaggtgagcttcagcctgagatagcaggcgacagacttcttgcgtttcaaaactgccatgcccccctgtgatgctcccgtgaaggaatgcactttgccttgtaagttcctgggaaaggggtatgttttctctccaggtgcagccagatctcacaaagtacaaaacgaatgcctttcttttcttgtttataatggtcactcactgtgtttggttactgtcaagaaatcaataaatgtgtttaacaagttacccagt

SEQ ID NO: 4577 - DNA, 1653 bp, Homo sapiens
aagggacaagagagaagagagactgaaacagggagaagaggcaggagaggaggaggtggggagagcacgaagctggaggccgacactgagggagggcgggaggaggtgaagaaggagagaggggagaagaggcaggagctggaaaggagagagggaggaggaggaggagatgcgggatggagacctggagttaggtggcttgggagagcttaatgaaaagagaacggagaggaggtgtgggttaggaaccaagaggtagccctgggggcagcagaaggctgagaggagtaggaagatcaggagctagagggagactggagggttccgggaaaagagcagaggaaagaggaaagacacagagagacgggagagagaagaagagtgggtttgaagggcggatctcagtccctggctgctttggcatttggggaactgggactccctgtggggaggagaggaaagctggaagtcctggagggacagggtcccagaaggaggggacagaggagctgagagaggggggcagggcgttgggcaggggtccctcggaggcctcctggggatgggggctgcagctcgtctgagcgcccctcgagcgctggtactctgggctgcactgggggcagcagctcacatcggaccagcacctgaccccgaggactggtggagctacaaggataatctccagggaaacttcgtgccagggcctcctttctggggcctggtgaatgcagcgtggagtctgtgtgctgtggggaagcggcagagccccgtggatgtggagctgaagagggttctttatgacccctttctgcccccattaaggctcagcactggaggagagaagctccggggaaccttgtacaacaccggccgacatgtctccttcctgcctgcaccccgacctgtggtcaatgtgtctggaggtcccctcctttacagccaccgactcagtgaactgcggctgctgtttggagctcgcgacggagccggctcggaacatcagatcaaccaccagggcttctctgctgaggtgcagctcattcacttcaaccaggaactctacgggaatttcagcgctgcctcccgcggccccaatggcctggccattctcagcctctttgtcaacgttgccagtacctctaacccattcctcagtcgcctccttaaccgcgacaccatcactcgcatctcctacaagaatgatgcctactttcttcaagacctgagcctggagctcctgttccctgaatccttcggcttcatcacctatcagggctctctcagcaccccgccctgctccgagactgtcacctggatcctcattgaccgggccctcaatatcacctcccttcagatgcactccctgagactcctgagccagaatcctccatctcagatcttccagagcctcagcggtaacagccggcccctgcagcccttggcccacagggcactgaggggcaacagggacccccggcaccccgagaggcgctgccgaggccccaactaccgcctgcatgtggatggtgtcccccatggtcgctgagactccccttcgaggattgcacccgcccgtcctaagcctccccacaaggcgaggggagttacccctaaaacaaagctattaaagggacagaatacttcctgttt

SEQ ID NO: 4578 - DNA, 6413 bp, Homo sapiens
ggaccagtgacagaccaagggcatgccactgaaggaatccctagacgcacccttctggatgtgagacaggcggatctcacccacgcctgccagcagctcctcggagaactgtgttcctgggtcagccctggcccagaggagcgccggggacccgcagagtgctgctgaagtcaaggctacaactcacctaggatctggggcgccagccctccggtgggcagggcgttctcctcccccaccccctccccgcacgatgacatcaagtgtttggcgttgagttgctccataaaagctgcccggggaagccaggagagcgaagggcggacgtactcgccacggcacccaggctgcgcgcacgcggtcccggtgtgcagctggagagcgagcggccaccgggagcccccggcacagcccgcgcccgccccgcaggagcccgcgaagatgccccggcgcagcctgcacgcggcggccgtgctcctgctggtgatcttaaaggaacagccttccagcccggccccagtgaacggttccaagtggacttattttggtcctgatggggagaatagctggtccaagaagtacccgtcgtgtgggggcctgctgcagtcccccatagacctgcacagtgacatcctccagtatgacgccagcctcacgcccctcgagttccaaggctacaatctgtctgccaacaagcagtttctcctgaccaacaatggccattcagtgaagctgaacctgccctcggacatgcacatccagggcctccagtctcgctacagtgccacgcagctgcacctgcactgggggaacccgaatgacccgcacggctctgagcacaccgtcagcggacagcacttcgccgccgagctgcacattgtccattataactcagacctttatcctgacgccagcactgccagcaacaagtcagaaggcctcgctgtcctggctgttctcattgagatgggctccttcaatccgtcctatgacaagatcttcagtcaccttcaacatgtaaagtacaaaggccaggaagcattcgtcccgggattcaacattgaagagctgcttccggagaggaccgctgaatattaccgctaccgggggtccctgaccacacccccttgcaaccccactgtgctctggacagttttccgaaaccccgtgcaaatttcccaggagcagctgctggctttggagacagccctgtactgcacacacatggacgacccttcccccagagaaatgatcaacaacttccggcaggtccagaagttcgatgagaggctggtatacacctccttctcccaagtgcaagtctgtactgcggcaggactgagtctgggcatcatcctctcactggccctggctggcattcttggcatctgtattgtggtggtggtgtccatttggcttttcagaaggaagagtatcaaaaaaggtgataacaagggagtcatttacaagccagccaccaagatggagactgaggcccacgcttgaggtccccggagctcccgggcacatccaggaaggaccttgctttggaccctacacacttcggctctctggacacttgcgacacctcaaggtgttctctgtagctcaatctgcaaacatgccaggcctcagggatcctctgctgggtgcctccttgccttgggaccatggccaccccagagccatccgatcgatggatgggatgcactctcagaccaagcagcaggaattcaaagctgcttgctgtaactgtgtgagattgtgaagtggtctgaattctggaatcacaaaccaagccatgctggtgggccattaatggttggaaaacactttcatccggggctttgccagagcgtgctttcaagtgtcctggaaattctgctgcttctccaagctttcagacaagaatgtgcactctctgcttaggttttgcttgggaaactcaacttctttcctctggagacggggcatctccctctgatttccttctgctatgacaaaacctttaatctgcaccttacaactcggggacaaatggggacaggaaggatcaagttgtagagagaaaaagaaaacaagagatatacattgtgatatattagggacactttcacagtcctgtcctctggatcacagacactgcacagaccttagggaatggcaggttcaagttccacttcttggtggggatgagaagggagagagagctagagggacaaagagaatgagaagacatggatgatctgggagagtctcactttggaatcagaattggaatcacattctgtttatcaagccataatgtaaggacagaataatacaatattaagtccaaatccaacctcctgtcagtggagcagttatgttttatactctacagattttacaaataatgaggctgttccttgaaaatgtgttgttgctgtgtcctggaggagacatgagttccgagatgacccaatctgcctttgaatctggaggaaataggcagaaacaaaatgactgtagaacttattctctgtaggccaaatttcatttcagccacttctgcaggatccctactgccaacctggaatggagacttttatctacttctctctctctgaagatgtcaaatcgtggtttagatcaaatatatttcaagctataaaagcaggaggttatctgtgcagggggctggcatcatgtatttaggggcaagtaataatggaatgctactaagatactccatattcttccccgaatcacacagacagtttctgacaggcgcaactcctccattttcctcccgcaggtgagaaccctgtggagatgagtcagtgccatgactgagaaggaaccgacccctagttgagagcaccttgcagttccccgagaactttctgattcacagtctcattttgacagcatgaaatgtcctcttgaagcatagctttttaaatatctttttccttctactcctccctctgactctaagaattctctcttctggaatcgcttgaacccaggaggcggaggttgcagtaagccaaggtcatgccactgcactctagcctgggtgacagagcgagactccatctcaaaaaaaaaaaaaaaaaaattattctgtaccatcacaacttttcacaacgatggcaagccttatgtcttgggagcctgttttgctaggcaaagttacaagtgacctaatgggagctcaaatgtgtgtgtgtctctctgtgtgtttgtgtgtgtgtgtgcactcaagacctctaacagcctcgaagcctggggtggcatcccggccttgccattagcatgcctcatgcatcatcagatgacaaggacaaccctcatgacgaagcaacatgaattagggggcctcttggccttggtccaaaattgtcaatcagaaatgaacataaaggactccagagcagtgggactgtctgtcaaaagactctgtatatcttttgtggatgagttttgtgagagaacagagagaccattgtacctggcacaagggctgttcatgaaaagggagacttactgggaggtgcaagacagtggcatttctcctctcctcttgctgctcagcacagccctggattgcagccccgaggctgagaccagacaaagcccgggaggcagaaagatgctccaagaaccaacactatcaatgtctttgcaaatcctcacaggattcctgtgggtccagctttggaactgggaaacctttcttcggatccgcactcattccactgatgccagctgcccctgaaggatgccagtactgtggtgtgtgagtctcagcagccgcccacacgctcctaactctgctgcatggcagatgcctaggtggaaatagcaaaaacaaggcccaggctggggccagggccagaggggaaggccctggattctcactcatgtgagatcttgaatctctttctttgttctgtttgtttagttagtatcatctggtaaaatagttaaaaaacaacaaaaaactctgtatctgtttctagcatgtgctgcattgactctattaatcacatttcaaattcaccctacattcctctcctcttcactagcctctctgaaggtgtcctggccagccctggagaagcactggtgtctgcagcacccctcagttcctgtgcctcagcccacaggccactgtgataatggtctgtttagcacttctgtatttattgtaagaatgattataatgaagatacacactgtaactacaagaaattataaatgtttttcacatcaggctgttctttttttttttttggaggcgaggttaaagcattactatttgcaaagcactctgtagctccctgttatggggataggtaactaatcagaataataatgtcactcgcatccacttcttagaacctggctccaaaggaaaataagctgatagactcaatcactttcctgaggatggaggcctatggcatgtgtggctgcaggtcgcgaagctgcttaatggtgctgggaagcctagaggaattaaataaagaccctggaggaggtgggatcggagctgcaccttgaacaaatagctcagatttgaacagatggatggaaaagagggaggtgttcccaaccaaggggacatgatacagggaacaggtcctatgtctctttactcctgagagtattaaacctagtaggtgggcagcccctcttggttgcctgttaccttattttgaattctttttgcaaaacatactatcacccgtccaaataatcttttgtctaaatccagacttcacattctgactggggcaaaaagaggcagtccagtaaaggttataaaataggtaccatcattgtttgccttatttagaaaagcatccaattttcactataatcaccctaagcctgagagaggtgaactgttcaagggtactttggctccagtgggtgacagtacctggcccagctttggaattgaaacatttctgatggtctgtactctgctagaacacaggatgcttctgctctccctgctctggcatcctgccaggtgtcatggccacgcacaggcatgaagacagccgggaagccagagttcccacgaagcactcactccttggacttgctcccaccccactggggagagcactcctggagcaggaaatgagcatctctcatctccctgaattccacatccactggctgaatgatcagggaggcatagcagtgagagccataggtcggcagagggaactcaggccctcctttaggatggccatcacctcatctcaatccagccaaatcaaccatctagagcacacaggccgagagaaatgtaataaaatataacatgagacacgtatgaaatttaaactttccggtagccacactagaaaaaggtaaaaaaaaaaaaaccagtgacattaatttaaatttaattttagataatccaacagatctaaaatactatcatttccacatgtaaccagtattttcatgtgtttttttctgcagtaaatctttgaaatctggtgtgtgttttacactgacagcacactcgattcagatgctagattttccttgtagatatttggtcgttatttagatttcataaaatttacagtttaaaagattccaatatccgagttgctccaaacacacttagaagttgttttccaaataatggaatcaatgatcggcttttagatgtaaacttattaaaataaagtagcgtttctcagttaagtcacattccaagcgctcaagatccatgccctgcgcagacccggacgacgaacccgactttcagagactgagggttctgcctagagagctcccacagaaatcagcccgagaagaaagccttgtgggtgaagccagggagggagacaggagggcaggaggaaaatcaagcctaaatgagcacatcgtggacgccgctcttcctctccccacatctcctcgcctcgccgcagtgggcccggctgtgccccaggtccccgcggtcgggagtgaatggcgctcgggtggcaggcacgtgggcacctggtgaactgcaggaccctggcaccgccaccccctcgcccctacacacacaggagtgcccctcccgttgtcacgtggccttcctgctgggtatctggagcagttgcagcctcgcttccggaaggaaacggggcctctggggcacagggaccacctgccagtgcgttccagccgggctgccatccacactggagaccgccccgcacgtggtcctcgggctcggattcagctgtcgcaggatgtgaggggaaaggtatgtggcccgacaatgccaccgagggtgtccccgggctccaccccgtgcctcttcattatagaatgactgggcagagataagggccagattactttgctgtattgaataattcaccataaaaatgattgcaaccagg

SEQ ID NO: 4579 - DNA, 2744 bp, Homo sapiens
gtactcgccacggcacccaggctgcgcgcacgcggtcccggtgtgcagctggagagcgagcggccaccgggagcccccggcacagcccgcgcccgccccgcaggagcccgcgaagatgccccggcgcagcctgcacgcggcggccgtgctcctgctggtgatcttaaaggaacagccttccagcccggccccagtgaacggttccaagtggacttattttggtcctgatggggagaatagctggtccaagaagtacccgtcgtgtgggggcctgctgcagtcccccatagacctgcacagtgacatcctccagtatgacgccagcctcacgcccctcgagttccaaggctacaatctgtctgccaacaagcagtttctcctgaccaacaatggccattcagtgaagctgaacctgccctcggacatgcacatccagggcctccagtctcgctacagtgccacgcagctgcacctgcactgggggaacccgaatgacccgcacggctctgagcacaccgtcagcggacagcacttcgccgccgagctgcacattgtccattataactcagacctttatcctgacgccagcactgccagcaacaagtcagaaggcctcgctgtcctggctgttctcattgagatgggctccttcaatccgtcctatgacaagatcttcagtcaccttcaacatgtaaagtacaaaggccaggaagcattcgtcccgggattcaacattgaagagctgcttccggagaggaccgctgaatattaccgctaccgggggtccctgaccacacccccttgcaaccccactgtgctctggacagttttccgaaaccccgtgcaaatttcccaggagcagctgctggctttggagacagccctgtactgcacacacatggacgacccttcccccagagaaatgatcaacaacttccggcaggtccagaagttcgatgagaggctggtatacacctccttctcccaaggcatcatcctctcactggccctggctggcattcttggcatctgtattgtggtggtggtgtccatttggcttttcagaaggaagagtatcaaaaaaggtgataacaagggagtcatttacaagccagccaccaagatggagactgaggcccacgcttgaggtccccggagctcccgggcacatccaggaaggaccttgctttggaccctacacacttcggctctctggacacttgcgacacctcaaggtgttctctgtagctcaatctgcaaacatgccaggcctcagggatcctctgctgggtgcctccttgccttgggaccatggccaccccagagccatccgatcgatggatgggatgcactctcagaccaagcagcaggaattcaaagctgcttgctgtaactgtgtgagattgtgaagtggtctgaattctggaatcacaaaccaagccatgctggtgggccattaatggttggaaaacactttcatccggggctttgccagagcgtgctttcaagtgtcctggaaattctgctgcttctccaagctttcagacaagaatgtgcactctctgcttaggttttgcttgggaaactcaacttctttcctctggagacggggcatctccctctgatttccttctgctatgacaaaacctttaatctgcaccttacaactcggggacaaatggggacaggaaggatcaagttgtagagagaaaaagaaaacaagagatatacattgtgatatattagggacactttcacagtcctgtcctctggatcacagacactgcacagaccttagggaatggcaggttcaagttccacttcttggtggggatgagaagggagagagagctagagggacaaagagaatgagaagacatggatgatctgggagagtctcactttggaatcagaattggaatcacattctgtttatcaagccataatgtaaggacagaataatacaatattaagtccaaatccaacctcctgtcagtggagcagttatgttttatactctacagattttacaaataatgaggctgttccttgaaaatgtgttgttgctgtgtcctggaggagacatgagttccgagatgacccaatctgcctttgaatctggaggaaataggcagaaacaaaatgactgtagaacttattctctgtaggccaaatttcatttcagccacttctgcaggatccctactgccaacctggaatggagacttttatctacttctctctctctgaagatgtcaaatcgtggtttagatcaaatatatttcaagctataaaagcaggaggttatctgtgcagggggctggcatcatgtatttaggggcaagtaataatggaatgctactaagatactccatattcttccccgaatcacacagacagtttctgacaggcgcaactcctccattttcctcccgcaggtgagaaccctgtggagatgagtcagtgccatgactgagaaggaaccgacccctagttgagagcaccttgcagttccccgagaactttctgattcacagtctcattttgacagcatgaaatgtcctcttgaagcatagctttttaaatatctttttccttctactcctccctctgactctaagaattctctcttctggaatcgcttgaacccaggaggcggaggttgcagtaagccaaggtcatgccactgcactctagcctgggtgacagagcgagactccatctcaaaaaaaaaaaaaaaaaaa

SEQ ID NO: 4580 - DNA, 2556 bp, Homo sapiens
gaagggcggacgtactcgccacggcacccaggctgcgcgcacgcggtcccggtgtgcagctggagagcgagcggccaccgggagcccccggcacagcccgcgcccgccccgcaggagcccgcgaagatgccccggcgcagcctgcacgcggcggccgtgctcctgctggtgatcttaaaggaacagccttccagcccggccccagtgaacggttccaagtggacttattttgtgaagctgaacctgccctcggacatgcacatccagggcctccagtctcgctacagtgccacgcagctgcacctgcactgggggaacccgaatgacccgcacggctctgagcacaccgtcagcggacagcacttcgccgccgagctgcacattgtccattataactcagacctttatcctgacgccagcactgccagcaacaagtcagaaggcctcgctgtcctggctgttctcattgagatgggctccttcaatccgtcctatgacaagatcttcagtcaccttcaacatgtaaagtacaaaggccaggaagcattcgtcccgggattcaacattgaagagctgcttccggagaggaccgctgaatattaccgctaccgggggtccctgaccacacccccttgcaaccccactgtgctctggacagttttccgaaaccccgtgcaaatttcccaggagcagctgctggctttggagacagccctgtactgcacacacatggacgacccttcccccagagaaatgatcaacaacttccggcaggtccagaagttcgatgagaggctggtatacacctccttctcccaaggcatcatcctctcactggccctggctggcattcttggcatctgtattgtggtggtggtgtccatttggcttttcagaaggaagagtatcaaaaaaggtgataacaagggagtcatttacaagccagccaccaagatggagactgaggcccacgcttgaggtccccggagctcccgggcacatccaggaaggaccttgctttggaccctacacacttcggctctctggacacttgcgacacctcaaggtgttctctgtagctcaatctgcaaacatgccaggcctcagggatcctctgctgggtgcctccttgccttgggaccatggccaccccagagccatccgatcgatggatgggatgcactctcagaccaagcagcaggaattcaaagctgcttgctgtaactgtgtgagattgtgaagtggtctgaattctggaatcacaaaccaagccatgctggtgggccattaatggttggaaaacactttcatccggggctttgccagagcgtgctttcaagtgtcctggaaattctgctgcttctccaagctttcagacaagaatgtgcactctctgcttaggttttgcttgggaaactcaacttctttcctctggagacggggcatctccctctgatttccttctgctatgacaaaacctttaatctgcaccttacaactcggggacaaatggggacaggaaggatcaagttgtagagagaaaaagaaaacaagagatatacattgtgatatattagggacactttcacagtcctgtcctctggatcacagacactgcacagaccttagggaatggcaggttcaagttccacttcttggtggggatgagaagggagagagagctagagggacaaagagaatgagaagacatggatgatctgggagagtctcactttggaatcagaattggaatcacattctgtttatcaagccataatgtaaggacagaataatacaatattaagtccaaatccaacctcctgtcagtggagcagttatgttttatactctacagattttacaaataatgaggctgttccttgaaaatgtgttgttgctgtgtcctggaggagacatgagttccgagatgacccaatctgcctttgaatctggaggaaataggcagaaacaaaatgactgtagaacttattctctgtaggccaaatttcatttcagccacttctgcaggatccctactgccaacctggaatggagacttttatctacttctctctctctgaagatgtcaaatcgtggtttagatcaaatatatttcaagctataaaagcaggaggttatctgtgcagggggctggcatcatgtatttaggggcaagtaataatggaatgctactaagatactccatattcttccccgaatcacacagacagtttctgacaggcgcaactcctccattttcctcccgcaggtgagaaccctgtggagatgagtcagtgccatgactgagaaggaaccgacccctagttgagagcaccttgcagttccccgagaactttctgattcacagtctcattttgacagcatgaaatgtcctcttgaagcatagctttttaaatatctttttccttctactcctccctctgactctaagaattctctcttctggaatcgcttgaacccaggaggcggaggttgcagtaagccaaggtcatgccactgcactctagcctgggtgacagagcgagactccatctc

SEQ ID NO: 4581 - DNA, 1788 bp, Homo sapiens
agcacccccgtccccacatacaccagttcagagccaccttaaaagcaggaggcagttgtaaagtcgctggccagctagtggagtggagactgcagagggagataaagagagagggcaaagaggcagcaagagatttgtcctggggatccagaaacccatgataccctactgaacaccgaatcccctggaagcccacagagacagagacagcaagagaagcagagataaatacactcacgccaggagctcgctcgctctctctctctctctctcactcctccctccctctctctctgcctgtcctagtcctctagtcctcaaattcccagtcccctgcaccccttcctgggacactatgttgttctccgccctcctgctggaggtgatttggatcctggctgcagatgggggtcaacactggacgtatgagggcccacatggtcaggaccattggccagcctcttaccctgagtgtggaaacaatgcccagtcgcccatcgatattcagacagacagtgtgacatttgaccctgatttgcctgctctgcagccccacggatatgaccagcctggcaccgagcctttggacctgcacaacaatggccacacagtgcaactctctctgccctctaccctgtatctgggtggacttccccgaaaatatgtagctgcccagctccacctgcactggggtcagaaaggatccccaggggggtcagaacaccagatcaacagtgaagccacatttgcagagctccacattgtacattatgactctgattcctatgacagcttgagtgaggctgctgagaggcctcagggcctggctgtcctgggcatcctaattgaggtgggtgagactaagaatatagcttatgaacacattctgagtcacttgcatgaagtcaggcataaagatcagaagacctcagtgcctcccttcaacctaagagagctgctccccaaacagctggggcagtacttccgctacaatggctcgctcacaactcccccttgctaccagagtgtgctctggacagttttttatagaaggtcccagatttcaatggaacagctggaaaagcttcaggggacattgttctccacagaagaggagccctctaagcttctggtacagaactaccgagcccttcagcctctcaatcagcgcatggtctttgcttctttcatccaagcaggatcctcgtataccacaggtgaaatgctgagtctaggtgtaggaatcttggttggctgtctctgccttctcctggctgtttatttcattgctagaaagattcggaagaagaggctggaaaaccgaaagagtgtggtcttcacctcagcacaagccacgactgaggcataaattccttctcagataccatggatgtggatgacttcccttcatgcctatcaggaagcctctaaaatggggtgtaggatctggccagaaacactgtaggagtagtaagcagatgtcctccttcccctggacatctcctagagaggaatggacccaggctgtcattccaggaagaactgcagagccttcagcctctccaaacatgtaggaggaaatgaggaaatcgctgtgttgttaatgcagagaacaaactctgtttagttgcaggggaagtttgggatataccccaaagtcctctaccccctcacttttatggccctttccctagatatactgcgggatctctccttaggataaagagttgctgttgaagttgtatatttttgatcaatatatttggaaattaaagtttctgactttaa

SEQ ID NO: 4582 - DNA, 1293 bp, Homo sapiens
agccccgccccgctagggcggggcctgcgcctgcgcgctcagcggccgggcgtgtaacccacgggtgcgcgcccacgaccgccagactcgagcagtctctggaacacgctgcggggctcccgggcctgagccaggtctgttctccacgcaggtgttccgcgcgccccgttcagccatgtcgtccggcatccatgtagcgctggtgactggaggcaacaagggcatcggcttggccatcgtgcgcgacctgtgccggctgttctcgggggacgtggtgctcacggcgcgggacgtgacgcggggccaggcggccgtacagcagctgcaggcggagggcctgagcccgcgcttccaccagctggacatcgacgatctgcagagcatccgcgccctgcgcgacttcctgcgcaaggagtacgggggcctggacgtgctggtcaacaacgcgggcatcgccttcaaggttgctgatcccacaccctttcatattcaagctgaagtgacgatgaaaacaaatttctttggtacccgagatgtgtgcacagaattactccctctaataaaaccccaagggagagtggtgaacgtatctagcatcatgagcgtcagagcccttaaaagctgcagcccagagctgcagcagaagttccgcagtgagaccatcactgaggaggagctggtggggctcatgaacaagtttgtggaggatacaaagaagggagtgcaccagaaggagggctggcccagcagcgcatacggggtgacgaagattggcgtcaccgttctgtccaggatccacgccaggaaactgagtgagcagaggaaaggggacaagatcctcctgaatgcctgctgcccagggtgggtgagaactgacatggcgggacccaaggccaccaagagcccagaagaaggtgcagagacccctgtgtacttggcccttttgcccccagatgctgagggtccccatggacaatttgtttcagagaagagagttgaacagtggtgagctgggctcacagctccatccatgggccccattttgtaccttgtcctgagttggtccaaagggcatttacaatgtcataaatatccttatataagaaaaaaaatgatctcttatcaattagcactcactaatgtactactaattgagcaacctacgcactcagttgactacgtaaatctgtcaggtcttttgtgatttcctctgatgcaggagaggaaaaattgtaattgatgaaaataatgaatgaaaatcaacagatgaataaatggttctttataagtgtc

SEQ ID NO: 4583 - DNA, 1169 bp, Homo sapiens
cggacacctcgcagatcaccccgcggctcagagcccggatcctgaagggcgcagcgtgggcagggggcgggcccgggagttggaacagagggcacagacggcccctcctcggaggggagggaccggagccggggcctttttctttaagactcgcagcactggatcccagaacttagtctgcgcggcggcattgacactagctgggctcctcggggcgcgccccaggtggtccgaagcccggtccgccctccacgcaggtgccccgcgctccccgctcagccatgtcgtcctgcagccgcgtggcgctggtgaccggggccaacaggggcatcggcttggccatcgcgcgcgaactgtgccgacagttctctggggatgtggtgctcaccgcgcgggacgtggcgcggggccaggcggccgtgcagcagctgcaggcggagggcctgagcccgcgcttccaccaactggacatcgacgacttgcagagcatccgcgccctgcgcgacttcctgcgcaaggagtacggggggctcaacgtactggtcaacaacgcggccgtcgccttcaagagtgatgatccaatgccctttgacattaaagctgagatgacactgaagacaaatttttttgccactagaaacatgtgcaacgagttactgccgataatgaaacctcatgggagagtggtgaatatcagtagtttgcagtgtttaagggcttttgaaaactgcagtgaagatctgcaggaaaggttccacagtgagacactcacagaaggagacctggtggatctcatgaaaaagtttgtggaggacacaaaaaatgaggtgcatgagagggaaggctggcccaactcaccttatggggtgtccaagttgggggtcacggtcttatcgaggatcctggccaggcgtctggatgagaagaggaaagctgacaggattctggtgaatgcgtgctgcccaggaccagtgaagacagacatggatgggaaagacagcatcaggactgtggaggagggggctgagacccctgtctacttggccctcttgcctccagatgccactgagccacaaggccagttggtccatgacaaagttgtgcaaaactggtaaacgtctgcttcggagcttgctgcttaataaatgttggtggaatgaatgaatgaa

SEQ ID NO: 4584 - DNA, 2267 bp, Homo sapiens
gatgctcaccatggggcgcctgcaactggttgtgttgggcctcacctgctgctgggcagtggcgagtgccgcgaagctgggcgccgtgtacacagaaggtgggttcgtggaaggcgtcaataagaagctcggcctcctgggtgactctgtggacatcttcaagggcatccccttcgcagctcccaccaaggccctggaaaatcctcagccacatcctggctggcaagggaccctgaaggccaagaacttcaagaagagatgcctgcaggccaccatcacccaggacagcacctacggggatgaagactgcctgtacctcaacatttgggtgccccagggcaggaagcaagtctcccgggacctgcccgttatgatctggatctatggaggcgccttcctcatggggtccggccatggggccaacttcctcaacaactacctgtatgacggcgaggagatcgccacacgcggaaacgtcatcgtggtcaccttcaactaccgtgtcggcccccttgggttcctcagcactggggacgccaatctgccaggtaactatggccttcgggatcagcacatggccattgcttgggtgaagaggaatatcgcggccttcgggggggaccccaacaacatcacgctcttcggggagtctgctggaggtgccagcgtctctctgcagaccctctccccctacaacaagggcctcatccggcgagccatcagccagagcggcgtggccctgagtccctgggtcatccagaaaaacccactcttctgggccaaaaaggtggctgagaaggtgggttgccctgtgggtgatgccgccaggatggcccagtgtctgaaggttactgatccccgagccctgacgctggcctataaggtgccgctggcaggcctggagtaccccatgctgcactatgtgggcttcgtccctgtcattgatggagacttcatccccgctgacccgatcaacctgtacgccaacgccgccgacatcgactatatagcaggcaccaacaacatggacggccacatcttcgccagcatcgacatgcctgccatcaacaagggcaacaagaaagtcacggaggacttctacaagctggtcagtgagttcacaatcaccaaggggctcagaggcgccaagacgacctttgatgtctacaccgagtcctgggcccaggacccatcccaggagaataagaagaagactgtggtggactttgagaccgatgtcctcttcctggtgcccaccgagattgccctagcccagcacagagccaatgccaagagtgccaagacctacgcctacctgttttcccatccctctcggatgcccgtctaccccaaatgggtgggggccgaccatgcagatgacattcagtacgttttcgggaagcccttcgccacccccacgggctaccggccccaagacaggacagtctctaaggccatgatcgcctactggaccaactttgccaaaacaggggaccccaacatgggcgactcggctgtgcccacacactgggaaccctacactacggaaaacagcggctacctggagatcaccaagaagatgggcagcagctccatgaagcggagcctgagaaccaacttcctgcgctactggaccctcacctatctggcgctgcccacagtgaccgaccaggaggccacccctgtgccccccacaggggactccgaggccactcccgtgccccccacgggtgactccgagaccgcccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggcgccccccccgtgccgcccacgggtgacgccgggcccccccccgtgccgcccacgggtgactccggcgccccccccgtgccgcccacgggtgactccggggccccccccgtgacccccacgggtgactccgagaccgcccccgtgccgcccacgggtgactccggggccccccctgtgccccccacgggtgactctgaggctgcccctgtgccccccacagatgactccaaggaagctcagatgcctgcagtcattaggttttagcgtcccatgagccttggtatcaagaggccacaagagtgggaccccaggggctcccctcccatcttgagctcttcctgaataaagcctcatacccctg

SEQ ID NO: 4585 - DNA, 2186 bp, Homo sapiens
ggccacccagaggctgatgctcaccatggggcgcctgcaactggttgtgttgggcctcacctgctgctgggcagtggcgagtgccgcgaagctgggcgccgtgtacacagaaggtgggttcgtggaaggcgtcaataagaagctcggcctcctgggtgactctgtggacatcttcaagggcatccccttcgcagctcccaccaaggccctggaaaatcctcagccacatcctggctggcaagggaccctgaaggccaagaacttcaagaagagatgcctgcaggccaccatcacccaggacagcacctacggggatgaagactgcctgtacctcaacatttgggtgccccagggcaggaagcaagtctcccgggacctgcccgttatgatctggatctatggaggcgccttcctcatggggtccggccatggggccaacttcctcaacaactacctgtatgacggcgaggagatcgccacacgcggaaacgtcatcgtggtcaccttcaactaccgtgtcggcccccttgggttcctcagcactggggacgccaatctgccaggtaactatggccttcgggatcagcacatggccattgcttgggtgaagaggaatatcgcggccttcgggggggaccccaacaacatcacgctcttcggggagtctgctggaggtgccagcgtctctctgcagaccctctccccctacaacaagggcctcatccggcgagccatcagccagagcggcgtggccctgagtccctgggtcatccagaaaaacccactcttctgggccaaaaaggtggctgagaaggtgggttgccctgtgggtgatgccgccaggatggcccagtgtctgaaggttactgatccccgagccctgacgctggcctataaggtgccgctggcaggcctggagtaccccatgctgcactatgtgggcttcgtccctgtcattgatggagacttcatccccgctgacccgatcaacctgtacgccaacgccgccgacatcgactatatagcaggcaccaacaacatggacggccacatcttcgccagcatcgacatgcctgccatcaacaagggcaacaagaaagtcacggaggaggacttctacaagctggtcagtgagttcacaatcaccaaggggctcagaggcgccaagacgacctttgatgtctacaccgagtcctgggcccaggacccatcccaggagaataagaagaagactgtggtggactttgagaccgatgtcctcttcctggtgcccaccgagattgccctagcccagcacagagccaatgccaaggaccccaacatgggcgactcggctgtgcccacacactgggaaccctacactacggaaaacagcggctacctggagatcaccaagaagatgggcagcagctccatgaagcggagcctgagaaccaacttcctgcgctactggaccctcacctatctggcgctgcccacagtgaccgaccaggaggccacccctgtgccccccacaggggactccgaggccactcccgtgccccccacgggtgactccgagaccgcccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggcgccccccccgtgccgcccacgggtgacgccgggcccccccccgtgccgcccacgggtgactccggcgccccccccgtgccgcccacgggtgactccggggccccccccgtgacccccacgggtgactccgagaccgcccccgtgccgcccacgggtgactccggggccccccctgtgccccccacgggtgactctgaggctgcccctgtgccccccacagatgactccaaggaagctcagatgcctgcagtcattaggttttagcgtcccatgagccttggtatcaagaggccacaagagtgggaccccaggggctcccctcccatcttgagctcttcctgaataaagcctcatacccctg

SEQ ID NO: 4586 - DNA, 2384 bp, Homo sapiens
ggccacccagaggctgatgctcaccatggggcgcctgcaactggttgtgttgggcctcacctgctgctgggcagtggcgagtgccgcgaagctgggcgccgtgtacacagaaggtgggttcgtggaaggcgtcaataagaagctcggcctcctgggtgactctgtggacatcttcaagggcatccccttcgcagctcccaccaaggccctggaaaatcctcagccacatcctggctggcaagggaccctgaaggccaagaacttcaagaagagatgcctgcaggccaccatcacccaggacagcacctacggggatgaagactgcctgtacctcaacatttgggtgccccagggcaggaagcaagtctcccgggacctgcccgttatgatctggatctatggaggcgccttcctcatggggtccggccatggggccaacttcctcaacaactacctgtatgacggcgaggagatcgccacacgcggaaacgtcatcgtggtcaccttcaactaccgtgtcggcccccttgggttcctcagcactggggacgccaatctgccaggtaactatggccttcgggatcagcacatggccattgcttgggtgaagaggaatatcgcggccttcgggggggaccccaacaacatcacgctcttcggggagtctgctggaggtgccagcgtctctctgcagaccctctccccctacaacaagggcctcatccggcgagccatcagccagagcggcgtggccctgagtccctgggtcatccagaaaaacccactcttctgggccaaaaaggtggctgagaaggtgggttgccctgtgggtgatgccgccaggatggcccagtgtctgaaggttactgatccccgagccctgacgctggcctataaggtgccgctggcaggcctggagtaccccatgctgcactatgtgggcttcgtccctgtcattgatggagacttcatccccgctgacccgatcaacctgtacgccaacgccgccgacatcgactatatagcaggcaccaacaacatggacggccacatcttcgccagcatcgacatgcctgccatcaacaagggcaacaagaaagtcacggaggaggacttctacaagctggtcagtgagttcacaatcaccaaggggctcagaggcgccaagacgacctttgatgtctacaccgagtcctgggcccaggacccatcccaggagaataagaagaagactgtggtggactttgagaccgatgtcctcttcctggtgcccaccgagattgccctagcccagcacagagccaatgccaagagtgccaagacctacgcctacctgttttcccatccctctcggatgcccgtctaccccaaatgggtgggggccgaccatgcagatgacattcagtacgttttcgggaagcccttcgccacccccacgggctaccggccccaagacaggacagtctctaaggccatgatcgcctactggaccaactttgccaaaacaggggaccccaacatgggcgactcggctgtgcccacacactgggaaccctacactacggaaaacagcggctacctggagatcaccaagaagatgggcagcagctccatgaagcggagcctgagaaccaacttcctgcgctactggaccctcacctatctggcgctgcccacagtgaccgaccaggaggccacccctgtgccccccacaggggactccgaggccactcccgtgccccccacgggtgactccgagaccgcccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggcgccccccccgtgccgcccacgggtgacgccgggcccccccccgtgccgcccacgggtgactccggcgccccccccgtgccgcccacgggtgactccggggccccccccgtgacccccacgggtgactccgagaccgcccccgtgccgcccacgggtgactccggggccccccctgtgccccccacgggtgactctgaggctgcccctgtgccccccacagatgactccaaggaagctcagatgcctgcagtcattaggttttagcgtcccatgagccttggtatcaagaggccacaagagtgggaccccaggggctcccctcccatcttgagctcttcctgaataaagcctcatacccctg

SEQ ID NO: 4587 - DNA, 2010 bp, Homo sapiens
agcgcagggcggtaactctgggcggggctgggctccagggctggacagcacagtccctctgaactgcacagagacctcgcaggccccgagaactgtcgcccttccacgatgtggctccgtgcctttatcctggccactctctctgcttccgcggcttgggcagggcatccgtcctcgccacctgtggtggacaccgtgcatggcaaagtgctggggaagttcgtcagcttagaaggatttgcacagcctgtggccattttcctgggaatcccttttgccaagccgcctcttggacccctgaggtttactccaccgcagcctgcagaaccatggagctttgtgaagaatgccacctcgtaccctcctatgtgcacccaagatcccaaggcggggcagttactctcagagctatttacaaaccgaaaggagaacattcctctcaagctttctgaagactgtctttacctcaatatttacactcctgctgacttgaccaagaaaaacaggctgccggtgatggtgtggatccacggaggggggctgatggtgggtgcggcatcaacctatgatgggctggcccttgctgcccatgaaaacgtggtggtggtgaccattcaatatcgcctgggcatctggggattcttcagcacaggggatgaacacagccgggggaactggggtcacctggaccaggtggctgccctgcgctgggtccaggacaacattgccagctttggagggaacccaggctctgtgaccatctttggagagtcagcgggaggagaaagtgtctctgttcttgttttgtctccattggccaagaacctcttccaccgggccatttctgagagtggcgtggccctcacttctgttctggtgaagaaaggtgatgtcaagcccttggctgagcaaattgctatcactgctgggtgcaaaaccaccacctctgctgtcatggttcactgcctgcgacagaagacggaagaggagctcttggagacgacattgaaaatgaaattcttatctctggacttacagggagaccccagagagagtcaaccccttctgggcactgtgattgatgggatgctgctgctgaaaacacctgaagagcttcaagctgaaaggaatttccacactgtcccctacatggtcggaattaacaagcaggagtttggctggttgattccaatgcagttgatgagctatccactctccgaagggcaactggaccagaagacagccatgtcactcctgtggaagtcctatccccttgtttgcattgctaaggaactgattccagaagccactgagaaatacttaggaggaacagacgacactgtcaaaaagaaagacctgttcctggacttgatagcagatgtgatgtttggtgtcccatctgtgattgtggcccggaaccacagagatgctggagcacccacctacatgtatgagtttcagtaccgtccaagcttctcatcagacatgaaacccaagacggtgataggagaccacggggatgagctcttctccgtctttggggccccatttttaaaagagggtgcctcagaagaggagatcagacttagcaagatggtgatgaaattctgggccaactttgctcgcaatggaaaccccaatggggaagggctgccccactggccagagtacaaccagaaggaagggtatctgcagattggtgccaacacccaggcggcccagaagctgaaggacaaagaagtagctttctggaccaacctctttgccaagaaggcagtggagaagccaccccagacagaacacatagagctgtgaatgaagatccagccggccttgggagcctggaggagcaaagactggggtcttttgcgaaagggattgcaggttcagaaggcatcttaccatggctggggaattgtctggtggtggggggcaggggacagaggccatgaaggagcaagttttgtatttgtgacctcagctttgggaataaaggatcttttgaaggcc

SEQ ID NO: 4588 - DNA, 2007 bp, Homo sapiens
agcgcagggcggtaactctgggcggggctgggctccagggctggacagcacagtccctctgaactgcacagagacctcgcaggccccgagaactgtcgcccttccacgatgtggctccgtgcctttatcctggccactctctctgcttccgcggcttgggggcatccgtcctcgccacctgtggtggacaccgtgcatggcaaagtgctggggaagttcgtcagcttagaaggatttgcacagcctgtggccattttcctgggaatcccttttgccaagccgcctcttggacccctgaggtttactccaccgcagcctgcagaaccatggagctttgtgaagaatgccacctcgtaccctcctatgtgcacccaagatcccaaggcggggcagttactctcagagctatttacaaaccgaaaggagaacattcctctcaagctttctgaagactgtctttacctcaatatttacactcctgctgacttgaccaagaaaaacaggctgccggtgatggtgtggatccacggaggggggctgatggtgggtgcggcatcaacctatgatgggctggcccttgctgcccatgaaaacgtggtggtggtgaccattcaatatcgcctgggcatctggggattcttcagcacaggggatgaacacagccgggggaactggggtcacctggaccaggtggctgccctgcgctgggtccaggacaacattgccagctttggagggaacccaggctctgtgaccatctttggagagtcagcgggaggagaaagtgtctctgttcttgttttgtctccattggccaagaacctcttccaccgggccatttctgagagtggcgtggccctcacttctgttctggtgaagaaaggtgatgtcaagcccttggctgagcaaattgctatcactgctgggtgcaaaaccaccacctctgctgtcatggttcactgcctgcgacagaagacggaagaggagctcttggagacgacattgaaaatgaaattcttatctctggacttacagggagaccccagagagagtcaaccccttctgggcactgtgattgatgggatgctgctgctgaaaacacctgaagagcttcaagctgaaaggaatttccacactgtcccctacatggtcggaattaacaagcaggagtttggctggttgattccaatgcagttgatgagctatccactctccgaagggcaactggaccagaagacagccatgtcactcctgtggaagtcctatccccttgtttgcattgctaaggaactgattccagaagccactgagaaatacttaggaggaacagacgacactgtcaaaaagaaagacctgttcctggacttgatagcagatgtgatgtttggtgtcccatctgtgattgtggcccggaaccacagagatgctggagcacccacctacatgtatgagtttcagtaccgtccaagcttctcatcagacatgaaacccaagacggtgataggagaccacggggatgagctcttctccgtctttggggccccatttttaaaagagggtgcctcagaagaggagatcagacttagcaagatggtgatgaaattctgggccaactttgctcgcaatggaaaccccaatggggaagggctgccccactggccagagtacaaccagaaggaagggtatctgcagattggtgccaacacccaggcggcccagaagctgaaggacaaagaagtagctttctggaccaacctctttgccaagaaggcagtggagaagccaccccagacagaacacatagagctgtgaatgaagatccagccggccttgggagcctggaggagcaaagactggggtcttttgcgaaagggattgcaggttcagaaggcatcttaccatggctggggaattgtctggtggtggggggcaggggacagaggccatgaaggagcaagttttgtatttgtgacctcagctttgggaataaaggatcttttgaaggcc

SEQ ID NO: 4589 - DNA, 2004 bp, Homo sapiens
agcgcagggcggtaactctgggcggggctgggctccagggctggacagcacagtccctctgaactgcacagagacctcgcaggccccgagaactgtcgcccttccacgatgtggctccgtgcctttatcctggccactctctctgcttccgcggcttgggggcatccgtcctcgccacctgtggtggacaccgtgcatggcaaagtgctggggaagttcgtcagcttagaaggatttgcacagcctgtggccattttcctgggaatcccttttgccaagccgcctcttggacccctgaggtttactccaccgcagcctgcagaaccatggagctttgtgaagaatgccacctcgtaccctcctatgtgcacccaagatcccaaggcggggcagttactctcagagctatttacaaaccgaaaggagaacattcctctcaagctttctgaagactgtctttacctcaatatttacactcctgctgacttgaccaagaaaaacaggctgccggtgatggtgtggatccacggaggggggctgatggtgggtgcggcatcaacctatgatgggctggcccttgctgcccatgaaaacgtggtggtggtgaccattcaatatcgcctgggcatctggggattcttcagcacaggggatgaacacagccgggggaactggggtcacctggaccaggtggctgccctgcgctgggtccaggacaacattgccagctttggagggaacccaggctctgtgaccatctttggagagtcagcgggaggagaaagtgtctctgttcttgttttgtctccattggccaagaacctcttccaccgggccatttctgagagtggcgtggccctcacttctgttctggtgaagaaaggtgatgtcaagcccttggctgagcaaattgctatcactgctgggtgcaaaaccaccacctctgctgtcatggttcactgcctgcgacagaagacggaagaggagctcttggagacgacattgaaaatgaaattcttatctctggacttacagggagaccccagagagagtcaaccccttctgggcactgtgattgatgggatgctgctgctgaaaacacctgaagagcttcaagctgaaaggaatttccacactgtcccctacatggtcggaattaacaagcaggagtttggctggttgattccaatgttgatgagctatccactctccgaagggcaactggaccagaagacagccatgtcactcctgtggaagtcctatccccttgtttgcattgctaaggaactgattccagaagccactgagaaatacttaggaggaacagacgacactgtcaaaaagaaagacctgttcctggacttgatagcagatgtgatgtttggtgtcccatctgtgattgtggcccggaaccacagagatgctggagcacccacctacatgtatgagtttcagtaccgtccaagcttctcatcagacatgaaacccaagacggtgataggagaccacggggatgagctcttctccgtctttggggccccatttttaaaagagggtgcctcagaagaggagatcagacttagcaagatggtgatgaaattctgggccaactttgctcgcaatggaaaccccaatggggaagggctgccccactggccagagtacaaccagaaggaagggtatctgcagattggtgccaacacccaggcggcccagaagctgaaggacaaagaagtagctttctggaccaacctctttgccaagaaggcagtggagaagccaccccagacagaacacatagagctgtgaatgaagatccagccggccttgggagcctggaggagcaaagactggggtcttttgcgaaagggattgcaggttcagaaggcatcttaccatggctggggaattgtctggtggtggggggcaggggacagaggccatgaaggagcaagttttgtatttgtgacctcagctttgggaataaaggatcttttgaaggcc

SEQ ID NO: 4590 - DNA, 1813 bp, Homo sapiens
ttccacgatgtggctccgtgcctttatcctggccactctctctgcttccgcggcttgggggcatccgtcctcgccacctgtggtggacaccgtgcatggcaaagtgctggggaagttcgtcagcttagaaggatttgcacagcctgtggccattttcctgggaatcccttttgccaagccgcctcttggacccctgaggtttactccaccgcagcctgcagaaccatggagctttgtgaagaatgccacctcgtaccctcctatgtgcacccaagatcccaaggcggggcagttgaccaagaaaaacaggctgccggtgatggtgtggatccacggaggggggctgatggtgggtgcggcatcaacctatgatgggctggcccttgctgcccatgaaaacgtggtggtggtgaccattcaatatcgcctgggcatctggggattcttcagcacaggggatgaacacagccgggggaactggggtcacctggaccaggtggctgccctgcgctgggtccaggacaacattgccagctttggagggaacccaggctctgtgaccatctttggagagtcagcgggaggagaaagtgtctctgttcttgttttgtctccattggccaagaacctcttccaccgggccatttctgagagtggcgtggccctcacttctgttctggtgaagaaaggtgatgtcaagcccttggctgagcaaattgctatcactgctgggtgcaaaaccaccacctctgctgtcatggttcactgcctgcgacagaagacggaagaggagctcttggagacgacattgaaaatgaaattcttatctctggacttacagggagaccccagagagagtcaaccccttctgggcactgtgattgatgggatgctgctgctgaaaacacctgaagagcttcaagctgaaaggaatttccacactgtcccctacatggtcggaattaacaagcaggagtttggctggttgattccaatgcagttgatgagctatccactctccgaagggcaactggaccagaagacagccatgtcactcctgtggaagtcctatccccttgtttgcattgctaaggaactgattccagaagccactgagaaatacttaggaggaacagacgacactgtcaaaaagaaagacctgttcctggacttgatagcagatgtgatgtttggtgtcccatctgtgattgtggcccggaaccacagagatgctggagcacccacctacatgtatgagtttcagtaccgtccaagcttctcatcagacatgaaacccaagacggtgataggagaccacggggatgagctcttctccgtctttggggccccatttttaaaagagggtgcctcagaagaggagatcagacttagcaagatggtgatgaaattctgggccaactttgctcgcaatggaaaccccaatggggaagggctgccccactggccagagtacaaccagaaggaagggtatctgcagattggtgccaacacccaggcggcccagaagctgaaggacaaagaagtagctttctggaccaacctctttgccaagaaggcagtggagaagccaccccagacagaacacatagagctgtgaatgaagatccagccggccttgggagcctggaggagcaaagactggggtcttttgcgaaagggattgcaggttcagaaggcatcttaccatggctggggaattgtctggtggtggggggcaggggacagaggccatgaaggagcaagttttgtatttgtgacctcagctttgggaataaaggatcttttgaaggcc

SEQ ID NO: 4591 - DNA, 3834 bp, Homo sapiens
gatcggtggtgctgaagggcagggatcttattccaccttctgaagcttctgtcgaaccagttgtaaggagaatggagagagcagtgagagtggagtccggggtcctggtcggggtggtctgtctgctcctggcatgccctgccacagccactgggcccgaagttgctcagcctgaagtagacaccaccctgggtcgtgtgcgaggccggcaggtgggcgtgaagggcacagaccgccttgtgaatgtctttctgggcattccatttgcccagccgccactgggccctgaccggttctcagccccacacccagcacagccctgggagggtgtgcgggatgccagcactgcgcccccaatgtgcctacaagacgtggagagcatgaacagcagcagatttgtcctcaacggaaaacagcagatcttctccgtttcagaggactgcctggtcctcaacgtctatagcccagctgaggtccccgcagggtccggtaggccggtcatggtatgggtccatggaggcgctctgataactggcgctgccacctcctacgatggatcagctctggctgcctatggggatgtggtcgtggttacagtccagtaccgccttggggtccttggcttcttcagcactggagatgagcatgcacctggcaaccagggcttcctagatgtggtagctgctttgcgctgggtgcaagaaaacatcgcccccttcgggggtgacctcaactgtgtcactgtctttggtggatctgccggtgggagcatcatctctggcctggtcctgtccccagtggctgcagggctgttccacagagccatcacacagagtggggtcatcaccaccccagggatcatcgactctcacccttggcccctagctcagaaaatcgcaaacaccttggcctgcagctccagctccccggctgagatggtgcagtgccttcagcagaaagaaggagaagagctggtccttagcaagaagctgaaaaatactatctatcctctcaccgttgatggcactgtcttccccaaaagccccaaggaactcctgaaggagaagcccttccactctgtgcccttcctcatgggtgtcaacaaccatgagttcagctggctcatccccaggggctggggtctcctggatacaatggagcagatgagccgggaggacatgctggccatctcaacacccgtcttgaccagtctggatgtgccccctgagatgatgcccaccgtcatagatgaatacctaggaagcaactcggacgcacaagccaaatgccaggcgttccaggaattcatgggtgacgtattcatcaatgttcccaccgtcagtttttcaagataccttcgagattctggaagccctgtctttttctatgagttccagcatcgacccagttcttttgcgaagatcaaacctgcctgggtgaaggctgatcatggggccgagggtgcttttgtgttcggaggtcccttcctcatggacgagagctcccgcctggcctttccagaggccacagaggaggagaagcagctaagcctcaccatgatggcccagtggacccactttgcccggacaggggaccccaatagcaaggctctgcctccttggccccaattcaaccaggcggaacaatatctggagatcaacccagtgccacgggccggacagaagttcagggaggcctggatgcagttctggtcagagacgctccccagcaagatacaacagtggcaccagaagcagaagaacaggaaggcccaggaggacctctgaggccaggcctgaaccttcttggctggggcaaaccactcttcaagtggtggcagagtcccagcacggcagcccgcctctccccctgctgagactttaatctccaccagcccttaaagtgtcggccgctctgtgactggagttatgctcttttgaaatgtcacaaggccgcctcccacctctggggcattgtacaagttcttccctctccctgaagtgcctttcctgctttcttcgtggtaggttctagcacattcctctagcttcctggaggactcactcccccaggaagccttccctgccttctctgggctgtgcggccccgagtctgcgtccattagagcacagtccacccgaggctagcaccgtgtctgtgtctgtctccccctcagaggagctctctcaaaatggggattagcctaaccccactctgtcacccacaccaggatcgggtgggacctggagctagggggtgtttgctgagtgagtgagtgaaacacagaatatgggaatggcagctgctgaacttgaacccagagccttcaggtgccaaagccatactcaggcccccaccgacattgtccaccctggccagaagggtgcatgccaatggcagagacctgggatgggagaagtcctggggcgccaggggatccagcctagagcagaccttagcccctgactaaggcctcagactagggcgggaggggtctcctcctctctgctgcccagtcctggcccctgcacaagacaacagaatccatcagggccatgagtgtcacccagacctgaccctcaccaattccagccctgaccctcaggacgctggatgccagctcccagccccagtgccgggtcctccctcccttcctggcttggggagaccagtttctggggagcttccaagagcacccaccaagacacagcaggacaggccaggggagggcatctggaccagggcatccgtcgggctattgtcacagagaaaagaagagacccacccactcgggctgcaaaaggtgaaaagcaccaagaggttttcagatggaagtgagaggtgacagtgtgctggcagccctcacagccctcgcttgctctccctgccgcctctgcctgggctcccactttggcagcacttgaggagcccttcaacccgccgctgcactgtaggagcccctttctgggctggccaaggccggagccagctccctcagcttgcggggaggtgcggagggagaggggcgggcaggaaccggggctgcgcgcagcgcttgcgggccagagtgagttccgggtgggcgtgggctcggcggggccccactcagagcagctggccggccccaggcagtgagggccttagcacctgggccagcagctgctgtgctcgatttctcgctgggccttagctgcctccccgcggggcagggctcgggacctgcagccctccatgcctgaccctccccccaccccccgtgggctcctgtgcggccggagcctccccaaggagcgccgccccctgctccacagcgcccagtcccatcgaccacccaagggctgaggagtgcgggtgcacagcgcgggactggcaggcagctccacctgctgccccagtgctggatccactgggtgaagccagctgggctcctgagtctggtggggacttggagaacctttatgtctagctaagggattgtaaatacaccgatgggcactctgtatctagctcaaggtttgtaaacacaccaatcagcaccctgtgtctagctcagtgtttgtgaatgcaccaatccacactctgtatctggctactctggtggggacttggagaacctttgtgtccacactctgtatctagctaatctagtggggatgtggagaacctttgtgtctagctcagggatcgtaaacgcaccaatcagcaccctgtcaaaacagaccacttgactctctgtaaaatggaccaatcagcaggatgtgggtggggcgagacaagagaataaaagcaggctgcctgagccagcagtgacaacccccctcgggtcccctccca

SEQ ID NO: 4592 - DNA, 3178 bp, Homo sapiens
gtgtgactctgtgccagagcaattgactaaaactctcaggttttagatatcaagccaccggggacttcatgagccaagtcccttccattcctttccaggtgcatagaacttcccacaagagtgtcagcactgtgctttcatcccgagcatcttgtttctgtcattcttattcttctacccatcttcacagcaatcattttcttcacttttctttttttttttttttcgtcttggcccattgcacaccctaagacaaagcaatccatttttgttgttgttgttgtttgtgtgtttgtttgttttttgagacagagcctcgatccatcatccaggctgcagtgcagcagcgccatcatgactctctactgcctcaacctctcaggcccgagcaatcctcccagcttcctgagtagctcgggcctcagggctggggtctcctggatacaatggagcagatgagccgggaggacatgctggccatctcaacacccgtcttgaccagtctggatgtgccccctgagatgatgcccaccgtcatagatgaatacctaggaagcaactcggacgcacaagccaaatgccaggcgttccaggaattcatgggtgacgtattcatcaatgttcccaccgtcagtttttcaagataccttcgagattctggaagccctgtctttttctatgagttccagcatcgacccagttcttttgcgaagatcaaacctgcctgggtgaaggctgatcatggggccgagggtgcttttgtgttcggaggtcccttcctcatggacgagagctcccgcctggcctttccagaggccacagaggaggagaagcagctaagcctcaccatgatggcccagtggacccactttgcccggacaggggaccccaatagcaaggctctgcctccttggccccaattcaaccaggcggaacaatatctggagatcaacccagtgccacgggccggacagaagttcagggaggcctggatgcagttctggtcagagacgctccccagcaagatacaacagtggcaccagaagcagaagaacaggaaggcccaggaggacctctgaggccaggcctgaaccttcttggctggggcaaaccactcttcaagtggtggcagagtcccagcacggcagcccgcctctccccctgctgagactttaatctccaccagcccttaaagtgtcggccgctctgtgactggagttatgctcttttgaaatgtcacaaggccgcctcccacctctggggcattgtacaagttcttccctctccctgaagtgcctttcctgctttcttcgtggtaggttctagcacattcctctagcttcctggaggactcactcccccaggaagccttccctgccttctctgggctgtgcggccccgagtctgcgtccattagagcacagtccacccgaggctagcaccgtgtctgtgtctgtctccccctcagaggagctctctcaaaatggggattagcctaaccccactctgtcacccacaccaggatcgggtgggacctggagctagggggtgtttgctgagtgagtgagtgaaacacagaatatgggaatggcagctgctgaacttgaacccagagccttcaggtgccaaagccatactcaggcccccaccgacattgtccaccctggccagaagggtgcatgccaatggcagagacctgggatgggagaagtcctggggcgccaggggatccagcctagagcagaccttagcccctgactaaggcctcagactagggcgggaggggtctcctcctctctgctgcccagtcctggcccctgcacaagacaacagaatccatcagggccatgagtgtcacccagacctgaccctcaccaattccagccctgaccctcaggacgctggatgccagctcccagccccagtgccgggtcctccctcccttcctggcttggggagaccagtttctggggagcttccaagagcacccaccaagacacagcaggacaggccaggggagggcatctggaccagggcatccgtcgggctattgtcacagagaaaagaagagacccacccactcgggctgcaaaaggtgaaaagcaccaagaggttttcagatggaagtgagaggtgacagtgtgctggcagccctcacagccctcgcttgctctccctgccgcctctgcctgggctcccactttggcagcacttgaggagcccttcaacccgccgctgcactgtaggagcccctttctgggctggccaaggccggagccagctccctcagcttgcggggaggtgcggagggagaggggcgggcaggaaccggggctgcgcgcagcgcttgcgggccagagtgagttccgggtgggcgtgggctcggcggggccccactcagagcagctggccggccccaggcagtgagggccttagcacctgggccagcagctgctgtgctcgatttctcgctgggccttagctgcctccccgcggggcagggctcgggacctgcagccctccatgcctgaccctccccccaccccccgtgggctcctgtgcggccggagcctccccaaggagcgccgccccctgctccacagcgcccagtcccatcgaccacccaagggctgaggagtgcgggtgcacagcgcgggactggcaggcagctccacctgctgccccagtgctggatccactgggtgaagccagctgggctcctgagtctggtggggacttggagaacctttatgtctagctaagggattgtaaatacaccgatgggcactctgtatctagctcaaggtttgtaaacacaccaatcagcaccctgtgtctagctcagtgtttgtgaatgcaccaatccacactctgtatctggctactctggtggggacttggagaacctttgtgtccacactctgtatctagctaatctagtggggatgtggagaacctttgtgtctagctcagggatcgtaaacgcaccaatcagcaccctgtcaaaacagaccacttgactctctgtaaaatggaccaatcagcaggatgtgggtggggcgagacaagagaataaaagcaggctgcctgagccagcagtgacaacccccctcgggtcccctcccacgccgtggaagctttgttctttcgctctttgcaataaatcttgctactgccc

SEQ ID NO: 4593 - DNA, 3817 bp, Homo sapiens
gtgctgaagggcagggatcttattccaccttctgaagcttctgtcgaaccagttgtaaggagaatggagagagcagtgagagtggagtccggggtcctggtcggggtggtctgtctgctcctggcatgccctgccacagccactgggcccgaagttgctcagcctgaagtagacaccaccctgggtcgtgtgcgaggccggcaggtgggcgtgaagggcacagaccgccttgtgaatgtctttctgggcattccatttgcccagccgccactgggccctgaccggttctcagccccacacccagcacagccctgggagggtgtgcgggatgccagcactgcgcccccaatgtgcctacaagacgtggagagcatgaacagcagcagatttgtcctcaacggaaaacagcagatcttctccgtttcagaggactgcctggtcctcaacgtctatagcccagctgaggtccccgcagggtccggtaggccggtcatggtatgggtccatggaggcgctctgataactggcgctgccacctcctacgatggatcagctctggctgcctatggggatgtggtcgtggttacagtccagtaccgccttggggtccttggcttcttcagcactggagatgagcatgcacctggcaaccagggcttcctagatgtggtagctgctttgcgctgggtgcaagaaaacatcgcccccttcgggggtgacctcaactgtgtcactgtctttggtggatctgccggtgggagcatcatctctggcctggtcctgtccccagtggctgcagggctgttccacagagccatcacacagagtggggtcatcaccaccccagggatcatcgactctcacccttggcccctagctcagaaaatcgcaaacaccttggcctgcagctccagctccccggctgagatggtgcagtgccttcagcagaaagaaggagaagagctggtccttagcaagaagctgaaaaatactatctatcctctcaccgttgatggcactgtcttccccaaaagccccaaggaactcctgaaggagaagcccttccactctgtgcccttcctcatgggtgtcaacaaccatgagttcagctggctcatccccaggggctggggtctcctggatacaatggagcagatgagccgggaggacatgctggccatctcaacacccgtcttgaccagtctggatgtgccccctgagatgatgcccaccgtcatagatgaatacctaggaagcaactcggacgcacaagccaaatgccaggcgttccaggaattcatgggtgacgtattcatcaatgttcccaccgtcagtttttcaagataccttcgagattctggaagccctgtctttttctatgagttccagcatcgacccagttcttttgcgaagatcaaacctgcctgggtgaaggctgatcatggggccgagggtgcttttgtgttcggaggtcccttcctcatggacgagagctcccgcctggaggccacagaggaggagaagcagctaagcctcaccatgatggcccagtggacccactttgcccggacaggggaccccaatagcaaggctctgcctccttggccccaattcaaccaggcggaacaatatctggagatcaacccagtgccacgggccggacagaagttcagggaggcctggatgcagttctggtcagagacgctccccagcaagatacaacagtggcaccagaagcagaagaacaggaaggcccaggaggacctctgaggccaggcctgaaccttcttggctggggcaaaccactcttcaagtggtggcagagtcccagcacggcagcccgcctctccccctgctgagactttaatctccaccagcccttaaagtgtcggccgctctgtgactggagttatgctcttttgaaatgtcacaaggccgcctcccacctctggggcattgtacaagttcttccctctccctgaagtgcctttcctgctttcttcgtggtaggttctagcacattcctctagcttcctggaggactcactcccccaggaagccttccctgccttctctgggctgtgcggccccgagtctgcgtccattagagcacagtccacccgaggctagcaccgtgtctgtgtctgtctccccctcagaggagctctctcaaaatggggattagcctaaccccactctgtcacccacaccaggatcgggtgggacctggagctagggggtgtttgctgagtgagtgagtgaaacacagaatatgggaatggcagctgctgaacttgaacccagagccttcaggtgccaaagccatactcaggcccccaccgacattgtccaccctggccagaagggtgcatgccaatggcagagacctgggatgggagaagtcctggggcgccaggggatccagcctagagcagaccttagcccctgactaaggcctcagactagggcgggaggggtctcctcctctctgctgcccagtcctggcccctgcacaagacaacagaatccatcagggccatgagtgtcacccagacctgaccctcaccaattccagccctgaccctcaggacgctggatgccagctcccagccccagtgccgggtcctccctcccttcctggcttggggagaccagtttctggggagcttccaagagcacccaccaagacacagcaggacaggccaggggagggcatctggaccagggcatccgtcgggctattgtcacagagaaaagaagagacccacccactcgggctgcaaaaggtgaaaagcaccaagaggttttcagatggaagtgagaggtgacagtgtgctggcagccctcacagccctcgcttgctctccctgccgcctctgcctgggctcccactttggcagcacttgaggagcccttcaacccgccgctgcactgtaggagcccctttctgggctggccaaggccggagccagctccctcagcttgcggggaggtgcggagggagaggggcgggcaggaaccggggctgcgcgcagcgcttgcgggccagagtgagttccgggtgggcgtgggctcggcggggccccactcagagcagctggccggccccaggcagtgagggccttagcacctgggccagcagctgctgtgctcgatttctcgctgggccttagctgcctccccgcggggcagggctcgggacctgcagccctccatgcctgaccctccccccaccccccgtgggctcctgtgcggccggagcctccccaaggagcgccgccccctgctccacagcgcccagtcccatcgaccacccaagggctgaggagtgcgggtgcacagcgcgggactggcaggcagctccacctgctgccccagtgctggatccactgggtgaagccagctgggctcctgagtctggtggggacttggagaacctttatgtctagctaagggattgtaaatacaccgatgggcactctgtatctagctcaaggtttgtaaacacaccaatcagcaccctgtgtctagctcagtgtttgtgaatgcaccaatccacactctgtatctggctactctggtggggacttggagaacctttgtgtccacactctgtatctagctaatctagtggggatgtggagaacctttgtgtctagctcagggatcgtaaacgcaccaatcagcaccctgtcaaaacagaccacttgactctctgtaaaatggaccaatcagcaggatgtgggtggggcgagacaagagaataaaagcaggctgcctgagccagcagtgacaacccccctcgggtcccctccca

SEQ ID NO: 4594 - DNA, 2335 bp, Homo sapiens
accccctctccctgcacctttctttatcttggagcctctcccatctctccctccctcttcctccctaccccaccctccgaccaccccacttcttcccctcccctcacacttccctccctcccttctctcgtctcctccccactgcgcctccctccctcctggccttccttcccttccccgactttgcagatttctcttcccccaggcctccctcctccacctctccgccccctccgggcttggctctcccaggaggctacgactggagccactggtcccgcaggatccccgcgtcctcggtcgccgcgtccacgtccctctcgcgtccccgcccggcgccacgccgcctcctctgggttcggcctccgcgcggtgcagcgcagtctcaggccgcgggacaagcccgacttaaatctctgcaatggctaacgaagcttatccttgtccgtgtgacattggccacagacttgagtatggagggctaggccgtgaagttcaagtcgagcacatcaaggcttatgtcaccaaatcccccgttgatgcaggcaaagctgtgattgtcattcaagatatatttggctggcagttgcccaataccagatatatagctgacatgatctcaggaaatggatacacaaccattgttccagacttctttgtagggcaagagccttgggacccctctggcgactggtctatcttccctgagtggctgaaaacaagaaatgcccagaagatcgatagagagatcagtgctatcttgaagtatctgaaacaacagtgtcatgcccagaaaattggcatcgtgggattctgctggggtggaactgctgtccatcatttgatgatgaaatactcagaattcagggcaggggtgtccgtctatggcattgtcaaggattctgaagacatttacaatttaaagaaccccactttgttcatttttgctgaaaatgatgttgtgattccactcaaggacgtatctttgctgactcagaagttgaaagaacactgcaaagttgaatatcaaattaaaacattttctgggcagactcatgggttcgtgcatcggaagagagaagattgctcacctgcagacaagccctacattgacgaggccagaaggaatttaattgagtggctgaacaagtacatgtagcaagaatcaagggcaagccttcctagaatagctttcatcccaaaatttgcttggaaatagttagatcatttgatttaattttcacttttataaaataagtgtaggaatcctaaaattgattatttcatttgaaacacaaattcagtaggacgtaatgcatgaaataatttaatttttgacatgtacatcgaatcataatttaaaaacaaggtctgaccaggtgtagtgcctcatgcctgtaattccagcactttgggaggccaaagtgggtggatcacctgaggtcaggagtttgagaccagcctggccaacatggtgagaccccatctctacaaaaaatacaaaaattagcctggtgtggtggtgcacgcctgtagtcccagctacttgggaggctgaggcacaagaatcaatagaacccaggaggtggagactgcagtgagccaagattgtgccactactgtactctagcctgggcagcagagtgagaccctgtctcaaaaataaataagtaaataaataaataaataaaataaaaaccaggtcagtacctggagaatttgaatgatagagaatgatagagtaataccctaattattagttaaaacctacaggccgggtgcggtggctcacgcctgtaatcccagcactttgggaggccgaggtgggtggatcacttgaggtcaggagttcaagaccagcctggccaacatggtgaaaccccatctctactaaaaatataaaaatcagccgggcatggtggcatgtgcctgtaatcccagctactcaggagtctgaggaggagaatcacttgaacctggaggcagaggttgcagtgagtcgaggttgcgctactgcactccagcctggacaacagagggagactctgtctcaaaaaaaaaaaaaaacctacagctgttcaaggaccagctgacaggtcaagtgtggccttttctggtctttgaacacatcatagaaagtgacaaatgctgcaaagccatgaagaacatgaactataaacgggtagactaactgcccagcttagacacttatctatgccacaaaacagctgaatttgtcacatttatatattgcaatatgggaagtattgagatcaaaacaggattccattgacctaattatattaagctaataaactaattttttgaatttttg

SEQ ID NO: 4595 - DNA, 1487 bp, Homo sapiens
agaactcccaccccagcctccccgtgggacaggacccaggtgctgggggagaacagacctcgggagcagccaggagtcctcggtcctgggagggtttaaaagccagggggccgtctcgacctcagtctgaccttccctcccggcagcagcatgcgggggttgctggtgttgagtgtcctgttgggggctgtctttggcaaggaggactttgtggggcatcaggtgctccgaatctctgtagccgatgaggcccaggtacagaaggtgaaggagctggaggacctggagcacctgcagctggacttctggcgggggcctgcccaccctggctcccccatcgacgtccgagtgcccttccccagcatccaggcggtcaagatctttctggagtcccacggcatcagctatgagaccatgatcgaggacgtgcagtcgctgctggacgaggagcaggagcagatgttcgccttccggtcccgggcgcgctccaccgacacttttaactacgccacctaccacaccctggaggagatctatgacttcctggacctgctggtggcggagaacccgcaccttgtcagcaagatccagattggcaacacctatgaagggcgtcccatttacgtgctgaagttcagcacggggggcagtaagcgtccagccatctggatcgacacgggcatccattcccgggagtgggtcacccaggccagtggggtctggtttgcaaagaagatcactcaagactacgggcaggatgcagctttcaccgccattctcgacaccttggacatcttcctggagatcgtcaccaaccctgatggctttgccttcacgcacagcacgaatcgcatgtggcgcaagactcggtcccacacagcaggctccctctgtattggcgtggaccccaacaggaactgggacgctggctttgggttgtccggagccagcagtaacccctgctcggagacttaccacggcaagtttgccaattccgaagtggaggtcaagtccattgtagactttgtgaaggaccatgggaacatcaaggccttcatctccatccacagctactcccagctcctcatgtatccctatggctacaaaacagaaccagtccctgaccaggatgagctggatcagctttccaaggctgctgtgacagccctggcctctctctacgggaccaagttcaactatggcagcatcatcaaggcaatttatcaagccagtggaagcactattgactggacctacagccagggcatcaagtactccttcaccttcgagctccgggacactgggcgctatggcttcctgctgccagcctcccagatcatccccacagccaaggagacgtggctggcgcttctgaccatcatggagcacaccctgaatcacccctactgagctgaccctttgacacccttcttgtcctcctctctggccccatccaggcaaccaaataaagtttgagtgtaccagga

SEQ ID NO: 4596 - DNA, 1366 bp, Homo sapiens
atccctacaaataaagttcaggaaggactctgaattctggactccaggaaaacccatggccatgaggttgatcctgttttttggtgccctttttgggcatatctactgtctagaaacatttgtgggagaccaagttcttgagattgtaccaagcaatgaagaacaaattaaaaatctgctacaattggaggctcaagaacatctccagcttgatttttggaaatcacccaccaccccaggggagacagcccacgtccgagttcccttcgtcaacgtccaggcagtcaaagtgttcttggagtcccagggaattgcctattccatcatgattgaagacgtgcaggtcctgttggacaaagagaatgaagaaatgctttttaataggagaagagaacggagtggtaacttcaattttggggcctaccataccctggaagagatttcccaagaaatggataacctcgtggctgagcaccctggtctagtgagcaaagtgaatattggctcttcttttgagaaccggcctatgaacgtgctcaagttcagcaccggaggagacaagccagctatctggctggatgctgggatccatgctcgagagtgggttacacaagctacggcactttggacagcaaataagattgtttctgattatggaaaggacccatccatcacttccattctggatgccctggatatcttcctcctgccagtcacaaaccctgatggatacgtgttctctcaaaccaaaaatcgtatgtggcggaagacccggtccaaggtatctggaagcctctgtgttggtgtggatcctaaccggaactgggatgcaggttttggaggacctggagccagcagcaacccttgctctgattcataccacggacccagtgccaactctgaagttgaagtgaaatccatagtggacttcatcaagagtcatggaaaagtcaaggccttcattaccctccacagctattcccagctgctgatgttcccctatgggtacaaatgtaccaagttagatgactttgatgagctgagtgaagtggcccaaaaggctgcccaatctctgagaagcctgcatggcaccaagtacaaagtgggaccaatctgctctgtcatctaccaagccagtggaggaagcattgactggtcctatgattatggcatcaagtactcatttgcctttgaactgagagacacagggcgctacggcttcctcttgccagcccgtcagatcctgcccacagccgaggagacctggcttggcttgaaggcaatcatggagcatgtgcgagaccacccctattagggccctggggaagaaacaagagccattaaaatctctttggtttgaagcaaa

SEQ ID NO: 4597 - DNA, 1795 bp, Homo sapiens
agggctgaggcataaaactgccagagggtctcaaggcaggcaaagaagaaccatgaggctcatcctgcctgtgggtttgattgctaccactcttgcaattgctcctgtccgctttgacagggagaaggtgttccgcgtgaagccccaggatgaaaaacaagcagacatcataaaggacttggccaaaaccaatgagcttgacttctggtatccaggtgccacccaccacgtagctgctaatatgatggtggatttccgagttagtgagaaggaatcccaagccatccagtctgccttggatcaaaataaaatgcactatgaaatcttgattcatgatctacaagaagagattgagaaacagtttgatgttaaagaagatatcccaggcaggcacagctacgcaaaatacaataattgggaaaagattgtggcttggactgaaaagatgatggataagtatcctgaaatggtctctcgtattaaaattggatctactgttgaagataatccactatatgttctgaagattggggaaaagaatgaaagaagaaaggctatttttacggattgtggcattcacgcacgagaatgggtctccccagcattctgccagtggtttgtctatcaggcaaccaaaacttatgggagaaacaaaattatgaccaaactcttggaccgaatgaatttttacattcttcctgtgttcaatgttgatggatatatttggtcatggacaaagaaccgcatgtggagaaaaaatcgttccaagaaccaaaactccaaatgcatcggcactgacctcaacaggaattttaatgcttcatggaactccattcctaacaccaatgacccatgtgcagataactatcggggctctgcaccagagtccgagaaagagacgaaagctgtcactaatttcattagaagccacctgaatgaaatcaaggtttacatcaccttccattcctactcccagatgctattgtttccctatggatatacatcaaaactgccacctaaccatgaggacttggccaaagttgcaaagattggcactgatgttctatcaactcgatatgaaacccgctacatctatggcccaatagaatcaacaatttacccgatatcaggttcttctttagactgggcttatgacctgggcatcaaacacacatttgcctttgagctccgagataaaggcaaatttggttttctccttccagaatcccggataaagccaacgtgcagagagaccatgctagctgtcaaatttattgccaagtatatcctcaagcatacttcctaaagaactgccctctgtttggaataagccaattaatccttttttgtgcctttcatcagaaagtcaatcttcagttatccccaaatgcagcttctatttcacctgaatccttctcttgctcatttaagtcccatgttactgctgtttgcttttacttactttcagtagcaccataacgaagtagctttaagtgaaaccttttaactacctttctttgctccaagtgaagtttggacccagcagaaagcattattttgaaaggtgatatacagtggggcacagaaaacaaatgaaaaccttcagtttctcacagattttcaccatgtggcttcatcaatttatgtgctaatacaataaaataaaatgcacttaatgctttaaaattcatctttttatgataaactatattctctgtatttctctatagcattaataatcaatattaatgccattcattcagtctgttaataagaaataatatcttcaattttc

SEQ ID NO: 4598 - DNA, 2797 bp, Homo sapiens
gccactgtatgactgactccccggggacatgaggtggatactgttcattggggcccttattgggtccagcatctgtggccaagaaaaattttttggggaccaagttttgaggattaatgtcagaaatggagacgagatcagcaaattgagtcaactagtgaattcaaacaacttgaagctcaatttctggaaatctccctcctccttcaatcggcctgtggatgtcctggtcccatctgtcagtctgcaggcatttaaatccttcctgagatcccagggcttagagtacgcagtgacaattgaggacctgcaggcccttttagacaatgaagatgatgaaatgcaacacaatgaagggcaagaacggagcagtaataacttcaactacggggcttaccattccctggaagctatttaccacgagatggacaacattgccgcagactttcctgacctggcgaggagggtgaagattggacattcgtttgaaaaccggccgatgtatgtactgaagttcagcactgggaaaggcgtgaggcggccggccgtttggctgaatgcaggcatccattcccgagagtggatctcccaggccactgcaatctggacggcaaggaagattgtatctgattaccagagggatccagctatcacctccatcttggagaaaatggatattttcttgttgcctgtggccaatcctgatggatatgtgtatactcaaactcaaaaccgattatggaggaagacgcggtcccgaaatcctggaagctcctgcattggtgctgacccaaatagaaactggaacgctagttttgcaggaaagggagccagcgacaacccttgctccgaagtgtaccatggaccccacgccaattcggaagtggaggtgaaatcagtggtagatttcatccaaaaacatgggaatttcaagggcttcatcgacctgcacagctactcgcagctgctgatgtatccatatgggtactcagtcaaaaaggccccagatgccgaggaactcgacaaggtggcgaggcttgcggccaaagctctggcttctgtgtcgggcactgagtaccaagtgggtcccacctgcaccactgtctatccagctagcgggagcagcatcgactgggcatatgacaacggcatcaaatttgcattcacatttgagttgagagataccgggacctatggcttcctcctgccagctaaccagatcatccccactgcagaggagacgtggctggggctgaagaccatcatggagcatgtgcgggacaacctctactaggcgatggctctgctctgtctacatttatttgtacccacacgtgcacgcactgaggccattgttaaaggagctctttcctacctgtgtgagtcagagccctctgggtttgtggagcacacaggcctgcccctctccagccagctccctggagtcgtgtgtcctggcagtgtccctgcaagaactggttctgccagcctgctcaattttggtcctgctgtttttgatgagccttttgtctgtttctccttccaccctgctggctgggcggctgcactcagcatcaccccttcctgggtggcatgtctctctctacctcatttttagaaccaaagaacatctgagatgattctctaccctcatccacatctagccaagccagtgaccttgctctggtggcactgtgggagacaccacttgtctttaggtgggtctcaaagatgatgtagaatttcctttaatttctcgcagtcttcctggaaaatattttcctttgagcagcaaatcttgtagggatatcagtgaaggtctctccctccctcctctcctgtttttttttttttgagacagagttttgctcttgttgcccaggctggagtgtgatggctcgatcttggctcaccacaacctctgcctcctgggttcaagcaattctcctgcctcagcctcttgagtagcttggtttataggcgcatgccaccatgcctggctaattttgtgtttttagtagagacagggtttctccatgttggtcaggctggtctcaaactcccaacctcaggtgatctgccctccttggcctcccagagtgctgggattacaggtgtgagccactgtgccgggcccgtcccctccttttttaggcctgaatacaaagtagaagatcactttccttcactgtgctgagaatttctagatactacagttcttactcctctcttccctttgttattcagtgtgaccaggatggcgggaggggatctgtgtcactgtaggtactgtgcccaggaaggctgggtgaagtgaccatctaaattgcaggatggtgaaattatccccatctgtcctaatgggcttacctcctctttgccttttgaactcacttcaaagatctaggcctcatcttacaggtcctaaatcactcatctggcctggataatctcactgccctggcacattcccatttgtgctgtggtgtatcctgtgtttccttgtcctggtttgtgtgtgtgtgtgtgtgtgtgtgtgtgtgtgtgtgtgtgtttgtgtgtgtgtgtctgtctattttgtatcctggaccacaagttcctaagtagagcaagaattcatcaaccagctgcctcttgtttcatttcacctcagcacgtaccatctgtccttttgttgttgttttgtttttgtttttttgcttttaccaaacatgtctgtaaatcttaacctcctgcctaggatttgtacagcatctggtgtgtgcttataagccaataaatattcaatgtgagtttc

SEQ ID NO: 4599 - DNA, 2718 bp, Homo sapiens
ataaatacagcttgactcagccactgtatgactgactccccggggacatgaggtggatactgttcattggggcccttattgggtccagcatctgtggccaagaaaaattttttggggaccaagttttgaggattaatgtcagaaatggagacgagatcagcaaattgagtcaactagtgaattcaaacaacttgaagctcaatttctggaaatctccctcctccttcaatcggcctgtggatgtcctggtcccatctgtcagtctgcaggcatttaaatccttcctgagatcccagggcttagagtacgcagtgacaattgaggacctgcagatttaccacgagatggacaacattgccgcagactttcctgacctggcgaggagggtgaagattggacattcgtttgaaaaccggccgatgtatgtactgaagttcagcactgggaaaggcgtgaggcggccggccgtttggctgaatgcaggcatccattcccgagagtggatctcccaggccactgcaatctggacggcaaggaagattgtatctgattaccagagggatccagctatcacctccatcttggagaaaatggatattttcttgttgcctgtggccaatcctgatggatatgtgtatactcaaactcaaaaccgattatggaggaagacgcggtcccgaaatcctggaagctcctgcattggtgctgacccaaatagaaactggaacgctagttttgcaggaaagggagccagcgacaacccttgctccgaagtgtaccatggaccccacgccaattcggaagtggaggtgaaatcagtggtagatttcatccaaaaacatgggaatttcaagggcttcatcgacctgcacagctactcgcagctgctgatgtatccatatgggtactcagtcaaaaaggccccagatgccgaggaactcgacaaggtggcgaggcttgcggccaaagctctggcttctgtgtcgggcactgagtaccaagtgggtcccacctgcaccactgtctatccagctagcgggagcagcatcgactgggcatatgacaacggcatcaaatttgcattcacatttgagttgagagataccgggacctatggcttcctcctgccagctaaccagatcatccccactgcagaggagacgtggctggggctgaagaccatcatggagcatgtgcgggacaacctctactaggcgatggctctgctctgtctacatttatttgtacccacacgtgcacgcactgaggccattgttaaaggagctctttcctacctgtgtgagtcagagccctctgggtttgtggagcacacaggcctgcccctctccagccagctccctggagtcgtgtgtcctggcagtgtccctgcaagaactggttctgccagcctgctcaattttggtcctgctgtttttgatgagccttttgtctgtttctccttccaccctgctggctgggcggctgcactcagcatcaccccttcctgggtggcatgtctctctctacctcatttttagaaccaaagaacatctgagatgattctctaccctcatccacatctagccaagccagtgaccttgctctggtggcactgtgggagacaccacttgtctttaggtgggtctcaaagatgatgtagaatttcctttaatttctcgcagtcttcctggaaaatattttcctttgagcagcaaatcttgtagggatatcagtgaaggtctctccctccctcctctcctgtttttttttttttgagacagagttttgctcttgttgcccaggctggagtgtgatggctcgatcttggctcaccacaacctctgcctcctgggttcaagcaattctcctgcctcagcctcttgagtagcttggtttataggcgcatgccaccatgcctggctaattttgtgtttttagtagagacagggtttctccatgttggtcaggctggtctcaaactcccaacctcaggtgatctgccctccttggcctcccagagtgctgggattacaggtgtgagccactgtgccgggcccgtcccctccttttttaggcctgaatacaaagtagaagatcactttccttcactgtgctgagaatttctagatactacagttcttactcctctcttccctttgttattcagtgtgaccaggatggcgggaggggatctgtgtcactgtaggtactgtgcccaggaaggctgggtgaagtgaccatctaaattgcaggatggtgaaattatccccatctgtcctaatgggcttacctcctctttgccttttgaactcacttcaaagatctaggcctcatcttacaggtcctaaatcactcatctggcctggataatctcactgccctggcacattcccatttgtgctgtggtgtatcctgtgtttccttgtcctggtttgtgtgtgtgtgtgtgtgtgtgtgtgtgtgtgtgtgtgtgtttgtgtgtgtgtgtctgtctattttgtatcctggaccacaagttcctaagtagagcaagaattcatcaaccagctgcctcttgtttcatttcacctcagcacgtaccatctgtccttttgttgttgttttgtttttgtttttttgcttttaccaaacatgtctgtaaatcttaacctcctgcctaggatttgtacagcatctggtgtgtgcttataagccaataaatattcaatgtgagtttca

SEQ ID NO: 4600 - DNA, 1621 bp, Homo sapiens
tgactgactccccggggacatgaggtggatactgttcattggggcccttattgggtccagcatctgtggccaagaaaaattttttggggaccaagttttgaggattaatgtcagaaatggagacgagatcagcaaattgagtcaactagtgaattcaaacaacttgaagctcaatttctggaaatctccctcctccttcaatcggcctgtggatgtcctggtcccatctgtcagtctgcaggcatttaaatccttcctgagatcccagggcttagagtacgcagtgacaattgaggacctgcaggcccttttagacaatgaagattgtatctgattaccagagggatccagctatcacctccatcttggagaaaatggatattttcttgttgcctgtggccaatcctgatggatatgtgtatactcaaactcaaaaccgattatggaggaagacgcggtcccgaaatcctggaagctcctgcattggtgctgacccaaatagaaactggaacgctagttttgcaggaaagggagccagcgacaacccttgctccgaagtgtaccatggaccccacgccaattcggaagtggaggtgaaatcagtggtagatttcatccaaaaacatgggaatttcaagggcttcatcgacctgcacagctactcgcagctgctgatgtatccatatgggtactcagtcaaaaaggccccagatgccgaggaactcgacaaggtggcgaggcttgcggccaaagctctggcttctgtgtcgggcactgagtaccaagtgggtcccacctgcaccactgtctatccagctagcgggagcagcatcgactgggcatatgacaacggcatcaaatttgcattcacatttgagttgagagataccgggacctatggcttcctcctgccagctaaccagatcatccccactgcagaggagacgtggctggggctgaagaccatcatggagcatgtgcgggacaacctctactaggcgatggctctgctctgtctacatttatttgtacccacacgtgcacgcactgaggccattgttaaaggagctctttcctacctgtgtgagtcagagccctctgggtttgtggagcacacaggcctgcccctctccagccagctccctggagtcgtgtgtcctggcagtgtccctgcaagaactggttctgccagcctgctcaattttggtcctgctgtttttgatgagccttttgtctgtttctccttccaccctgctggctgggcggctgcactcagcatcaccccttcctgggtggcatgtctctctctacctcatttttagaaccaaagaacatctgagatgattctctaccctcatccacatctagccaagccagtgaccttgctctggtggcactgtgggagacaccacttgtctttaggtgggtctcaaagatgatgtagaatttcctttaatttctcgcagtcttcctggaaaatattttcctttgagcagcaaatcttgtagggatatcagtgaaggtctctccctccctcctctcctgtttttttttttttgagacagagttttgctcttgttgcccaggctggagtgtgatggctcgatcttggctcaccaca

SEQ ID NO: 4601 - DNA, 1616 bp, Homo sapiens
aagatcaggctcagctgctgctgctgctgctgctgcttgtcccaagaccaagtcgtaatagcaacttcccttcctcagctgcctgaactttttttttcccttgtagctggagagaagtgtcacattttgctcactctcaaccttcctcgcccacccccttcccggagaacctgtgcggtgtgtagagggtgctgtgagccacctccagcctcgggtggctgcttaagtaactttcaactcctctcttcttaacactatgaagtgtctcgggaagcgcaggggccaggcagctgctttcctgcctctttgctggctctttttgaagattctgcaaccggggcacagccacctttataacaaccgctatgctggtgataaagtgataagatttattcccaaaacagaagaggaagcatatgcactgaagaaaatatcctatcaacttaaggtggacctgtggcagcccagcagtatctcctatgtatcagagggaacagttactgatgtccatatcccccaaaatggttcccgagccctgttagccttcttacaggaagccaacatccagtacaaggtcctcatagaagatcttcagaaaacactggagaagggaagcagcttgcacacccagagaaaccgaagatccctctctggatataattatgaagtttatcactccttagaagaaattcaaaattggatgcatcatctgaataaaactcactcaggcctcattcacatgttctctattggaagatcatatgagggaagatctctttttattttaaagctgggcagacgatcacgactcaaaagagctgtttggatagactgtggtattcatgcaagagaatggattggtcctgccttttgtcagtggtttgtaaaagaagctcttctaacatataagagtgacccagccatgagaaaaatgttgaatcatctatatttctatatcatgcctgtgtttaacgtcgatggataccattttagttggaccaatgatcgattttggagaaaaacaaggtcaaggaactcaaggtttcgctgccgtggagtggatgccaatagaaactggaaagtgaagtggtgtgatgtgagctctggtagctcaatggattgggcctacaaaaatggaataccttatgcatttgctttcgaactacgtgacactggatattttggatttttactcccagagatgctcatcaaacccacctgtacagaaactatgctggctgtgaaaaatatcacaatgcacctgctaaagaaatgtccctgagacagcccaaggctcaggtcaactgccataggattctgagcaaggcctacttggccctggatagaaattgttttcaaagagaagggcagctgcttagagtgaacatgtctatggactttaaaaagaccccacgcaatttgactttgtggcaatagaaaacagtaaaaaacagggcatagcctagtttgttataagaaaaagcatccattttctatccttttagagtcttatttgattatggtgggagggaatgttttcaaatttcccatttctcaagaaatgttcatattaattgaggatttcccttcaataaatctcatgtcctcaattagga

SEQ ID NO: 4602 - DNA, 1861 bp, Homo sapiens
cccaagaccaagtcgtaatagcaacttcccttcctcagctgcctgaactttttttttcccttgtagctggagagaagtgtcacattttgctcactctcaaccttcctcgcccacccccttcccggagaacctgtgcggtgtgtagagggtgctgtgagccacctccagcctcgggtggctgcttaagtaactttcaactcctctcttcttaacactatgaagtgtctcgggaagcgcaggggccaggcagctgctttcctgcctctttgctggctctttttgaagattctgcaaccggggcacagccacctttataacaaccgctatgctggtgataaagtgataagatttattcccaaaacagaagaggaagcatatgcactgaagaaaatatcctatcaacttaaggtggacctgtggcagcccagcagtatctcctatgtatcagagggaacagttactgatgtccatatcccccaaaatggttcccgagccctgttagccttcttacaggaagccaacatccagtacaaggtcctcatagaagatcttcagaaaacactggagaagggaagcagcttgcacacccagagaaaccgaagatccctctctggatataattatgaagtttatcactccttagaagaaattcaaaattggatgcatcatctgaataaaactcactcaggcctcattcacatgttctctattggaagatcatatgagggaagatctctttttattttaaagctgggcagacgatcacgactcaaaagagctgtttggatagactgtggtattcatgcaagagaatggattggtcctgccttttgtcagtggtttgtaaaagaagctcttctaacatataagagtgacccagccatgagaaaaatgttgaatcatctatatttctatatcatgcctgtgtttaacgtcgatggataccattttagttggaccaatgatcgattttggagaaaaacaaggtcaaggaactcaaggtttcgctgccgtggagtggatgccaatagaaactggaaagtgaagtggtgtgatgaaggagcttctatgcacccttgtgatgacacatactgtggcccttttccagaatctgagccggaagtgaaggctgtagctaacttccttcgaaaacacagaaagcacattagggcttatctctcctttcatgcatatgctcagatgttactgtatccctattcttacaaatatgcaacaattcccaattttagatgtgtggaatctgcagcttataaagctgtgaatgcacttcagtcagtatacggggtacgatacagatatggaccagcctccacaacgttgtatgtgagctctggtagctcaatggattgggcctacaaaaatggaataccttatgcatttgctttcgaactacgtgacactggatattttggatttttactcccagagatgctcatcaaacccacctgtacagaaactatgctggctgtgaaaaatatcacaatgcacctgctaaagaaatgtccctgagacagcccaaggctcaggtcaactgccataggattctgagcaaggcctacttggccctggatagaaattgttttcaaagagaagggcagctgcttagagtgaacatgtctatggactttaaaaagaccccacgcaatttgactttgtggcaatagaaaacagtaaaaaacagggcatagcctagtttgttataagaaaaagcatccattttctatccttttagagtcttatttgattatggtgggagggaatgttttcaaatttcccatttctcaagaaatgttcatattaattgaggatttcccttcaataaatctcatgtcctcaatta

SEQ ID NO: 4603 - DNA, 1538 bp, Homo sapiens
caagaccaagtcgtaatagcaacttcccttcctcagctgcctgaactttttttttcccttgtagctggagagaagtgtcacattttgctcactctcaaccttcctcgcccacccccttcccggagaacctgtgcggtgtgtagagggtgctgtgagccacctccagcctcgggtggctgcttaagtaactttcaactcctctcttcttaacactatgaagtgtctcgggaagcgcaggggccaggcagctgctttcctgcctctttgctggctctttttgaagattctgcaaccggggcacagccacctttataacaaccgctatgctggtgataaagtgataagatttattcccaaaacagaagaggaagcatatgcactgaagaaaatatcctatcaacttaaggtggacctgtggcagcccagcagtatctcctatgtatcagagggaacagttactgatgtccatatcccccaaaatggttcccgagccctgttagccttcttacaggaagccaacatccagtacaaggtcctcatagaagatcttcagaaaacactggagaagggaagcagcttgcacacccagagaaaccgaagatccctctctggatataattatgaagtttatcactccttagaagaaattcaaaattggatgcatcatctgaataaaactcactcaggcctcattcacatgttctctattggaagatcatatgagggaagatctctttttattttaaagctgggcagacgatcacgactcaaaagagctgtttggatagactgtggtattcatgcaagagaatggattggtcctgccttttgtcagtggtttgtaaaagaagctcttctaacatataagagtgacccagccatgagaaaaatgttgaatcatctatatttctatatcatgcctgtgtttaacgtcgatggataccattttagttggaccaatgatcgattttggagaaaaacaaggtcaaggaactcaaggtttcgctgccgtggagtggatgccaatagaaactggaaagtgaagtggtgtggtaagtttgggaccaactgggatccagatccaaaggtttctgcaggttttactctgcaaaatatgagtccagaggactctcatgggagactcatgtttttctgtatgtgaaaacctggtagagaaaggtacagatacgtacatgatagctgtaattggcaaaagaaaatgaaaggattcttttttaatatataaaaatcaaggattttaaatatgtcaattcggtcctgaaaactgaaaatttaaatacatatgtaaaagcagcaaactgaggaatatttgtcattccccaaattaaaacatgaaccgtggtgtagtataattctggttaaatctttttatccttttcatacaagcaccactgatgctgcattcggctgtctgtcgtggtcagagctgtcatgaccttgtctatattctaccactctgctggtcatacgtggattgaccatgcacattgggaatgtatttctgctgcattccatgt

SEQ ID NO: 4604 - DNA, 1717 bp, Homo sapiens
agaaaattgctgttgggatgaagctttgcagccttgcagtccttgtacccattgttctcttctgtgagcagcatgtcttcgcgtttcagagtggccaagttctagctgctcttcctagaacctctaggcaagttcaagttctacagaatcttactacaacatatgagattgttctctggcagccggtaacagctgaccttattgtgaagaaaaaacaagtccatttttttgtaaatgcatctgatgtcgacaatgtgaaagcccatttaaatgtgagcggaattccatgcagtgtcttgctggcagatgtggaagatcttattcaacagcagatttccaacgacacagtcagcccccgagcctccgcatcgtactatgaacagtatcactcactaaatgaaatctattcttggatagaatttataactgagaggcatcctgatatgcttacaaaaatccacattggatcctcatttgagaagtacccactctatgttttaaaggtttctggaaaagaacaagcagccaaaaatgccatatggattgactgtggaatccatgccagagaatggatctctcctgctttctgcttgtggttcataggccatataactcaattctatgggataatagggcaatataccaatctcctgaggcttgtggatttctatgttatgccagtggttaatgtggatggttatgactactcatggaaaaagaatcgaatgtggagaaagaaccgttctttctatgcgaacaatcattgcatcggaacagacctgaataggaactttgcttccaaacactggtgtgaggaaggtgcatccagttcctcatgctcggaaacctactgtggactttatcctgagtcagaaccagaagtgaaggcagtggctagtttcttgagaagaaatatcaaccagattaaagcatacatcagcatgcattcatactcccagcatatagtgtttccatattcctatacacgaagtaaaagcaaagaccatgaggaactgtctctagtagccagtgaagcagttcgtgctattgagaaaattagtaaaaataccaggtatacacatggccatggctcagaaaccttatacctagctcctggaggtggggacgattggatctatgatttgggcatcaaatattcgtttacaattgaacttcgagatacgggcacatacggattcttgctgccggagcgttacatcaaacccacctgtagagaagcttttgccgctgtctctaaaatagcttggcatgtcattaggaatgtttaatgcccctgattttatcattctgcttccgtattttaatttactgattccagcaagaccaaatcattgtatcaaattatttttaagttttatccgtagttttgataaaagattttcctattccttggttctgtcagagaacctaataagtgctactttgccattaaggcagactagggttcatgtctttttaccctttaaaaaaaattgtaaaagtctagttacctactttttctttgattttcgacgtttgactagccatctcaagcaagtttcgacgtttgactagccatctcaagcaagtttaatcaatgatcatctcacgctgatcattggatcctactcaacaaaaggaagggtggtcagaagtacattaaagatttctgctccaaattttcaataaatttctgcttgtgcctttagaaatacaa

SEQ ID NO: 4605 - DNA, 1544 bp, Homo sapiens
agaaaattgctgttgggatgaagctttgcagccttgcagtccttgtacccattgttctcttctgtgagcagcatgtcttcgcgtttcagagtggccaagttctagctgctcttcctagaacctctaggcaagttcaagttctacagaatcttactacaacatatgagattgttctctggcagccggtaacagctgaccttattgtgaagaaaaaacaagtccatttttttgtaaatgcatctgatgtcgacaatgtgaaagcccatttaaatgtgagcggaattccatgcagtgtcttgctggcagatgtggaagatcttattcaacagcagatttccaacgacacagtcagcccccgagcctccgcatcgtactatgaacagtatcactcactaaatgaaatctattcttggatagaatttataactgagaggcatcctgatatgcttacaaaaatccacattggatcctcatttgagaagtacccactctatgttttaaaggtttctggaaaagaacaagcagccaaaaatgccatatggattgactgtggaatccatgccagagaatggatctctcctgctttctgcttgtggttcataggccataatcgaatgtggagaaagaaccgttctttctatgcgaacaatcattgcatcggaacagacctgaataggaactttgcttccaaacactggtgtgaggaaggtgcatccagttcctcatgctcggaaacctactgtggactttatcctgagtcagaaccagaagtgaaggcagtggctagtttcttgagaagaaatatcaaccagattaaagcatacatcagcatgcattcatactcccagcatatagtgtttccatattcctatacacgaagtaaaagcaaagaccatgaggaactgtctctagtagccagtgaagcagttcgtgctattgagaaaattagtaaaaataccaggtatacacatggccatggctcagaaaccttatacctagctcctggaggtggggacgattggatctatgatttgggcatcaaatattccgttacatcaaacccacctgtagagaagcttttgccgctgtctctaaaatagcttggcatgtcattaggaatgtttaatgcccctgattttatcattctgcttccgtattttaatttactgattccagcaagaccaaatcattgtatcaaattatttttaagttttatccgtagttttgataaaagattttcctattccttggttctgtcagagaacctaataagtgctactttgccattaaggcagactagggttcatgtctttttaccctttaaaaaaaattgtaaaagtctagttacctactttttctttgattttcgacgtttgactagccatctcaagcaagtttcgacgtttgactagccatctcaagcaagtttaatcaatgatcatctcacgctgatcattggatcctactcaacaaaaggaagggtggtcagaagtacattaaagatttctgctccaaattttcaataaatttctgcttgtgccttt

SEQ ID NO: 4606 - DNA, 9098 bp, Homo sapiens
gccgcccggagcgctgagccgcgggagcggagccggggttagcggcgctgctggaagatggcgagcggccgggacgagcggccgccttggcggctagggcggctcctgttgctcatgtgcctgctgctgctggggagctcggcccgggcggctcacatcaagaaggcggaggcgactaccacaactacgagcgcgggcgccgaggcggccgagggccagttcgaccgctactaccacgaagaggagttggagtcggcgctgagggaggcggcggccgcgggcctccccggcctggcccgcctctttagcatcggccgctcggtggaaggccggccgctgtgggtgcttcgcctcaccgccggcctggggtcgctaatccctgagggcgacgcggggcctgacgctgccgggcccgacgctgcggggccgctgctgcccggccggccccaggtgaagctggtgggcaacatgcatggcgacgagaccgtgtcgcgccaggtgttgatctacttggcccgcgagctggcggccggctaccgccgcggggacccgcgcctggtccgcctgctcaacaccaccgacgtgtacctgctgcccagcctcaaccccgatggcttcgagcgtgcccgcgagggcgactgtggcttcggcgacggcggcccgtccggggccagcggccgcgacaatagtcgcggccgcgacctcaaccgaagctttcccgaccagtttagcaccggcgaaccccccgccctggacgaggtgcccgaggtgcgcgccctcatcgagtggatccgcaggaacaagtttgtgctttctggaaatctgcatggtggctcagtggtagcaagctatccttttgatgattctccagaacataaggccactggaatctatagcaaaacctcagatgatgaagtatttaaatacttggcaaaagcttatgcttcaaaccaccccataatgaaaactggtgagcctcattgtccaggagatgaagacgagactttcaaagatggaatcacaaacggcgcacattggtatgatgtggaaggtggtatgcaagattacaattatgtgtgggccaactgttttgagatcacattagaactgtcttgttgcaagtacccacctgcttcacagcttcgacaggaatgggagaacaatcgtgagtctttgatcacattgattgaaaaggttcacattggagtgaaaggatttgttaaagattccataacaggatctgggttagagaatgcaaccatctcagtggctggtattaatcataatatcacaacaggcagatttggtgatttctaccgattacttgttcctggaacttacaaccttacagtagttttaactgggtatatgccattgactgttactaatgtagtggtgaaagaaggaccagccacagaggtggatttttctcttaggccaactgtaacttcagtaatccctgacacgacagaggctgtatcaactgctagcacagttgctatacctaatattctttctggaacatcatcctcctaccagccaattcagccaaaggactttcaccaccaccatttccctgatatggaaatcttcttgagaaggtttgccaatgaatatcctaacattacccggctttattccttgggaaaatcagtagagtcaagagaactttatgtgatggagatatctgataatccgggtgtccatgaaccaggtgaaccagaatttaagtacattggaaatatgcatggaaatgaagtggttggaagagaactgctgttgaacctcatagaatacctttgtaagaactttggaacagaccctgaagtcacagatttggttcataacactagaattcaccttatgccatccatgaatcctgatgggtatgaaaagtcccaggaaggagattcaataagtgtaattggcagaaacaacagcaacaactttgacctgaaccgaaatttcccagaccagtttgttcagatcacagatcctacgcaaccagaaactattgctgtaatgagctggatgaagtcctatccatttgtactttcagcaaacctgcatggaggttctttggtggttaactacccttttgatgatgatgaacaaggacttgccacatatagtaaatcaccagatgatgctgtgttccaacaaatagcactttcttattccaaggaaaattcccagatgtttcaaggtagaccttgcaagaatatgtatcctaatgaatattttcctcatggaataacaaatggagctagttggtataatgtgccaggaggaatgcaggactggaactatttacaaacaaattgctttgaagtgactattgaactaggttgtgtgaaatatccacttgagaaagagctgccaaacttttgggaacagaatcgaagatcactaatccagtttatgaaacaggttcatcagggcgtcagaggatttgttctagatgccacagatggcaggggtatattaaatgccaccattagtgttgctgagattaatcacccagtgactacttacaaaactggagattactggcgtctcttggttccaggaacttataaaatcacagcatctgctcgagggtataatccagttaccaagaatgtgactgtcaagagtgaaggcgctattcaggtcaacttcacacttgttcgatcctcaacagattcaaacaatgaatcaaagaaaggaaaaggggctagcagcagcaccaatgatgccagtgatccaactactaaagagtttgaaactttaattaaagacctttcagcggagaatggtttggaaagcctcatgttacgctcctcctcaaatctggctctggctctttatcgataccattcctacaaagacttatcagagtttctgagaggacttgtaatgaactatccacatattacaaatcttaccaatttgggacagagcactgaatatcgtcacatttggtcccttgaaatctccaataagcccaatgtatctgagcctgaagaaccaaagattcgttttgttgctggtatccatggaaatgcgccagttggaactgaactgcttttggctctggcagaatttctctgcctgaactacaaaaagaacccagctgttacccaattggttgacaggactaggattgtgattgtcccttctctaaatccagatgggcgagagagagctcaagagaaagactgtacttcaaaaataggacaaacaaatgctcgtggcaaagatttggatacagacttcacaaataatgcctcccaacctgagaccaaagccatcattgaaaatttgattcaaaaacaggactttagtctttctgttgccttagatggtggttccatgctggtcacatatccttatgacaagccagtacagacagtggaaaataaagagactctgaagcatttggcatctctttatgcaaataatcatccatccatgcacatgggtcagcccagttgcccaaataaatcagatgagaatattccaggaggagtaatgcgtggagcagaatggcatagtcacctgggcagcatgaaggattatagtgtcacctatggccattgtccggaaatcacagtatacacaagctgctgttactttcctagtgctgcacgactcccttccttgtgggcagacaataagagatctcttcttagtatgttagtggaggttcacaagggagttcatggatttgttaaagataagactggaaagccaatctctaaagcagtcattgtacttaatgaaggaataaaggtacaaacaaaagagggaggttatttccatgtactcttagcgccaggtgtccataacattattgccatcgctgatgggtaccagcaacaacattcacaggtctttgtgcatcatgatgcagctagttctgtggtgatagtctttgacacagataaccggatatttggtttgccaagggagcttgtggtaactgtatcaggtgctactatgtcggcattgatcctaacagcttgcattatttggtgcatctgctcaatcaagtctaatagacacaaggatggctttcatcggctcaggcagcatcatgatgagtatgaagatgaaattcgcatgatgtctaccggctccaagaagtccctcctaagccatgagttccaggatgaaacagacactgaagaggaaacattatattctagcaaacattgaaaaacacattttgcatatctcccagcataagtaccaagcaaaattacagttcctcttgggagaacactgcattaagaagagagactctcttgcttcttcaaagagctttgggaaattaaattgctaaatttgtattctctgtgaatttcactggcagttttgaacttcccttccttaaagtactctaaacctttaaaaaaaaatctgatttatgcagcagagatgggacagccactttttctttttaatttaagatgagctatttggagcttatgtaataatggcataaagccaactagaggatgttgtattttgcacatcagatgtttactagtggctttagtatttttctttgttttaaatggccaaaagaatccagaaacattaaggcagggacagcagtcagaatcgacataaagctttaaaaactcaaggttttttcaacctactgaggagtacttttctctagttgttaaatagctggagtttttcttattcaggtttaatggaggttgaattgatttttaaacacatataacagtaggaaatgaataaatgggcttctgcatttggctttctacctgttccaaggctagatcggaactggtagactacgctgtaagcaggatttcactacctctcttaaggtttagcaaacttctaaatagcccattttaagggagaacttactaactttattgtgaaaggtctaaatgcccacttgaatgaagctgagagagagatctagcaaaagctaaaactcatgttgtctatctttgaacttggtaaaaacccacaggtgctgctgcttatatctgtgaagcactagcttattctaggaatgcctgattctttaatattgcctaaatcggaacctttttctatgttgcacacatggttttcagatgacccagccatctacaagatctgaattctactgaaaatatctagaaatgtggaagagacctacttgcacattcttaacctgtatttgaacacaaaatatctatacttcatgctccagcccaagcctataccctgtaatagcatactattattgaaatcgcttgaccggtcttgttcacataggcctctgggagtgatttggttctttgccctaatgtttcatttgacggtctctttttgatcaaccaatttttctaaaagttcagtcgaaagcttttaagtatagcttcctcccttgaaaaaaaatgtaaactatgactgctgagtgataaaacactgtggtgtgaaagtgtcatcttcactgccaatcaggcaaagaccggaaagatttgcattttattatgtctgtcttatcatgcaatggaaatgatgctttttgtaagtatgcatcttaccaatgatgtaacggtttaatacctttgaatgttttaataaccaagttgctgctgaacttatactaaatcaggggaccaaaaaacttgctcttatcttctcaaattgtattctatatccattaatgtatcagttatcccaaagccttcaggtggaggggtttaccaccttcctaggtcgttcaaccaggttttgtgaggaatgcattcaaagtggctttataaaagaagattttctttagcaagaataatgaggtcatgtcatttgttaataagtatctgtgataaatccgtggttcaaggttaagccattctggtattctggtattagcaactgtaaattctgccacctcatacatggaacagagcttgtgggatgctaatagttagtgaagtatacatgatttaatttctaataatctttatgttttctttaaggatggtggtgtattgctctttttcagctttatttttaagagtacagtcaggaaaccaacaaggggcctaagagtggctgcccctgcttgggacattacagcaagtgaaacaaagttaatgtgacaagctttgctttgttatcattggtcttcactagaggataccttttacatgtacttctctcttggatcaaatatgtctttaactgtacatctcagtggctggaggccatgccttttaagcatgtgtaaaatttttaaagaaatgaacatacacatagttattttagtaatatttcctgaaagaaaaaccaaattctgctataagtcttgatcttcaatgaacttttaaataatgcatttagctggaaaacaagactttcccagcttgtattacctagaagcgtgaatgtataggatacctgactactaagactatattctcagccctgccctgtcttttatttgcgggtctaatctaatattagaatatattaaccgcttaaggcattgaagccatatgggatggggaatgcatttcttcagtgtttctccgagagactttccatttccttggagttatggcggcaagtaagtatcatagtattaagaaatttgcctaaatctgagttgtgcctttctttactcacaaggcatgggctttgtcctggtgatcagtttgtaagccttcttccttcccagctccttaataaaagcaaagtgattgagtaggtaatgttcaaagtgtctgcctgtgtacatgtacttgtattgattatgtagttcagtaagatgtgcccaagtcatttcagaaagaaagacccttcagttttgatgcattttgctgaacacttgggtagtgagtgggatcctatccagttgaggaatgcttgcaatgctcattgaagggatttgctttgggactttgtcatcttccagaaaggaaacatattgtatatttggcccagtgtgattgattgctttatctttggtaacttttacttgaatgggatttgctgaattaatgactattgaatttaaaactaattatgagttgacaaataaataaaaggtagtgtttatgtctgagcttattgtgtttgagctaacaccaggttactcagtaaccatgacctgctcctccatttccatttattctcaacattaaatagttttatcttgttgttgccagaaatgcacttgtgccaggtattgtccctgctgtatgaaaagcttcttggcaatgaattctgtaatagtgccctacattatggttttctggtggaattgttttaacagtgacaacccaggatttccaatatatttttgttttattgttattaccaaaaattccactatgattgatgttcagtgattttctatagcaacttttttggtaactctttgggtttctgatttgttttagctaaaattttggggatatgatttgggtctttgattaatgtcagctgaacttggatttctagttcatgaagaaatctctcccaatacccatttatcctatttttagcaataattcgttaatgattccacttgattttcagaatattgtcctggttgattttgatttgacagcatacattatgaaatttgaaagtaggttaccattttgaggcagttggatataaattatgtaaatatgtatgattatgatttttataaatggcataacatgagtgtactaactaccttctatgctggccatgctacagattttctggaggtatgacaatagtatttttttatgctcagattaaaaatcagcttttcacctctccagtttttccaagtgatactcccagttctagagcaatctacagctgtttatgtgaggtgcccaacacccattcatctcaagtgcttcagtctttggtttatttcatgcactgtgccttcaaaatgaaatttttaaaagggactttaaatgaagttgaatagtagtttttaaaagtcaatttgtaatttatgtgaaatctaactgtaatgaggtcctttctgttttttatatgtaaacagatctactaatcctgtataaaagttattttacgatgtttgtctttctttgtgttttgtctcataatcttttttcagatgcaatatgccggaaaaagttataggtccagtttgaaaattatttagtttttctgcctatgctagtggaaaaatagtaccaggatcagaatacagggtatcacctatggaatgtttctgtatttatgaattgactcaaaagaaagctttgtttctgaaatcgcattatgtagtagccacagttttctgtttgtagctcagctagattgttatatatgttcaatcatttcacaataacaacacaaaactggtcattgaaaggtttttatgtacgcattttaaacttgttcgttaaaaatttggtcctttttccaggtgaggcccagttagaataatgtgtcccggcacttttaggcacagcaaggatgaattcaatatccccttttcacttagcaacaatgtgttacttctaccctaataggaattgggaaagcaaagttgtatgagaaacagactctgctgataaagtactcatagtccagaccagagaaatataaatggaaataggttatatttcaatagtgattggttcatctaaaagtctctgctgtaaaggaaataaagcatagaggtttgagcatggactttggagttggaccaatctgtgactgattcttcgttctgctacttgcttccaatgtgaccttgtacaagtttcttgacattctctgagcctcagtttctctactggttgaataatccttgataggattgcagtggaaaattaaatgaaataatgttagcaaaggtcccaacataatatttgacttggaattgaatgcccatggtaaccagcatcattttccttcatgtgatgtcttcttatgcctttgaaagaaagttactttatcaaatgtataaataaagatctgtttataggtgatctttttaatttagaagaaattctgagacacaaataaaaaaagaaattttttattatgtggttcaatagattgtctaaagcatggcagtaaagttttaattatgccaa

SEQ ID NO: 4607 - DNA, 3953 bp, Homo sapiens
agtgtggctgggacttagaattaggcaatctgattcccgatagtcctcttagccacggagggacactggagcccaaaaatggcagatgatattcccaggatcttccccttgcctatttgacagaagctgatttttctccaatttttacctctgactcagcttaagaagatatggacttagctggagaacttgcacagatctgtgagccgcttcattttagactctgaagggtttgtgatgtcatttgtgcaccttattagcctgggcagaatggctaatggtcacacttctaatacacactttaagtgttattaagcattgcatgaggtttaaaaaattacaaagtagaagaaggaggacctcaagaaattagtataaaacaagagaatgttataaatatttatgaggtttgtgctttctggaaatctgcatggtggctcagtggtagcaagctatccttttgatgattctccagaacataaggccactggaatctatagcaaaacctcagatgatgaagtatttaaatacttggcaaaagcttatgcttcaaaccaccccataatgaaaactggtgagcctcattgtccaggagatgaagacgagactttcaaagatggaatcacaaacggcgcacattggtatgatgtggaaggtggtatgcaagattacaattatgtgtgggccaactgttttgagatcacattagaactgtcttgttgcaagtacccacctgcttcacagcttcgacaggaatgggagaacaatcgtgagtctttgatcacattgattgaaaaggttcacattggagtgaaaggatttgttaaagattccataacaggatctgggttagagaatgcaaccatctcagtggctggtattaatcataatatcacaacaggcagatttggtgatttctaccgattacttgttcctggaacttacaaccttacagtagttttaactgggtatatgccattgactgttactaatgtagtggtgaaagaaggaccagccacagaggtggatttttctcttaggccaactgtaacttcagtaatccctgacacgacagaggctgtatcaactgctagcacagttgctatacctaatattctttctggaacatcatcctcctaccagccaattcagccaaaggactttcaccaccaccatttccctgatatggaaatcttcttgagaaggtttgccaatgaatatcctaacattacccggctttattccttgggaaaatcagtagagtcaagagaactttatgtgatggagatatctgataatccgggtgtccatgaaccaggtgaaccagaatttaagtacattggaaatatgcatggaaatgaagtggttggaagagaactgctgttgaacctcatagaatacctttgtaagaactttggaacagaccctgaagtcacagatttggttcataacactagaattcaccttatgccatccatgaatcctgatgggtatgaaaagtcccaggaaggagattcaataagtgtaattggcagaaacaacagcaacaactttgacctgaaccgaaatttcccagaccagtttgttcagatcacagatcctacgcaaccagaaactattgctgtaatgagctggatgaagtcctatccatttgtactttcagcaaacctgcatggaggttctttggtggttaactacccttttgatgatgatgaacaaggacttgccacatatagtaaatcaccagatgatgctgtgttccaacaaatagcactttcttattccaaggaaaattcccagatgtttcaaggtagaccttgcaagaatatgtatcctaatgaatattttcctcatggaataacaaatggagctagttggtataatgtgccaggaggaatgcaggactggaactatttacaaacaaattgctttgaagtgactattgaactaggttgtgtgaaatatccacttgagaaagagctgccaaacttttgggaacagaatcgaagatcactaatccagtttatgaaacaggttcatcagggcgtcagaggatttgttctagatgccacagatggcaggggtatattaaatgccaccattagtgttgctgagattaatcacccagtgactacttacaaaactggagattactggcgtctcttggttccaggaacttataaaatcacagcatctgctcgagggtataatccagttaccaagaatgtgactgtcaagagtgaaggcgctattcaggtcaacttcacacttgttcgatcctcaacagattcaaacaatgaatcaaagaaaggaaaaggggctagcagcagcaccaatgatgccagtgatccaactactaaagagtttgaaactttaattaaagacctttcagcggagaatggtttggaaagcctcatgttacgctcctcctcaaatctggctctggctctttatcgataccattcctacaaagacttatcagagtttctgagaggacttgtaatgaactatccacatattacaaatcttaccaatttgggacagagcactgaatatcgtcacatttggtcccttgaaatctccaataagcccaatgtatctgagcctgaagaaccaaagattcgttttgttgctggtatccatggaaatgcgccagttggaactgaactgcttttggctctggcagaatttctctgcctgaactacaaaaagaacccagctgttacccaattggttgacaggactaggattgtgattgtcccttctctaaatccagatgggcgagagagagctcaagagaaagactgtacttcaaaaataggacaaacaaatgctcgtggcaaagatttggatacagacttcacaaataatgcctcccaacctgagaccaaagccatcattgaaaatttgattcaaaaacaggactttagtctttctgttgccttagatggtggttccatgctggtcacatatccttatgacaagccagtacagacagtggaaaataaagagactctgaagcatttggcatctctttatgcaaataatcatccatccatgcacatgggtcagcccagttgcccaaataaatcagatgagaatattccaggaggagtaatgcgtggagcagaatggcatagtcacctgggcagcatgaaggattatagtgtcacctatggccattgtccggaaatcacagtatacacaagctgctgttactttcctagtgctgcacgactcccttccttgtgggcagacaataagagatctcttcttagtatgttagtggaggttcacaagggagttcatggatttgttaaagataagactggaaagccaatctctaaagcagtcattgtacttaatgaaggaataaaggtacaaacaaaagagggaggttatttccatgtactcttagcgccaggtgtccataacattattgccatcgctgatgggtaccagcaacaacattcacaggtctttgtgcatcatgatgcagctagttctgtggtgatagtctttgacacagataaccggatatttggtttgccaagggagcttgtggtaactgtatcaggtgctactatgtcggcattgatcctaacagcttgcattatttggtgcatctgctcaatcaagtctaatagacacaaggatggctttcatcggctcaggcagcatcatgatgagtatgaagatgaaattcgcatgatgtctaccggctccaagaagtccctcctaagccatgagttccaggatgaaacagacactgaagaggaaacattatattctagcaaacattgaaaaacacattttgcatatctcccagcataagtaccaagcaaaattacagttcctcttgggagaacactgcattaagaagagagactctcttgcttcttcaaagagctttgggaaattaaattgctaaatttgtattctctgtgaatttc

SEQ ID NO: 4608 - DNA, 2189 bp, Homo sapiens
agtgcgcgggctgacactcattcagccggggaaggtgaggcgagtagaggctggtgcggaacttgccgcccccagcagcgccggcgggctaagcccagggccgggcagacaaaagaggccgcccgcgtaggaaggcacggccggcggcggcggagcgcagcgatggccgggcatgaggcggcgccggcggctgcagcaagaggacggcatctccttcgagtaccaccgctaccccgagctgcgcgaggcgctcgtgtccgtgtggctgcagtgcaccgccatcagcaggatttacacggtggggcgcagcttcgagggccgggagctcctggtcatcgagctgtccgacaaccctggcgtccatgagcctggtgagcctgaatttaaatacattgggaatatgcatgggaatgaggctgttggacgagaactgctcattttcttggcccagtacctatgcaacgaataccagaaggggaacgagacaattgtcaacctgatccacagtacccgcattcacatcatgccttccctgaacccagatggctttgagaaggcagcgtctcagcctggtgaactcaaggactggtttgtgggtcgaagcaatgcccagggaatagatctgaaccggaactttccagacctggataggatagtgtacgtgaatgagaaagaaggtggtccaaataatcatctgttgaaaaatatgaagaaaattgtggatcaaaacacaaagcttgctcctgagaccaaggctgtcattcattggattatggatattccttttgtgctttctgccaatctccatggaggagaccttgtggccaattatccatatgatgagacgcggagtggtagtgctcacgaatacagctcctccccagatgacgccattttccaaagcttggcccgggcatactcttctttcaacccggccatgtctgaccccaatcggccaccatgtcgcaagaatgatgatgacagcagctttgtagatggaaccaccaacggtggtgcttggtacagcgtacctggagggatgcaagacttcaattaccttagcagcaactgttttgagatcaccgtggagcttagctgtgagaagttcccacctgaagagactctgaagacctactgggaggataacaaaaactccctcattagctaccttgagcagatacaccgaggagttaaaggatttgtccgagaccttcaaggtaacccaattgcgaatgccaccatctccgtggaaggaatagaccacgatgttacatccgcaaaggatggtgattactggagattgcttacctggaaactataaacttacagcctcagctccaggctatctggcaataacaaagaaagtggcagttccttacagccctgctgctggggttgattttgaactggagtcattttctgaaaggaaagaagaggagaaggaagaattgatggaatggtggaaaatgatgtcagaaactttaaatttttaaaaaggcttctagttagctgctttaaatctatctatataatgtagtatgatgtaatgtggtcttttttttagattttgtgcagttaatacttaacattgatttattttttaatcatttaaatattaatcaactttccttaaaataaatagcctcttaggtaaaaatataagaacttgatatatttcattctcttatatagtattcattttcctacctatattacacaaaaaagtatagaaaagatttaagtaattttgccatcctaggcttaaatgcaatattcctggtattatttacaatgcagaattttttgagtaattctagctttcaaaaattagtgaagttcttttactgtaattggtgacaatgtcacataatgaatgctattgaaaaggttaacagatacagctcggagttgtgagcactctactgcaagacttaaatagttcagtataaattgtcgtttttttcttgtgctgactaactataagcatgatcttgttaatgcatttttgatgggaagaaaaggtacatgtttacaaagaggttttatgaaaagaataaaaattgacttcttgcttgtacatataggagcaatactattatattatgtagtccgttaacactacttaaaagtttagggttttctcttggttgtagagtggcccagaattgcattctgaatgaataaaggtt

SEQ ID NO: 4609 - DNA, 2421 bp, Homo sapiens
gcccgtctctccgccggccccctcctcgcagtggtttctcctgcagctcccctgggctccgcggccagtagtgcagcccgtggagccgcggctttgcccgtctcctctgggtggccccagtgcgcgggctgacactcattcagccggggaaggtgaggcgagtagaggctggtgcggaacttgccgcccccagcagcgccggcgggctaagcccagggccgggcagacaaaagaggccgcccgcgtaggaaggcacggccggcggcggcggagcgcagcgatggccgggcgagggggcagcgcgctgctggctctgtgcggggcactggctgcctgcgggtggctcctgggcgccgaagcccaggagcccggggcgcccgcggcgggcatgaggcggcgccggcggctgcagcaagaggacggcatctccttcgagtaccaccgctaccccgagctgcgcgaggcgctcgtgtccgtgtggctgcagtgcaccgccatcagcaggatttacacggtggggcgcagcttcgagggccgggagctcctggtcatcgagctgtccgacaaccctggcgtccatgagcctggtgagcctgaatttaaatacattgggaatatgcatgggaatgaggctgttggacgagaactgctcattttcttggcccagtacctatgcaacgaataccagaaggggaacgagacaattgtcaacctgatccacagtacccgcattcacatcatgccttccctgaacccagatggctttgagaaggcagcgtctcagcctggtgaactcaaggactggtttgtgggtcgaagcaatgcccagggaatagatctgaaccggaactttccagacctggataggatagtgtacgtgaatgagaaagaaggtggtccaaataatcatctgttgaaaaatatgaagaaaattgtggatcaaaacacaaagcttgctcctgagaccaaggctgtcattcattggattatggatattccttttgtgctttctgccaatctccatggaggagaccttgtggccaattatccatatgatgagacgcggagtggtagtgctcacgaatacagctcctccccagatgacgccattttccaaagcttggcccgggcatactcttctttcaacccggccatgtctgaccccaatcggccaccatgtcgcaagaatgatgatgacagcagctttgtagatggaaccaccaacggtggtgcttggtacagcgtacctggagggatgcaagacttcaattaccttagcagcaactgttttgagatcaccgtggagcttagctgtgagaagttcccacctgaagagactctgaagacctactgggaggataacaaaaactccctcattagctaccttgagcagatacaccgaggagttaaaggatttgtccgagaccttcaaggtaacccaattgcgaatgccaccatctccgtggaaggaatagaccacgatgttacatccgcaaaggatggtgattactggagattgcttatacctggaaactataaacttacagcctcagctccaggctatctggcaataacaaagaaagtggcagttccttacagccctgctgctggggttgattttgaactggagtcattttctgaaaggaaagaagaggagaaggaagaattgatggaatggtggaaaatgatgtcagaaactttaaatttttaaaaaggcttctagttagctgctttaaatctatctatataatgtagtatgatgtaatgtggtcttttttttagattttgtgcagttaatacttaacattgatttattttttaatcatttaaatattaatcaactttccttaaaataaatagcctcttaggtaaaaatataagaacttgatatatttcattctcttatatagtattcattttcctacctatattacacaaaaaagtatagaaaagatttaagtaattttgccatcctaggcttaaatgcaatattcctggtattatttacaatgcagaattttttgagtaattctagctttcaaaaattagtgaagttcttttactgtaattggtgacaatgtcacataatgaatgctattgaaaaggttaacagatacagctcggagttgtgagcactctactgcaagacttaaatagttcagtataaattgtcgtttttttcttgtgctgactaactataagcatgatcttgttaatgcatttttgatgggaagaaaaggtacatgtttacaaagaggttttatgaaaagaataaaaattgacttcttgcttgtacatataggagcaatactattatattatgtagtccgttaacactacttaaaagtttagggttttctcttggttgtagagtggcccagaattgcattctgaatgaataaaggttaaaaaaaaatcccc

SEQ ID NO: 4610 - DNA, 6636 bp, Homo sapiens
ccctcatgtgttctcaggttcttcttatttttattcatctctagaacatggacttcccgtgcctctggctagggctgttgctgcctttggtagctgcgctggatttcaactaccaccgccaggaagggatggaagcgtttttgaagactgttgcccaaaactacagttctgtcactcacttacacagtattgggaaatctgtgaaaggtagaaacctgtgggttcttgttgtggggcggtttccaaaggaacacagaattgggattccagagttcaaatacgtggcaaatatgcatggagatgagactgttgggcgggagctgctgctccatctgattgactatctcgtaaccagtgatggcaaagaccctgaaatcacaaatctgatcaatagtacccggatacacatcatgccttccatgaacccagatggatttgaagccgtcaaaaagcctgactgttattacagcatcggaagggaaaattataaccagtatgacttgaatcgaaatttccccgatgcttttgaatataataatgtctcaaggcagcctgaaactgtggcagtcatgaagtggctgaaaacagagacgtttgtcctctctgcaaacctccatggtggtgccctcgtggccagttacccatttgataatggtgttcaagcaactggggcattatactcccgaagcttaacgcctgatgatgatgtttttcaatatcttgcacatacctatgcttcaagaaatcccaacatgaagaaaggagacgagtgtaaaaacaaaatgaactttcctaatggtgttacaaatggatactcttggtatccactccaaggtggaatgcaagattacaactacatctgggcccagtgttttgaaattacgttggagctgtcatgctgtaaatatcctcgtgaggagaagcttccatccttttggaataataacaaagcctcattaattgaatatataaagcaggtgcacctaggtgtaaagggtcaagtttttgatcagaatggaaatccattacccaatgtaattgtggaagtccaagacagaaaacatatctgcccctatagaaccaacaaatatggagagtattatctccttctcttgcctgggtcttatataataaatgttacagtccctggacatgatccacacatcacaaaggtgattattccggagaaatcccagaacttcagtgctcttaaaaaggatattctacttccattccaagggcaattggattctatcccagtatcaaatccttcatgcccaatgattcctctatacagaaatttgccagaccactcagctgcaacaaagcctagtttgttcttatttttagtgagtcttttgcacatattcttcaaataaagtaaaatgtgaaactcaacccacatcaccacctggaatcagggattgctcactccaggttactgcaaccctaactcactctagtgggaccttgactggagaaactccacgatcttcctgaagaagagaaatggatgtttccaaattccacaataagcaatatgtggtgataatgaaaagaatgattcagtcttgacggtgaatggaagacacttacctaacaagtactgctcatttacactcaaattaatcttgaagtagtcttaaaatgtgtaagaagttaaaacttgagaagcaaaaaaatgcctgcaaaaagaagatcattttgtatacagagaaccggatgaatataagcaatgaagatgaacatttattgatcttctacatacaagacttcaccataaggccaggagcagtggctcacaccttgtaatcccagcactttgggaggccaaggtgggcggatcaccctgaggttaggagttcaaaaccagcctgaccaacatggtgaaaccctgtctctactaaatattagcggggtgtggtggcgggcacctgtaatcgcagcctttcaggaggctgagacaggagaatcgcttgaaccctagaggcggagtttgcagtgagccgagatagtgccattgtactccagcttgggcaacagagtaagactctgtctcaaaaaaaaaaaaacaaaaacaaacaaacaaaaaaaacacctcaccatgagtgctacatgtgaatagatattaagtgccatatataattagttctcagaagaagggagaaatgatcataggactgggaattgttttgcaaacgttctaggagatgtgagagaaaatatgtaaccacatcttagtggcccaagaaaatacaggcctgaagggataagattgtgtctctatagagcttcaaagcatacaggtcaattaagaaagcccctctctctccagagccgtttccctagcttttggcacctggatgccacagtcctccattaggctgatgactccaaagatgtaactctagcctcttgcctgagcttcagactcgcgtcccactgcccacaggacacatccacctggatgtgactcacaggtacctccaacccatcatgtggagatactcatcctgttccccctagagctgctcttcctgctgcattctctctctcaattactgggaccaccaagctaggaacctgggagtcatccttgatactttctcttcctccttaatcctgtgtattcagcaagtaactaaaggttggtgttggccaggcatggtggctcatgcctgtaatcccagcattttgggaggccaaggcgggcggatcacttgaggtcaggagctcaagaccagcctggccaacatggtgaaaccccatctctactaaaaaaaaaaaaaaaattagtcgggcgtggtggtgcatgcctgtaatcccagctactggggaggctgaggcaggagaatcgcttgaacctgggaggcagaggttgcagtgagccgggattgcgccattgtactccagcctgggtgaagaagtgagactctgtcttaaaaaaaaaaattggtgctgataaatattgatgaattctgctctctgctctctatggttgtcaacactgcagagttgaggcctcatatctcacctgcactgctgcaacagcttactggtcccttgctcccagccttctcctcttcagtccatcgtccacacagcactggggaaggggagccacttgaaacaaaagtcaacaactggttgtagttcataaacacagagctgtttgtgtcccctgtatctggaatgccattatgacccactacattttttctttcctacccctcttaaaactcagttcaggtagcagctccactaggaagccttggctgaccataatcccattcaattccatttcacctcttcgcaggcagtctggggttagggaccctttctctttgctccccaaaataaactggttatctctactattggatttacaacattgtattataatcttctccatgtgtgccttctctagtagaatgtgagctctttgaggccaaggtctatttaatttgtttgaaaaattcattgttatatcctcaaagcctagcacatagtaggtactgaatgaatgaatgaacaaggggtgccaggagactgctactcccagtccttcccagaaactgcctagggctttgagtcattttatgaagctaggtcttaatgcgtaggcaacctcccagctcactatgaacgctgacagaagagtgttttcatgtctataatcaagaattccagatacattccttttactgaaccttgaattgatcctaagattggtagtaaaggtattatgttacctcctaacagcactacaaagtacctttttttatcagaaaaaaattttaccattaggactcaatttgaagtactaatgcttctcaagttctccactatgagagttaccctgtattagaccgttacctataagaattaaggggtaaagcactaaacagaaaagaaaaaaaaaatagcaactctggtgagcagatttctttcctttcttccttccttctcctcttcctaccttcctccctcctttccctctcctccccttctctccctttccctccccttcccttccttttcttctttcctccgctcccctccccttccctccccttcccatccttctttctcttttttttacttaatccccagtgtgacagtaatataggctgatttctagaagtgtggtgtattactcatggaaagtgagttgccttggttattactttcaattgaaagttctatgggatctagaaatgagacatactggcatggagagtgagaacgacaaaggaatgaagagctacaggagcatttaggccatttctatgccaagcttattctacatgcacaaaatcatacatgttaataaatataaacaaattggaggcttatttaaaccaattatgaaatctggtaatttgtgcagcagcaatagatgataaccaaaaaaaactcataataatctgaatatcttgatcatttgtatttaaagaagcagtaattatatacttgaaagtacataatatagtattgcaaaaatgactttggtatattacaaattaaaagtatataagatgaaacttgatttgctatcaagccccaagcaatttttcaactgggcattgaattctaacttttctaagatagcaatttttgaagagacacgaacaaaaatctgaattagttcatgagccttaatgtaaatctcttgctgaaatagtttttaaaatcagaatttagttatctatcagactcaaaatcatttaaagactaacaaaacacaatcatgatattctaactgtggtcaaaccaggtacccaagccacctccctgcccaacgcctttccggcttttcccctccctcttgggctggtggttatgctcctccagctctagttcagctataattccttttatagagaaaccaacctgatacacactttcatgatgggagaaaaatgtgggagtgaaatggtatttagaaagcagcagtcaggcacggtggctcatgcctgtaatcccagcactttgggaggctgaggcaggcggatcacttgaggtcaggagctcgagaccagcctggccaacacggtgaaaccccatctctactaaaaaaaaatacaaaaattagccgggcgtggtggcaggcacctgtaatcccagctacttgggaggctgaggcaggagaaatcgcctgaacccagaaggcagaggttgcagtgagccaagatcacatcactgcactgcactccagccggggtgacagagcgaacctctgtctcaaaaaaaaaaaaagaaaaaagaaagaaagaaaaaaggcagaagccctggattcaaatccgccacacattcagtttctttatctgtaaaatggagaccaccccccgccacgctgaacggtgattctgtgactggtaagagatgctacatttttggtgcttgttcaggtggaggaaagatgatagttaacactcaggtaataagtattttgaaggcagtataatataccttcttaaagagtatacctactcaaatgttggtaaatgttgacatgattgaatctaaatggcaaagagtattttagaaaaacattaagtccctgcagataaatgacagtgttgatttggatgcttaattacattcagacatgaactgttggatgtatctgaaatgttaaaagctttttctcaacatttccaaaagtctttccaagaaatcaatgttatgttttgttccagaagcaaatttgcatttgtgatctgtttctaaaaatggtacaagttagctctgtttagaaagtaaaaatatctgatgttagattggaagtatctcttcctggggaatccagaaagataagcatagcatattgtcttactgcaatagataagttgcttattgagaagtctggttgttattctatatggtaacaatacagttgatgtatattttatgatagatcctttatattttcctcatgactttagaagggggaagggggagaaaattatgatgaccagactagttaaagagcattgaaagtccacagtactgtagctaaagtagaagtttgggtttgttatagactttacattatatcaactaataagcagatactgtacagtattgctcaccattttatcatacttttgcatatgaactactccattgccttttatagatgttttatagctgatcttaccagttttcctggtaactttttttatttcttttttttttttttgagacggagtctcgccctaacacccaggttggagtgcagtgccgtgatctcggctcactgcaacctctgcctcccgggttcaagcaattctcctgtctcagcctcccgagtacctgggactaccggtgcctgtctccacgcccggctaattttttgtatttgtagtagagacggggtttcaccgtgttagccaggatggtctcgatctcctgacctcatgatctgcctgcctctgcctggacctcccaaagtgctgggattacaggcgtgagcccccgcgcccagccactttctttaatactataactaagaatttattaaaatgcacaaattgtctaagactgtaaagtttattggggagaggccatgactacctctgaatttagtaaatttaaaatatttctgattctcaataaagaactaatatccat

SEQ ID NO: 4611 - DNA, 2116 bp, Homo sapiens
gtctagattcttcttggcctctctgagcagcatttcttccttctgcgtatgggacaggaccctttctggaatgggggtcttatgacctacaatcaaacaagaacatggacttcccgtgcctctggctagggctgttgctgcctttggtagctgcgctggatttcaactaccaccgccaggaagggatggaagcgtttttgaagactgttgcccaaaactacagttctgtcactcacttacacagtattgggaaatctgtgaaaggtagaaacctgtgggttcttgttgtggggcggtttccaaaggaacacagaattgggattccagagttcaaatacgtggcaaatatgcatggagatgagactgttgggcgggagctgctgctccatctgattgactatctcgtaaccagtgatggcaaagaccctgaaatcacaaatctgatcaatagtacccggatacacatcatgccttccatgaacccagatggatttgaagccgtcaaaaagcctgactgttattacagcatcggaagggaaaattataaccagtatgacttgaatcgaaatttccccgatgcttttgaatataataatgtctcaaggcagcctgaaactgtggcagtcatgaagtggctgaaaacagagacgtttgtcctctctgcaaacctccatggtggtgccctcgtggccagttacccatttgataatggtgttcaagcaactggggcattatactcccgaagcttaacgcctgatgatgatgtttttcaatatcttgcacatacctatgcttcaagaaatcccaacatgaagaaaggagacgagtgtaaaaacaaaatgaactttcctaatggtgttacaaatggatactcttggtatccactccaaggtggaatgcaagattacaactacatctgggcccagtgttttgaaattacgttggagctgtcatgctgtaaatatcctcgtgaggagaagcttccatccttttggaataataacaaagcctcattaattgaatatataaagcaggtgcacctaggtgtaaagggtcaagtttttgatcagaatggaaatccattacccaatgtaattgtggaagtccaagacagaaaacatatctgcccctatagaaccaacaaatatggagagtattatctccttctcttgcctgggtcttatataataaatgttacagtccctggacatgatccacacatcacaaaggtgattattccggagaaatcccagaacttcagtgctcttaaaaaggatattctacttccattccaagggcaattggattctatcccagtatcaaatccttcatgcccaatgattcctctatacagaaatttgccagaccactcagctgcaacaaagcctagtttgttcttatttttagtgagtcttttgcacatattcttcaaataaagtaaaatgtgaaactcaacccacatcaccacctggaatcagggattgctcactccaggttactgcaaccctaactcactctagtgggaccttgactggagaaactccacgatcttcctgaagaagagaaatggatgtttccaaattccacaataagcaatatgtggtgataatgaaaagaatgattcagtcttgacggtgaatggaagacacttacctaacaagtactgctcatttacactcaaattaatcttgaagtagtcttaaaatgtgtaagaagttaaaacttgagaagcaaaaaaatgcctgcaaaaagaagatcattttgtatacagagaaccggatgaatataagcaatgaagatgaacatttattgatcttctacatacaagacttcaccataaggccaggagcagtggctcacaccttgtaatcccagcactttgggaggccaaggtgggcggatcaccctgaggttaggagttcaaaaccagcctgaccaacatggtgaaaccctgtctctactaaatattagcggggtgtggtggcgggcacctgtaatcgcagcctttcaggaggctgagacaggagaatcgcttgaaccctagaggcggagtttgcagtgagccgagatagtgccattgtactccagcttgggcaacagagtaagactctgtctc

SEQ ID NO: 4612 - DNA, 2196 bp, Homo sapiens
gaacatggacttcccgtgcctctggctagggctgttgctgcctttggtagctgcgctggatttcaactaccaccgccaggaagggatggaagcgtttttgaagactgttgcccaaaactacagttctgtcactcacttacacagtattgggaaatctgtgaaaggtagaaacctgtgggttcttgttgtggggcggtttccaaaggaacacagaattgggattccagagttcaaatacgtggcaaatatgcatggagatgagactgttgggcgggagctgctgctccatctgattgactatctcgtaaccagtgatggcaaagaccctgaaatcacaaatctgatcaatagtacccggatacacatcatgccttccatgaacccagatggatttgaagccgtcaaaaagcctgactgttattacagcatcggaagggaaaattataaccagtatgacttgaatcgaaatttccccgatgcttttgaatataataatgtctcaaggcagcctgaaactgtggcagtcatgaagtggctgaaaacagagacgtttgtcctctctgcaaacctccatggtggtgccctcgtggccagttacccatttgataatggtgttcaagcaactggggcattatactcccgaagcttaacgcctgatgatgatgtttttcaatatcttgcacatacctatgcttcaagaaatcccaacatgaagaaaggagacgagtgtaaaaacaaaatgaactttcctaatggtgttacaaatggatactcttggtatccactccaaggtggaatgcaagattacaactacatctgggcccagtgttttgaaattacgttggagctgtcatgctgtaaatatcctcgtgaggagaagcttccatccttttggaataataacaaagcctcattaattgaatatataaagcaggtgcacctaggtgtaaagggtcaagtttttgatcagaatggaaatccattacccaatgtaattgtggaagtccaagacagaaaacatatctgcccctatagaaccaacaaatatggagagtattatctccttctcttgcctgggtcttatataataaatgttacagtccctggacatgatccacacatcacaaaggtgattattccggagaaatcccagaacttcagtgctcttaaaaaggatattctacttccattccaagggcaattggattctatcccagtatcaaatccttcatgcccaatgattcctctatacagaaatttgccagaccactcagctgcaacaaagcctagtttgttcttatttttagtgagtcttttgcacatattcttcaaataaagtaaaatgtgaaactcaacccacatcaccacctggaatcagggattgctcactccaggttactgcaaccctaactcactctagtgggaccttgactggagaaactccacgatcttcctgaagaagagaaatggatgtttccaaattccacaataagcaatatgtggtgataatgaaaagaatgattcagtcttgacggtgaatggaagacacttacctaacaagtactgctcatttacactcaaattaatcttgaagtagtcttaaaatgtgtaagaagttaaaacttgagaagcaaaaaaatgcctgcaaaaagaagatcattttgtatacagagaaccggatgaatataagcaatgaagatgaacatttattgatcttctacatacaagacttcaccataaggccaggagcagtggctcacaccttgtaatcccagcactttgggaggccaaggtgggcggatcaccctgaggttaggagttcaaaaccagcctgaccaacatggtgaaaccctgtctctactaaatattagcggggtgtggtggcgggcacctcaattctcctgtctcagcctcccgagtacctgggactaccggtgcctgtctccacgcccggctaattttttgtatttgtagtagagacggggtttcaccgtgttagccaggatggtctcgatctcctgacctcatgatctgcctgcctctgcctggacctcccaaagtgctgggattacaggcgtgagcccccgcgcccagccactttctttaatactataactaagaatttattaaaatgcacaaattgtctaagactgtaaagtttattggggagaggccatgactacctctgaatttagt

SEQ ID NO: 4613 - DNA, 454 bp, Homo sapiens
gggtgggtagaggtgcgcgcctgggacctggtgaggctggggaacatggacttcccgtgcctctggctagggctgttgctgcctttggtagctgcgctggatttcaactaccaccgccaggaagggatggaagcgtttttgaagactgttgcccaaaactacagttctgtcactcacttacacagtattgggaaatctgtgaaaggtagaaacctgtgggttcttgttgtggggcggtttccaaaggaacacagaattgggattccagagttcaaatacgtggcaaatatgcatggagatgagactgttgggcgggagctgctgctccatctgattgactatctcgtaaccagtgatggcaaagaccctgaaatcacaaatctgatcaatagtacccggatacacatcatgccttccatgaacccagatggatttgaagccgtcaaaaagcctg

SEQ ID NO: 4614 - DNA, 794 bp, Homo sapiens
gctataacacccggccccgccgggcggccgcgggtgggtagagaacatggacttcccgtgcctctggctagggctgttgctgcctttggtagctgcgctggatttcaactaccaccgccaggaagggatggaagcgtttttgaagactgttgcccaaaactacagttctgtcactcacttacacagtattgggaaatctgtgaaaggtagaaacctgtgggttcttgttgtggggcggtttccaaaggaacacagaattgggattccagagttcaaatacgtggcaaatatgcatggagatgagactgttgggcgggagctgctgctccatctgattgactatctcgtaaccagtgatggcaaagaccctgaaatcacaaatctgatcaatagtacccggatacacatcatgccttccatgaacccagatggatttgaagccgtcaaaaagcctgactgttattacagcatcggaagggaaaattataaccagtatgacttgaatcgaaatttccccgatgcttttgaatataataatgtctcaaggcagcctgaaactgtggcagtcatgaagtggctgaaaacagagacgtttgtcctctctgcaaacctccatggtggtgccctcgtggccagttacccatttgataatggtgttcaagcaactggggcattatactcccgaagcttaacgcctgatgatgatgtttttcaatatcttgcacatacctatgcttcaagaaatcccaacatgaagaaaggagacgagtgtaaaaacaaaatgaactttccta

SEQ ID NO: 4615 - DNA, 6655 bp, Homo sapiens
ataacacccggccccgccgggcggccgcgggtgggtagaggtgcgcgcctgggacctgaacatggacttcccgtgcctctggctagggctgttgctgcctttggtagctgcgctggatttcaactaccaccgccaggaagggatggaagcgtttttgaagactgttgcccaaaactacagttctgtcactcacttacacagtattgggaaatctgtgaaaggtagaaacctgtgggttcttgttgtggggcggtttccaaaggaacacagaattgggattccagagttcaaatacgtggcaaatatgcatggagatgagactgttgggcgggagctgctgctccatctgattgactatctcgtaaccagtgatggcaaagaccctgaaatcacaaatctgatcaatagtacccggatacacatcatgccttccatgaacccagatggatttgaagccgtcaaaaagcctgactgttattacagcatcggaagggaaaattataaccagtatgacttgaatcgaaatttccccgatgcttttgaatataataatgtctcaaggcagcctgaaactgtggcagtcatgaagtggctgaaaacagagacgtttgtcctctctgcaaacctccatggtggtgccctcgtggccagttacccatttgataatggtgttcaagcaactggggcattatactcccgaagcttaacgcctgatgatgatgtttttcaatatcttgcacatacctatgcttcaagaaatcccaacatgaagaaaggagacgagtgtaaaaacaaaatgaactttcctaatggtgttacaaatggatactcttggtatccactccaaggtggaatgcaagattacaactacatctgggcccagtgttttgaaattacgttggagctgtcatgctgtaaatatcctcgtgaggagaagcttccatccttttggaataataacaaagcctcattaattgaatatataaagcaggtgcacctaggtgtaaagggtcaagtttttgatcagaatggaaatccattacccaatgtaattgtggaagtccaagacagaaaacatatctgcccctatagaaccaacaaatatggagagtattatctccttctcttgcctgggtcttatataataaatgttacagtccctggacatgatccacacatcacaaaggtgattattccggagaaatcccagaacttcagtgctcttaaaaaggatattctacttccattccaagggcaattggattctatcccagtatcaaatccttcatgcccaatgattcctctatacagaaatttgccagaccactcagctgcaacaaagcctagtttgttcttatttttagtgagtcttttgcacatattcttcaaataaagtaaaatgtgaaactcaacccacatcaccacctggaatcagggattgctcactccaggttactgcaaccctaactcactctagtgggaccttgactggagaaactccacgatcttcctgaagaagagaaatggatgtttccaaattccacaataagcaatatgtggtgataatgaaaagaatgattcagtcttgacggtgaatggaagacacttacctaacaagtactgctcatttacactcaaattaatcttgaagtagtcttaaaatgtgtaagaagttaaaacttgagaagcaaaaaaatgcctgcaaaaagaagatcattttgtatacagagaaccggatgaatataagcaatgaagatgaacatttattgatcttctacatacaagacttcaccataaggccaggagcagtggctcacaccttgtaatcccagcactttgggaggccaaggtgggcggatcaccctgaggttaggagttcaaaaccagcctgaccaacatggtgaaaccctgtctctactaaatattagcggggtgtggtggcgggcacctgtaatcgcagcctttcaggaggctgagacaggagaatcgcttgaaccctagaggcggagtttgcagtgagccgagatagtgccattgtactccagcttgggcaacagagtaagactctgtctcaaaaaaaaaaaaacaaaaacaaacaaacaaaaaaaacacctcaccatgagtgctacatgtgaatagatattaagtgccatatataattagttctcagaagaagggagaaatgatcataggactgggaattgttttgcaaacgttctaggagatgtgagagaaaatatgtaaccacatcttagtggcccaagaaaatacaggcctgaagggataagattgtgtctctatagagcttcaaagcatacaggtcaattaagaaagcccctctctctccagagccgtttccctagcttttggcacctggatgccacagtcctccattaggctgatgactccaaagatgtaactctagcctcttgcctgagcttcagactcgcgtcccactgcccacaggacacatccacctggatgtgactcacaggtacctccaacccatcatgtggagatactcatcctgttccccctagagctgctcttcctgctgcattctctctctcaattactgggaccaccaagctaggaacctgggagtcatccttgatactttctcttcctccttaatcctgtgtattcagcaagtaactaaaggttggtgttggccaggcatggtggctcatgcctgtaatcccagcattttgggaggccaaggcgggcggatcacttgaggtcaggagctcaagaccagcctggccaacatggtgaaaccccatctctactaaaaaaaaaaaaaaaattagtcgggcgtggtggtgcatgcctgtaatcccagctactggggaggctgaggcaggagaatcgcttgaacctgggaggcagaggttgcagtgagccgggattgcgccattgtactccagcctgggtgaagaagtgagactctgtcttaaaaaaaaaaattggtgctgataaatattgatgaattctgctctctgctctctatggttgtcaacactgcagagttgaggcctcatatctcacctgcactgctgcaacagcttactggtcccttgctcccagccttctcctcttcagtccatcgtccacacagcactggggaaggggagccacttgaaacaaaagtcaacaactggttgtagttcataaacacagagctgtttgtgtcccctgtatctggaatgccattatgacccactacattttttctttcctacccctcttaaaactcagttcaggtagcagctccactaggaagccttggctgaccataatcccattcaattccatttcacctcttcgcaggcagtctggggttagggaccctttctctttgctccccaaaataaactggttatctctactattggatttacaacattgtattataatcttctccatgtgtgccttctctagtagaatgtgagctctttgaggccaaggtctatttaatttgtttgaaaaattcattgttatatcctcaaagcctagcacatagtaggtactgaatgaatgaatgaacaaggggtgccaggagactgctactcccagtccttcccagaaactgcctagggctttgagtcattttatgaagctaggtcttaatgcgtaggcaacctcccagctcactatgaacgctgacagaagagtgttttcatgtctataatcaagaattccagatacattccttttactgaaccttgaattgatcctaagattggtagtaaaggtattatgttacctcctaacagcactacaaagtacctttttttatcagaaaaaaattttaccattaggactcaatttgaagtactaatgcttctcaagttctccactatgagagttaccctgtattagaccgttacctataagaattaaggggtaaagcactaaacagaaaagaaaaaaaaaatagcaactctggtgagcagatttctttcctttcttccttccttctcctcttcctaccttcctccctcctttccctctcctccccttctctccctttccctccccttcccttccttttcttctttcctccgctcccctccccttccctccccttcccatccttctttctcttttttttacttaatccccagtgtgacagtaatataggctgatttctagaagtgtggtgtattactcatggaaagtgagttgccttggttattactttcaattgaaagttctatgggatctagaaatgagacatactggcatggagagtgagaacgacaaaggaatgaagagctacaggagcatttaggccatttctatgccaagcttattctacatgcacaaaatcatacatgttaataaatataaacaaattggaggcttatttaaaccaattatgaaatctggtaatttgtgcagcagcaatagatgataaccaaaaaaaactcataataatctgaatatcttgatcatttgtatttaaagaagcagtaattatatacttgaaagtacataatatagtattgcaaaaatgactttggtatattacaaattaaaagtatataagatgaaacttgatttgctatcaagccccaagcaatttttcaactgggcattgaattctaacttttctaagatagcaatttttgaagagacacgaacaaaaatctgaattagttcatgagccttaatgtaaatctcttgctgaaatagtttttaaaatcagaatttagttatctatcagactcaaaatcatttaaagactaacaaaacacaatcatgatattctaactgtggtcaaaccaggtacccaagccacctccctgcccaacgcctttccggcttttcccctccctcttgggctggtggttatgctcctccagctctagttcagctataattccttttatagagaaaccaacctgatacacactttcatgatgggagaaaaatgtgggagtgaaatggtatttagaaagcagcagtcaggcacggtggctcatgcctgtaatcccagcactttgggaggctgaggcaggcggatcacttgaggtcaggagctcgagaccagcctggccaacacggtgaaaccccatctctactaaaaaaaaatacaaaaattagccgggcgtggtggcaggcacctgtaatcccagctacttgggaggctgaggcaggagaaatcgcctgaacccagaaggcagaggttgcagtgagccaagatcacatcactgcactgcactccagccggggtgacagagcgaacctctgtctcaaaaaaaaaaaaagaaaaaagaaagaaagaaaaaaggcagaagccctggattcaaatccgccacacattcagtttctttatctgtaaaatggagaccaccccccgccacgctgaacggtgattctgtgactggtaagagatgctacatttttggtgcttgttcaggtggaggaaagatgatagttaacactcaggtaataagtattttgaaggcagtataatataccttcttaaagagtatacctactcaaatgttggtaaatgttgacatgattgaatctaaatggcaaagagtattttagaaaaacattaagtccctgcagataaatgacagtgttgatttggatgcttaattacattcagacatgaactgttggatgtatctgaaatgttaaaagctttttctcaacatttccaaaagtctttccaagaaatcaatgttatgttttgttccagaagcaaatttgcatttgtgatctgtttctaaaaatggtacaagttagctctgtttagaaagtaaaaatatctgatgttagattggaagtatctcttcctggggaatccagaaagataagcatagcatattgtcttactgcaatagataagttgcttattgagaagtctggttgttattctatatggtaacaatacagttgatgtatattttatgatagatcctttatattttcctcatgactttagaagggggaagggggagaaaattatgatgaccagactagttaaagagcattgaaagtccacagtactgtagctaaagtagaagtttgggtttgttatagactttacattatatcaactaataagcagatactgtacagtattgctcaccattttatcatacttttgcatatgaactactccattgccttttatagatgttttatagctgatcttaccagttttcctggtaactttttttatttcttttttttttttttgagacggagtctcgccctaacacccaggttggagtgcagtgccgtgatctcggctcactgcaacctctgcctcccgggttcaagcaattctcctgtctcagcctcccgagtacctgggactaccggtgcctgtctccacgcccggctaattttttgtatttgtagtagagacggggtttcaccgtgttagccaggatggtctcgatctcctgacctcatgatctgcctgcctctgcctggacctcccaaagtgctgggattacaggcgtgagcccccgcgcccagccactttctttaatactataactaagaatttattaaaatgcacaaattgtctaagactgtaaagtttattggggagaggccatgactacctctgaatttagtaaatttaaaatatttctgattctcaataaagaactaatatccatataaa

SEQ ID NO: 4616 - DNA, 1863 bp, Homo sapiens
tgcaaaaaacctttcaaaaggctttcctggattagagaaagaaagggagtgagggaggagagatgagtggctattccagaacgacataaagaatttccagccttggacggacagctgggaacgtcttccaatttggactggtgtttacaagcgggaagctaggtggaccttggattttggcgggtgaagaggctaggttgtttaaggaggtggggcgcgtttcagtggctctctttgaaaaagcccagcaagatgtcagacctgctctcagtcttcctccacctcctccttctcttcaagttggttgccccggtgacctttcgccaccaccgctatgatgatcttgtgcggacgctgtacaaggtgcaaaacgaatgccccggcatcacgcgggtctacagcattgggcgcagcgtggaggggagacacctctacgtgctggagttcagcgaccaccctggaatccacgagcccttggaaccagaggtcaagtatgtggggaacatgcacggcaacgaagcgttgggccgcgagctgatgctgcagctgtcggagtttctgtgcgaggagttccggaacaggaaccagcgcatcgtccagctcatccaggacacgcgcattcacatcctgccatccatgaaccccgacggctacgaggtggctgctgcccagggcccaaacaagcctgggtatctagttggcaggaacaatgcaaatggagtggacctgaaccgcaacttccctgatctcaatacctatatctactataacgagaagtacggaggccccaaccaccacctgccccttccagacaactggaaaagtcaggtggaacccgagacccgggcggtgatccggtggatgcactccttcaactttgttctttcagccaatctccacggaggggcggtggtggccaattacccgtatgacaagtcctttgagcaccgggtccgaggggtccgccgcaccgccagcacccccacgcctgacgacaagctcttccagaagctggccaaggtctactcctatgcacatggatggatgttccaaggttggaactgcggagattacttcccagatggcatcaccaatggggcttcctggtattctctcagcaagggaatgcaagactttaattatctccataccaactgctttgagatcacgctggaactgagttgcgacaagtttccccccgaagaggagttacagcgggagtggctgggtaatcgggaagccctaatccagttcctggaacaggttcaccagggcatcaagggaatggtgcttgatgagaattacaataatctcgccaatgctgtcatttctgtcagtgggattaaccatgatgtcacttcaggtgaccatggtgattacttccggctgctgcttccaggtatctacactgttagtgccacagcacctgggtatgacccagagacagtaactgtgaccgtgggtcctgcggaaccaacgttggttaacttccacctcaaaagaagcatccctcaagtaagccctgtgaggagagctcccagcagaaggcacggagtcagagccaaagtgcagccccaagccagaaagaaagaaatggagatgaggcagctgcagagaggccctgcctgaaacccacagtgccaggcaacccttcagaaaggctttgctcctgctctcagatcagatcaagcattctttctattttattatctgggacatatttaaatacaaacatattcagaacaattcagaatggtctccatctgttccaggggtaagccatctctaggtcatcatgaaaaaaattaggatctattgaaaggtgatgtggtggccgggtgtggtggctcacatctgtaatcc

SEQ ID NO: 4617 - DNA, 669 bp, Homo sapiens
cgccaacctctcgcctcctcccaggtggaacccgagacccgggcggtgatccggtggatgcactccttcaactttgttctttcagccaatctccacggaggggcggtggtggccaattacccgtatgacaagtcctttgagcaccgggtccgaggggtccgccgcaccgccagcacccccacgcctgacgacaagctcttccagaagctggccaaggtctactcctatgcacatggatggatgttccaaggttggaactgcggagattacttcccagatggcatcaccaatggggcttcctggtattctctcagcaagggaatgcaagactttaattatctccataccaactgctttgagatcacgctggaactgagttgcgacaagtttccccccgaagaggagttacagcgggagtggctgggtaatcgggaagccctaatccagttcctggaacaggttcaccagggcatcaagggaatggtgcttgatgagaattacaataatctcgccaatgctgtcatttctgtcagtgggattaaccatgatgtcacttcaggtgaccatggtgattacttccggctgctgcttccaggtatctacactgttagtgccacagcacctgggtatgacccagagacagtaactgtgaccgtgggtcctgcggaa

SEQ ID NO: 4618 - DNA, 3028 bp, Homo sapiens
ggattgagctgaccacaggccacaccagactcctctctgctcctgaggaagacagggcagcccggcgccacccgctcggccctcacgaagatgctccctggagcctggctgctctggacctccctcctgctcctggccaggcctgcccagccctgtcccatgggttgtgactgcttcgtccaggaggtgttctgctcagatgaggagcttgccaccgtcccactggacatcccgccatatacgaaaaacatcatctttgtggagacctcgttcaccacattggaaaccagagcttttggcagtaaccccaacttgaccaaggtggtcttcctcaacactcagctctgccagtttaggccggatgccttcggggggctgcccaggctggaggacctggaggtcacaggcagtagcttcttgaacctcagcaccaacatcttctccaacctgacctcgctgggcaagctcaccctcaacttcaacatgctggaggctctgcccgagggtcttttccagcacctggctgccctggagtccctccacctgcaggggaaccagctccaggccctgcccaggaggctcttccagcctctgacccatctgaagacactcaacctggcccagaacctcctggcccagctcccggaggagctgttccacccactcaccagcctgcagaccctgaagctgagcaacaacgcgctctctggtctcccccagggtgtgtttggcaaactgggcagcctgcaggagctcttcctggacagcaacaacatctcggagctgccccctcaggtgttctcccagctcttctgcctagagaggctgtggctgcaacgcaacgccatcacgcacctgccgctctccatctttgcctccctgggtaatctgacctttctgagcttgcagtggaacatgcttcgggtcctgcctgccggcctctttgcccacaccccgtgcctggttggcctgtctctgacccataaccagctggagactgtcgctgagggcacctttgcccacctgtccaacctgcgttccctcatgctctcatacaatgccattacccacctcccagctggcatcttcagagacctggaggagttggtcaaactctacctgggcagcaacaaccttacggcgctgcacccagccctcttccagaacctgtccaagctggagctgctcagcctctccaagaaccagctgaccacacttccggagggcatcttcgacaccaactacaacctgttcaacctggccctgcacggtaacccctggcagtgcgactgccacctggcctacctcttcaactggctgcagcagtacaccgatcggctcctgaacatccagacctactgcgctggccctgcctacctcaaaggccaggtggtgcccgccttgaatgagaagcagctggtgtgtcccgtcacccgggaccacttgggcttccaggtcacgtggccggacgaaagcaaggcagggggcagctgggatctggctgtgcaggaaagggcagcccggagccagtgcacctacagcaaccccgagggcaccgtggtgctcgcctgtgaccaggcccagtgtcgctggctgaacgtccagctctctcctcagcagggctccctgggactgcagtacaatgctagtcaggagtgggacctgaggtcgagctgcggttctctgcggctcaccgtgtctatcgaggctcgggcagcagggccctagtagcagcgcatacaggagctggggaagggggcctctggggcctgaccaggcgacaggtaggggcggaggggagctgagtctccgaagccttggcttttcacatgcaagggacagggttacatccccaaggtgagggggtggagtctggtctgctccactaaccagggtctcctcctcctcttccttcatcgcttctcctggagtgtgcggcctaacaaggccatccttatgccttgcaaagcaccctcaaaagctgcaccacagcctggagaataaaatatcctcagccctgatgcctccccattatgtaacacccaaccgctctcacctacaccctgaggtctattcactgcatcccagtgatacaaagtggaggccactgccttctgacatctggctcaaaagcccagtgtctgtttccatttatttccctggaatttcatttaaaattggtatagagaaaaaaaggatgtgacagaagcagagatgaccagaaagcacaggggcagggttctgactggcgtgtgggagaccctgtggccggcacccacctccacacgaggactaagctctgatttttttatcttgcccaaattcctacctaaggggtctagggagtcgcgccttacaaatcataaattctcatcagatgggttttatttgaccctgtatatcatgacttatttttaatctgactatggcataacattacaagacgaggcaaaaatatttaacccccaaatatatttccttgccctaccttgaacttgccctgcagagtctcttgtgaggagaatccacatcctataaagaagcccctttcccctttgttttccttcctttctttccagtccaggagatcatcaactaagagccaggcaccccttttaagtcgataagaaacagtttacaacctgctctctctctctctgaagtctgctgagagcttcccctgcacaataaaacttggcctccacgatcctttatcttaacctgaacattcctttccattgatcccaggtcttcagctaagctcaaccaattgtcaaccagaaaatgtttaaatttacctacagcctggaagcacccacccccgctgcttcgagttgtcctgcctttctgaactcaaccaatgtatttcttaaatgtatttgattgatgcctcattcctccctaaaatgtataaaaccaagctgtacctcgaccaccttgggcacatgttcccaggccctcctgaggtctgtgtcacgggccatggccactcatatttggctcagaataaatctcttcaaatatttta

SEQ ID NO: 4619 - DNA, 2008 bp, Homo sapiens
gaccacaggccacaccagactcctctctgctcctgaggaagacagggcagcccggcgccacccgctcggccctcacgatgctccctggagcctggctgctctggacctccctcctgctcctggccaggcctgcccagccctgtcccatgggttgtgactgcttcgtccaggaggtgttctgctcagatgaggagcttgccaccgtcccactggacatcccgccatatacgaaaaacatcatctttgtggagacctcgttcaccacattggaaaccagagcttttggcagtaaccccaacttgaccaaggtggtcttcctcaacactcagctctgccagtttaggccggatgccttcggggggctgcccaggctggaggacctggaggtcacaggcagtagcttcttgaacctcagcaccaacatcttctccaacctgacctcgctgggcaagctcaccctcaacttcaacatgctggaggctctgcccgagggtcttttccagcacctggctgccctggagtccctccacctgcaggggaaccagctccaggccctgcccaggaggctcttccagcctctgacccatctgaagacactcaacctggcccagaacctcctggcccagctcccggaggagctgttccacccactcaccagcctgcagaccctgaagctgagcaacaacgcgctctctggtctcccccagggtgtgtttggcaaactgggcagcctgcaggagctcttcctggacagcaacaacatctcggagctgccccctcaggtgttctcccagctcttctgcctagagaggctgtggctgcaacgcaacgccatcacgcacctgccgctctccatctttgcctccctgggtaatctgacctttctgagcttgcagtggaacatgcttcgggtcctgcctgccggcctctttgcccacaccccgtgcctggttggcctgtctctgacccataaccagctggagactgtcgctgagggcacctttgcccacctgtccaacctgcgttccctcatgctctcatacaatgccattacccacctcccagctggcatcttcagagacctggaggagttggtcaaactctacctgggcagcaacaaccttacggcgctgcacccagccctcttccagaacctgtccaagctggagctgctcagcctctccaagaaccagctgaccacacttccggagggcatcttcgacaccaactacaacctgttcaacctggccctgcacggtaacccctggcagtgcgactgccacctggcctacctcttcaactggctgcagcagtacaccgatcggctcctgaacatccagacctactgcgctggccctgcctacctcaaaggccaggtggtgcccgccttgaatgagaagcagctggtgtgtcccgtcacccgggaccacttgggcttccaggtcacgtggccggacgaaagcaaggcagggggcagctgggatctggctgtgcaggaaagggcagcccggagccagtgcacctacagcaaccccgagggcaccgtggtgctcgcctgtgaccaggcccagtgtcgctggctgaacgtccagctctctcctcagcagggctccctgggactgcagtacaatgctagtcaggagtgggacctgaggtcgagctgcggttctctgcggctcaccgtgtctatcgaggctcgggcagcagggccctagtagcagcgcatacaggagctggggaagggggcctctggggcctgaccaggcgacaggtaggggcggaggggagctgagtctccgaagccttggcttttcacatgcaagggacagggttacatccccaaggtgagggggtggagtctggtctgctccactaaccagggtctcctcctcctcttccttcatcgcttctcctggagtgtgcggcctaacaaggccatccttatgccttgcaaagcaccctcaaaagctgcaccacagcctggagaataaaatatcctcagccctga

SEQ ID NO: 4620 - DNA, 2091 bp, Homo sapiens
gtgactgggtggggctgcctcacttctgcctgatttgggaagcgctgcaaggacaaccggctggggtccttgcgcgccgcggctcagggaggagcaccgactgcgccgcaccctgagagatggttggtgccatgtggaaggtgattgtttcgctggtcctgttgatgcctggcccctgtgatgggctgtttcgctccctatacagaagtgtttccatgccacctaagggagactcaggacagccattatttctcaccccttacattgaagctgggaagatccaaaaaggaagagaattgagtttggtcggccctttcccaggactgaacatgaagagttatgccggcttcctcaccgtgaataagacttacaacagcaacctcttcttctggttcttcccagctcagatacagccagaagatgccccagtagttctctggctacagggtgggccgggaggttcatccatgtttggactctttgtggaacatgggccttatgttgtcacaagtaacatgaccttgcgtgacagagacttcccctggaccacaacgctctccatgctttacattgacaatccagtgggcacaggcttcagttttactgatgatacccacggatatgcagtcaatgaggacgatgtagcacgggatttatacagtgcactaattcagtttttccagatatttcctgaatataaaaataatgacttttatgtcactggggagtcttatgcagggaaatatgtgccagccattgcacacctcatccattccctcaaccctgtgagagaggtgaagatcaacctgaacggaattgctattggagatggatattctgatcccgaatcaattatagggggctatgcagaattcctgtaccaaattggcttgttggatgagaagcaaaaaaagtacttccagaagcagtgccatgaatgcatagaacacatcaggaagcagaactggtttgaggcctttgaaatactggataaactactagatggcgacttaacaagtgatccttcttacttccagaatgttacaggatgtagtaattactataactttttgcggtgcacggaacctgaggatcagctttactatgtgaaatttttgtcactcccagaggtgagacaagccatccacgtggggaatcagacttttaatgatggaactatagttgaaaagtacttgcgagaagatacagtacagtcagttaagccatggttaactgaaatcatgaataattataaggttctgatctacaatggccaactggacatcatcgtggcagctgccctgacagagcgctccttgatgggcatggactggaaaggatcccaggaatacaagaaggcagaaaaaaaagtttggaagatctttaaatctgacagtgaagtggctggttacatccggcaagcgggtgacttccatcaggtaattattcgaggtggaggacatattttaccctatgaccagcctctgagagcttttgacatgattaatcgattcatttatggaaaaggatgggatccttatgttggataaactaccttcccaaaagagaacatcagaggttttcattgctgaaaagaaaatcgtaaaaacagaaaatgtcataggaataaaaaaattatcttttcatatctgcaagatttttttcatcaataaaaattatccttgaaacaagtgagcttttgtttttggggggagatgtttactacaaaattaacatgagtacatgagtaagaattacattatttaacttaaaggatgaaaggtatggatgatgtgacactgagacaagatgtataaatgaaattttagggtcttgaataggaagttttaatttcttctaagagtaagtgaaaagtgcagttgtaacaaacaaagctgtaacatctttttctgccaataacagaagtttggcatgccgtgaaggtgtttggaaatattattggataagaatagctcaattatcccaaataaatggatgaagctataatagttttggggaaaagattctcaaatgtataaagtcttagaacaaaagaattctttgaaataaaaatattatatataaaagtaa

SEQ ID NO: 4621 - DNA, 1739 bp, Homo sapiens
agcgctgcaaggacaaccggctggggtccttgcgcgccgcggctcagggaggagcaccgactgcgccgcgtaagtgccgcctgccctgcgtgggtcgtgccagctcagcgggacaggtcctcgcctcggtccctcggacttagggagcgcggggcagaccctgagagatggttggtgccatgtggaaggtgattgtttcgctggtcctgttgatgcctggcccctgtgatgggctgtttcgctccctatacagaagtgtttccatgccacctaagggagactcaggacagccattatttctcaccccttacattgaagctgggaagatccaaaaaggaagagaattgagtttggtcggccctttcccaggactgaacatgaagagttatgccggcttcctcaccgtgaataagacttacaacagcaacctcttcttctggttcttcccagctcagatacagccagaagatgccccagtagttctctggctacagggtgggccgggaggttcatccatgtttggactctttgtggaacatgggccttatgttgtcacaagtaacatgaccttgcgtgacagagacttcccctggaccacaacgctctccatgctttacattgacaatccagtgggcacaggcttcagttttactgatgatacccacggatatgcagtcaatgaggacgatgtagcacgggatttatacagtgcactaattcagtttttccagatatttcctgaatataaaaataatgacttttatgtcactggggagtcttatgcagggaaatatgtgccagccattgcacacctcatccattccctcaaccctgtgagagaggtgaagatcaacctgaacggaattgctattggagatggatattctgatcccgaatcaattatagggggctatgcagaattcctgtaccaaattggcttgttggatgagaagcaaaaaaagtacttccagaagcagtgccatgaatgcatagaacacatcaggaagcagaactggtttgaggcctttgaaatactggataaactactagatggcgacttaacaagtgatccttcttacttccagaatgttacaggatgtagtaattactataactttttgcggtgcacggaacctgaggatcagctttactatgtgaaatttttgtcactcccagaggtgagacaagccatccacgtggggaatcagacttttaatgatggaactatagttgaaaagtacttgcgagaagatacagtacagtcagttaagccatggttaactgaaatcatgaataattataaggttctgatctacaatggccaactggacatcatcgtggcagctgccctgacagagcgctccttgatgggcatggactggaaaggatcccaggaatacaagaaggcagaaaaaaaagtttggaagatctttaaatctgacagtgaagtggctggttacatccggcaagcgggtgacttccatcaggtaattattcgaggtggaggacatattttaccctatgaccagcctctgagagcttttgacatgattaatcgattcatttatggaaaaggatgggatccttatgttggataaactaccttcccaaaagagaacatcagaggttttcattgctgaaaagaaaatcgtaaaaacagaaaatgtcataggaataaaaaaattatcttttcatatctgcaagatttttttcatcaataaaaattatccttgaaacaa

SEQ ID NO: 4622 - DNA, 2213 bp, Homo sapiens
gctcctttcgcttttcgctcgctgcactccaagccccggaacacccgcgtccgcacactaagggcaccaccgctctcccacctctgcgctgtcagatgtcaggcgcggaggtgctctgggcaccgaggtgctggcgaaccaaacaagtatcaccccggacgcctgcccccattccgagagagcgggcgggatggccacaggctgcaatacagtgacacgatcacagctcactgctacagcctctacctcctgggcttaatccatcctccctcctcagcctcccaagcagctgggactacaggtgattttgatatgctgctaaggtttgataagagaaatgagattcagagaacagattatattgttgaagagcttgactggaaatgatccaaacggaaacattggctcttcctggggttccagcctgctgtcttgacaggaactataccatcagctctcctgggtctcttacatgccaagtcatcctgcagatctgggactcactccgtaatcagcttgattgctgtaagttgaacacgtcagtggcatgggcaccagctgcacaaccctaggagccaccaaacacagtatattctatataaatgttgctgccaggagccccagttcaaactacaataccctgagagatggttggtgccatgtggaaggtgattgtttcgctggtcctgttgatgcctggcccctgtgatgggctgtttcgctccctatacagaagtgtttccatgccacctaagggagactcaggacagccattatttctcaccccttacattgaagctgggaagatccaaaaaggaagagaattgagtttggtcggccctttcccaggactgaacatgaagagttatgccggcttcctcaccgtgaataagacttacaacagcaacctcttcttctggttcttcccagctcagatacagccagaagatgccccagtagttctctggctacagggtgggccgggaggttcatccatgtttggactctttgtggaacatgggccttatgttgtcacaagtaacatgaccttgcgtgacagagacttcccctggaccacaacgctctccatgctttacattgacaatccagtgggcacaggcttcagttttactgatgatacccacggatatgcagtcaatgaggacgatgtagcacgggatttatacagtgcactaattcagtttttccagatatttcctgaatataaaaataatgacttttatgtcactggggagtcttatgcagggaaatatgtgccagccattgcacacctcatccattccctcaaccctgtgagagaggtgaagatcaacctgaacggaattgctattggagatggatattctgatcccgaatcaattatagggggctatgcagaattcctgtaccaaattggcttgttggatgagaagcaaaaaaagtacttccagaagcagtgccatgaatgcatagaacacatcaggaagcagaactggtttgaggcctttgaaatactggataaactactagatggcgacttaacaagtgatccttcttacttccagaatgttacaggatgtagtaattactataactttttgcggtgcacggaacctgaggatcagctttactatgtgaaatttttgtcactcccagaggtgagacaagccatccacgtggggaatcagacttttaatgatggaactatagttgaaaagtacttgcgagaagatacagtacagtcagttaagccatggttaactgaaatcatgaataattataaggttctgatctacaatggccaactggacatcatcgtggcagctgccctgacagagcgctccttgatgggcatggactggaaaggatcccaggaatacaagaaggcagaaaaaaaagtttggaagatctttaaatctgacagtgaagtggctggttacatccggcaagcgggtgacttccatcaggtaattattcgaggtggaggacatattttaccctatgaccagcctctgagagcttttgacatgattaatcgattcatttatggaaaaggatgggatccttatgttggataaactaccttcccaaaagagaacatcagaggttttcattgctgaaaagaaaatcgtaaaaacagaaaatgtcataggaataaaaaaattatcttttcatatctgcaagatttttttcatcaataaaaattatccttg

SEQ ID NO: 4623 - DNA, 524 bp, Homo sapiens
aaagaaaatcaagtctgcgaggagcgagggtttgctcccctctgctccggatttgggtgtccagggtagcgggcgcggcacggcaaacaggtcggggcgctctgcttcaccccaaccttctccgccccgccagcccccgctccagctgcgccagaaagtgcgagcctgcccgctcctttcgcttttcgctcgctgcactccaagccccggaacacccgcgtccgcacactaagggcaccaccgctctcccacctctgcgctgtcagatgtcaggcgcggaggtgctctgggcaccgaggtgctggcgaaccaaacaagtatcaccccggacgcctgcccccattccgagagagcgggcgggatggccacaggcttgattgctgtaagttgaacacgtcagtggcatgggcaccagctgcacaaccctaggagccaccaaacacagtatattctatataaatgttgctgccaggagccccagttcaaactacaataccctgagagatggttggtgccatgtggaa

SEQ ID NO: 4624 - DNA, 528 bp, Homo sapiens
gtcagatgtcaggcgcggaggtgctctgggcaccgaggtgctggcgaaccaaacaagtatcaccccggacgcctgcccccattccgagagagcgggcgggatggccacagatccaaacggaaacattggctcttcctggggttccagcctgctgtcttgacaggaactataccatcagctctcctgggtctcttacatgccaagtcatcctgcagatctgggactcactccgtaatcagcttgattgctgtaagttgaacacgtcagtggcatgggcaccagctgcacaaccctaggagccaccaaacacagtatattctatataaatgttgctgccaggagccccagttcaaactacaataccctgagagatggttggtgccatgtggaaggtgattgtttcgctggtcctgttgatgcctggcccctgtgatgggctgtttcgctccctatacagaagtgtttccatgccacctaagggagactcaggacagccattatttctcaccccttacattgaagctggga

SEQ ID NO: 4625 - DNA, 571 bp, Homo sapiens
aaacaaagaaaatcaagtctgcgaggagcgagggtttgctcccctctgctccggatttgggtgtccagggtagcgggcgcggcacggcaaacaggtgattttgatatgctgctaaggtttgataagagaaatgagattcagagaacagattatattgttgaagagcttgactggaaatgatccaaacggaaacattggctcttcctggggttccagcctgctgtcttgacaggaactataccatcagctctcctgggtctcttacatgccaagtcatcctgcagatctgggactcactccgtaatcagcttgattgctgtaagttgaacacgtcagtggcatgggcaccagctgcacaaccctaggagccaccaaacacagtatattctatataaatgttgctgccaggagccccagttcaaactacaataccctgagagatggttggtgccatgtggaaggtgattgtttcgctggtcctgttgatgcctggcccctgtgatgggctgtttcgctccctatacagaagtgtttccatgccacctaagggagactcaggacagccattatt

SEQ ID NO: 4626 - DNA, 1086 bp, Homo sapiens
ggctcagggaggagcaccgactgcgccgcaccctgagagatggttggtgccatgtggaaggtgattgtttcgctggtcctgttgatgcctggcccctgtgatgggctgtttcgctccctatacagaagtgtttccatgccacctaagggagactcaggacagccattatttctcaccccttacattgaagctgggaagatccaaaaaggaagagaattgagtttggtcggccctttcccaggactgaacatgaagagttatgccggcttcctcaccgtgaataagacttacaacagcaacctcttcttctggttcttcccagctcagatacagccagaagatgccccagtagttctctggctacagggtgggccgggaggttcatccatgtttggactctttgtggaacatgggccttatgttgtcacaagtaacatgaccttgcgtgacagagacttcccctggaccacaacgctctccatgctttacattgacaatccagtgggcacaggcttcagttttactgatgatacccacggatatgcagtcaatgaggacgatgtagcacgggatttatacagtgcactaattcagtttttccagatatttcctgaatataaaaataatgacttttatgtcactggggagtcttatgcagggaaatatgtgccagccattgcacacctcatccattccctcaaccctgtgagagaggtgaagatcaacctgaacggaattgctattggagatggatattctgatcccgaatcaattatagggggctatgcagaattcctgtaccaaattggcttgttggatgagaagcaaaaaaagtacttccagaagcagtgccatgaatgcatagaacacatcaggaagcagaactggtttgaggcctttgaaatactggataaactactagatggcgacttaacaagtgatccttcttacttccagaatgttacaggatgtagtaattactataactttttgcggtgcacggaacctgaggatcagctttactatgtgaaatttttgtcactcccagaggtgagacaagccccacgtggggaatcagacttttaa

SEQ ID NO: 4627 - DNA, 3519 bp, Homo sapiens
aaagctctgggccccagggaggaggctcagcacagagagtggaaaacagcagaggtgacagagcagccgtgctcgaagcgttcctggagcccaagctctcctccacaggtgaagacagggccagcaggagacaccatggggcacctctcagccccacttcacagagtgcgtgtaccctggcaggggcttctgctcacagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccatgtatacccggagctgcccaagccctccatctccagcaacaactccaaccctgtggaggacaaggatgctgtggccttcacctgtgaacctgagactcaggacacaacctacctgtggtggataaacaatcagagcctcccggtcagtcccaggctgcagctgtccaatggcaacaggaccctcactctactcagtgtcacaaggaatgacacaggaccctatgagtgtgaaatacagaacccagtgagtgcgaaccgcagtgacccagtcaccttgaatgtcacctatggcccggacacccccaccatttccccttcagacacctattaccgtccaggggcaaacctcagcctctcctgctatgcagcctctaacccacctgcacagtactcctggcttatcaatggaacattccagcaaagcacacaagagctctttatccctaacatcactgtgaataatagtggatcctatacctgccacgccaataactcagtcactggctgcaacaggaccacagtcaagacgatcatagtcactgagctaagtccagtagtagcaaagccccaaatcaaagccagcaagaccacagtcacaggagataaggactctgtgaacctgacctgctccacaaatgacactggaatctccatccgttggttcttcaaaaaccagagtctcccgtcctcggagaggatgaagctgtcccagggcaacaccaccctcagcataaaccctgtcaagagggaggatgctgggacgtattggtgtgaggtcttcaacccaatcagtaagaaccaaagcgaccccatcatgctgaacgtaaactataatgctctaccacaagaaaatggcctctcacctggggccattgctggcattgtgattggagtagtggccctggttgctctgatagcagtagccctggcatgttttctgcatttcgggaagaccggcagggcaagcgaccagcgtgatctcacagagcacaaaccctcagtctccaaccacactcaggaccactccaatgacccacctaacaagatgaatgaagttacttattctaccctgaactttgaagcccagcaacccacacaaccaacttcagcctccccatccctaacagccacagaaataatttattcagaagtaaaaaagcagtaatgaaacctgtcctgctcactgcagtgctgatgtatttcaagtctctcaccctcatcactaggagattcctttcccctgtaggggtagaggggtggggacagaaacaactttctcctactcttccttcctaataggcatctccaggctgcctggtcactgcccctctctcagtgtcaatagatgaaagtacattgggagtctgtaggaaacccaaccttcttgtcattgaaatttggcaaagctgactttgggaaagagggaccagaacttcccctcccttccccttttcccaacctggacttgttttaaacttgcctgttcagagcactcattccttcccacccccagtcctgtcctatcactctaattcggatttgccatagccttgaggttatgtccttttccattaagtacatgtgccaggaaacaagagagagagaaagtaaaggcagtaatgccttctcctatttctccaaagccttgtgtgaactcaccaaacacaagaaaatcaaatatataaccaatagtgaaatgccacacctttgtccactgtcagggttgtctacctgtaggatcagggtctaagcaccttggtgcttagctagaataccacctaatccttctggcaagcctgtcttcagagaacccactagaagcaactaggaaaatcacttgccaaaatccaaggcaattcctgatggaaaatgcaaaagcacatatatgttttaatatctttatgggctctgttcaaggcagtgctgagagggaggggttatagcttcaggagggaaccagcttctgataaacacaatctgctaggaacttgggaaaggaatcagagagctgcccttcagcgattatttaaattattgttaaagaatacacaatttggggtattgggatttttctccttttctctgagacattccaccattttaatttttgtaactgcttatttatgtgaaaagggttatttttacttagcttagctatgtcagccaatccgattgccttaggtgaaagaaaccaccgaaatccctcaggtcccttggtcaggagcctctcaagattttttttgtcagaggctccaaatagaaaataagaaaaggttttcttcattcatggctagagctagatttaactcagtttctaggcacctcagaccaatcatcaactaccattctattccatgtttgcacctgtgcattttctgtttgcccccattcactttgtcaggaaaccttggcctctgctaaggtgtatttggtccttgagaagtgggagcaccctacagggacactatcactcatgctggtggcattgtttacagctagaaagctgcactggtgctaatgccccttggggaaatggggctgtgaggaggaggattataacttaggcctagcctcttttaacagcctctgaaatttatcttttcttctatggggtctataaatgtatcttataataaaaaggaaggacaggaggaagacaggcaaatgtacttctcacccagtcttctacacagatggaatctctttggggctaagagaaaggttttattctatattgcttacctgatctcatgttaggcctaagaggctttctccaggaggattagcttggagttctctatactcaggtacctctttcagggttttctaaccctgacacggactgtgcatactttccctcatccatgctgtgctgtgttatttaatttttcctggctaagatcatgtctgaattatgtatgaaaattattctatgtttttataataaaaataatatatcagacatcga

SEQ ID NO: 4628 - DNA, 1427 bp, Homo sapiens
agcacagagagtggaaaacagcagaggtgacagagcagccgtgctcgaagcgttcctggagcccaagctctcctccacaggtgaagacagggccagcaggagacaccatggggcacctctcagccccacttcacagagtgcgtgtaccctggcaggggcttctgctcacagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccatgtatacccggagctgcccaagccctccatctccagcaacaactccaaccctgtggaggacaaggatgctgtggccttcacctgtgaacctgagactcaggacacaacctacctgtggtggataaacaatcagagcctcccggtcagtcccaggctgcagctgtccaatggcaacaggaccctcactctactcagtgtcacaaggaatgacacaggaccctatgagtgtgaaatacagaacccagtgagtgcgaaccgcagtgacccagtcaccttgaatgtcacctatggcccggacacccccaccatttccccttcagacacctattaccgtccaggggcaaacctcagcctctcctgctatgcagcctctaacccacctgcacagtactcctggcttatcaatggaacattccagcaaagcacacaagagctctttatccctaacatcactgtgaataatagtggatcctatacctgccacgccaataactcagtcactggctgcaacaggaccacagtcaagacgatcatagtcactgagatggcgtttcaccatgttgccaaggctggtctcaaactcctgagctcaagcaatccacccgcctccacctcccaaagtgctaagattacagataatgctctaccacaagaaaatggcctctcacctggggccattgctggcattgtgattggagtagtggccctggttgctctgatagcagtagccctggcatgttttctgcatttcgggaagaccggcagctcaggaccactccaatgacccacctaacaagatgaatgaagttacttattctaccctgaactttgaagcccagcaacccacacaaccaacttcagcctccccatccctaacagccacagaaataatttattcagaagt

SEQ ID NO: 4629 - DNA, 1619 bp, Homo sapiens
gagcagccgtgctcgaagcgttcctggagcccaagctctcctccacaggtgaagacagggccagcaggagacaccatggggcacctctcagccccacttcacagagtgcgtgtaccctggcaggggcttctgctcacagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccatgtatacccggagctgcccaagccctccatctccagcaacaactccaaccctgtggaggacaaggatgctgtggccttcacctgtgaacctgagactcaggacacaacctacctgtggtggataaacaatcagagcctcccggtcagtcccaggctgcagctgtccaatggcaacaggaccctcactctactcagtgtcacaaggaatgacacaggaccctatgagtgtgaaatacagaacccagtgagtgcgaaccgcagtgacccagtcaccttgaatgtcacctatggcccggacacccccaccatttccccttcagacacctattaccgtccaggggcaaacctcagcctctcctgctatgcagcctctaacccacctgcacagtactcctggcttatcaatggaacattccagcaaagcacacaagagctctttatccctaacatcactgtgaataatagtggatcctatacctgccacgccaataactcagtcactggctgcaacaggaccacagtcaagacgatcatagtcactgagtctcccgtcctcggagaggatgaagctgtcccagggcaacaccaccctcagcataaaccctgtcaagagggaggatgctgggacgtattggtgtgaggtcttcaacccaatcagtaagaaccaaagcgaccccatcatgctgaacgtaaactgtaagtgactcctcaccccttcctatatgtccctctaggattactctgtcaatggtgtgcaaaatggataaaactcacaggaggcagaatatcaatgaagagaccattatagcaaacagaattgcaaagtggttaagagctcagctcaggccgggcacagtggctcacgcctgtaatcccagcagtttgggaggccaaggcgggcggatcacgagggcaggagatcgagaccatcctggctaatatggtgaaaccccgtgtctactaaaaatacaaaaaaaaattagccgggcatggtggcgggcgcctgtagtcccagctactcgggaggctgaggcgggagaatggcgtgaacctgggaggcggagctttcagtgagccgagatggtgccactgcactccagtctaggcaacagagcaagactctgtctc

SEQ ID NO: 4630 - DNA, 2675 bp, Homo sapiens
aggctcagcacagagagtggaaaacagcagaggtgacagagcagccgtgctcgaagcgttcctggagcccaagctctcctccacaggtgaagacagggccagcaggagacaccatggggcacctctcagccccacttcacagagtgcgtgtaccctggcaggggcttctgctcacagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccatgtataccataatgctctaccacaagaaaatggcctctcacctggggccattgctggcattgtgattggagtagtggccctggttgctctgatagcagtagccctggcatgttttctgcatttcgggaagaccggcagggcaagcgaccagcgtgatctcacagagcacaaaccctcagtctccaaccacactcaggaccactccaatgacccacctaacaagatgaatgaagttacttattctaccctgaactttgaagcccagcaacccacacaaccaacttcagcctccccatccctaacagccacagaaataatttattcagaagtaaaaaagcagtaatgaaacctgtcctgctcactgcagtgctgatgtatttcaagtctctcaccctcatcactaggagattcctttcccctgtaggggtagaggggtggggacagaaacaactttctcctactcttccttcctaataggcatctccaggctgcctggtcactgcccctctctcagtgtcaatagatgaaagtacattgggagtctgtaggaaacccaaccttcttgtcattgaaatttggcaaagctgactttgggaaagagggaccagaacttcccctcccttccccttttcccaacctggacttgttttaaacttgcctgttcagagcactcattccttcccacccccagtcctgtcctatcactctaattcggatttgccatagccttgaggttatgtccttttccattaagtacatgtgccaggaaacaagagagagagaaagtaaaggcagtaatgccttctcctatttctccaaagccttgtgtgaactcaccaaacacaagaaaatcaaatatataaccaatagtgaaatgccacacctttgtccactgtcagggttgtctacctgtaggatcagggtctaagcaccttggtgcttagctagaataccacctaatccttctggcaagcctgtcttcagagaacccactagaagcaactaggaaaatcacttgccaaaatccaaggcaattcctgatggaaaatgcaaaagcacatatatgttttaatatctttatgggctctgttcaaggcagtgctgagagggaggggttatagcttcaggagggaaccagcttctgataaacacaatctgctaggaacttgggaaaggaatcagagagctgcccttcagcgattatttaaattattgttaaagaatacacaatttggggtattgggatttttctccttttctctgagacattccaccattttaatttttgtaactgcttatttatgtgaaaagggttatttttacttagcttagctatgtcagccaatccgattgccttaggtgaaagaaaccaccgaaatccctcaggtcccttggtcaggagcctctcaagattttttttgtcagaggctccaaatagaaaataagaaaaggttttcttcattcatggctagagctagatttaactcagtttctaggcacctcagaccaatcatcaactaccattctattccatgtttgcacctgtgcattttctgtttgcccccattcactttgtcaggaaaccttggcctctgctaaggtgtatttggtccttgagaagtgggagcaccctacagggacactatcactcatgctggtggcattgtttacagctagaaagctgcactggtgctaatgccccttggggaaatggggctgtgaggaggaggattataacttaggcctagcctcttttaacagcctctgaaatttatcttttcttctatggggtctataaatgtatcttataataaaaaggaaggacaggaggaagacaggcaaatgtacttctcacccagtcttctacacagatggaatctctttggggctaagagaaaggttttattctatattgcttacctgatctcatgttaggcctaagaggctttctccaggaggattagcttggagttctctatactcaggtacctctttcagggttttctaaccctgacacggactgtgcatactttccctcatccatgctgtgctgtgttatttaatttttcctggctaagatcatgtctgaattatgtatgaaaattattctatgtttttataataaaaataatatatcagacatcga

SEQ ID NO: 4631 - DNA, 3230 bp, Homo sapiens
aaagctctgggccccagggaggaggctcagcacagagagtggaaaacagcagaggtgacagagcagccgtgctcgaagcgttcctggagcccaagctctcctccacaggtgaagacagggccagcaggagacaccatggggcacctctcagccccacttcacagagtgcgtgtaccctggcaggggcttctgctcacagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccatgtatacccggagctgcccaagccctccatctccagcaacaactccaaccctgtggaggacaaggatgctgtggccttcacctgtgaacctgagactcaggacacaacctacctgtggtggataaacaatcagagcctcccggtcagtcccaggctgcagctgtccaatggcaacaggaccctcactctactcagtgtcacaaggaatgacacaggaccctatgagtgtgaaatacagaacccagtgagtgcgaaccgcagtgacccagtcaccttgaatgtcacctatggcccggacacccccaccatttccccttcagacacctattaccgtccaggggcaaacctcagcctctcctgctatgcagcctctaacccacctgcacagtactcctggcttatcaatggaacattccagcaaagcacacaagagctctttatccctaacatcactgtgaataatagtggatcctatacctgccacgccaataactcagtcactggctgcaacaggaccacagtcaagacgatcatagtcactgataatgctctaccacaagaaaatggcctctcacctggggccattgctggcattgtgattggagtagtggccctggttgctctgatagcagtagccctggcatgttttctgcatttcgggaagaccggcagggcaagcgaccagcgtgatctcacagagcacaaaccctcagtctccaaccacactcaggaccactccaatgacccacctaacaagatgaatgaagttacttattctaccctgaactttgaagcccagcaacccacacaaccaacttcagcctccccatccctaacagccacagaaataatttattcagaagtaaaaaagcagtaatgaaacctgtcctgctcactgcagtgctgatgtatttcaagtctctcaccctcatcactaggagattcctttcccctgtaggggtagaggggtggggacagaaacaactttctcctactcttccttcctaataggcatctccaggctgcctggtcactgcccctctctcagtgtcaatagatgaaagtacattgggagtctgtaggaaacccaaccttcttgtcattgaaatttggcaaagctgactttgggaaagagggaccagaacttcccctcccttccccttttcccaacctggacttgttttaaacttgcctgttcagagcactcattccttcccacccccagtcctgtcctatcactctaattcggatttgccatagccttgaggttatgtccttttccattaagtacatgtgccaggaaacaagagagagagaaagtaaaggcagtaatgccttctcctatttctccaaagccttgtgtgaactcaccaaacacaagaaaatcaaatatataaccaatagtgaaatgccacacctttgtccactgtcagggttgtctacctgtaggatcagggtctaagcaccttggtgcttagctagaataccacctaatccttctggcaagcctgtcttcagagaacccactagaagcaactaggaaaatcacttgccaaaatccaaggcaattcctgatggaaaatgcaaaagcacatatatgttttaatatctttatgggctctgttcaaggcagtgctgagagggaggggttatagcttcaggagggaaccagcttctgataaacacaatctgctaggaacttgggaaaggaatcagagagctgcccttcagcgattatttaaattattgttaaagaatacacaatttggggtattgggatttttctccttttctctgagacattccaccattttaatttttgtaactgcttatttatgtgaaaagggttatttttacttagcttagctatgtcagccaatccgattgccttaggtgaaagaaaccaccgaaatccctcaggtcccttggtcaggagcctctcaagattttttttgtcagaggctccaaatagaaaataagaaaaggttttcttcattcatggctagagctagatttaactcagtttctaggcacctcagaccaatcatcaactaccattctattccatgtttgcacctgtgcattttctgtttgcccccattcactttgtcaggaaaccttggcctctgctaaggtgtatttggtccttgagaagtgggagcaccctacagggacactatcactcatgctggtggcattgtttacagctagaaagctgcactggtgctaatgccccttggggaaatggggctgtgaggaggaggattataacttaggcctagcctcttttaacagcctctgaaatttatcttttcttctatggggtctataaatgtatcttataataaaaaggaaggacaggaggaagacaggcaaatgtacttctcacccagtcttctacacagatggaatctctttggggctaagagaaaggttttattctatattgcttacctgatctcatgttaggcctaagaggctttctccaggaggattagcttggagttctctatactcaggtacctctttcagggttttctaaccctgacacggactgtgcatactttccctcatccatgctgtgctgtgttatttaatttttcctggctaagatcatgtctgaattatgtatgaaaattattctatgtttttataataaaaataatatatcagacatcg

SEQ ID NO: 4632 - DNA, 3302 bp, Homo sapiens
aggctcagcacagagagtggaaaacagcagaggtgacagagcagccgtgctcgaagcgttcctggagcccaagctctcctccacaggtgaagacagggccagcaggagacaccatggggcacctctcagccccacttcacagagtgcgtgtaccctggcaggggcttctgctcacagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccatgtatacccggagctgcccaagccctccatctccagcaacaactccaaccctgtggaggacaaggatgctgtggccttcacctgtgaacctgagactcaggacacaacctacctgtggtggataaacaatcagagcctcccggtcagtcccaggctgcagctgtccaatggcaacaggaccctcactctactcagtgtcacaaggaatgacacaggaccctatgagtgtgaaatacagaacccagtgagtgcgaaccgcagtgacccagtcaccttgaatgtcacctatggcccggacacccccaccatttccccttcagacacctattaccgtccaggggcaaacctcagcctctcctgctatgcagcctctaacccacctgcacagtactcctggcttatcaatggaacattccagcaaagcacacaagagctctttatccctaacatcactgtgaataatagtggatcctatacctgccacgccaataactcagtcactggctgcaacaggaccacagtcaagacgatcatagtcactgagagacagaatctcaccatgttacccaggctggactcgaactcctgggctcaagcaatcctcccatctgtttcccaaagtgctgagattacagataatgctctaccacaagaaaatggcctctcacctggggccattgctggcattgtgattggagtagtggccctggttgctctgatagcagtagccctggcatgttttctgcatttcgggaagaccggcagggcaagcgaccagcgtgatctcacagagcacaaaccctcagtctccaaccacactcaggaccactccaatgacccacctaacaagatgaatgaagttacttattctaccctgaactttgaagcccagcaacccacacaaccaacttcagcctccccatccctaacagccacagaaataatttattcagaagtaaaaaagcagtaatgaaacctgtcctgctcactgcagtgctgatgtatttcaagtctctcaccctcatcactaggagattcctttcccctgtaggggtagaggggtggggacagaaacaactttctcctactcttccttcctaataggcatctccaggctgcctggtcactgcccctctctcagtgtcaatagatgaaagtacattgggagtctgtaggaaacccaaccttcttgtcattgaaatttggcaaagctgactttgggaaagagggaccagaacttcccctcccttccccttttcccaacctggacttgttttaaacttgcctgttcagagcactcattccttcccacccccagtcctgtcctatcactctaattcggatttgccatagccttgaggttatgtccttttccattaagtacatgtgccaggaaacaagagagagagaaagtaaaggcagtaatgccttctcctatttctccaaagccttgtgtgaactcaccaaacacaagaaaatcaaatatataaccaatagtgaaatgccacacctttgtccactgtcagggttgtctacctgtaggatcagggtctaagcaccttggtgcttagctagaataccacctaatccttctggcaagcctgtcttcagagaacccactagaagcaactaggaaaatcacttgccaaaatccaaggcaattcctgatggaaaatgcaaaagcacatatatgttttaatatctttatgggctctgttcaaggcagtgctgagagggaggggttatagcttcaggagggaaccagcttctgataaacacaatctgctaggaacttgggaaaggaatcagagagctgcccttcagcgattatttaaattattgttaaagaatacacaatttggggtattgggatttttctccttttctctgagacattccaccattttaatttttgtaactgcttatttatgtgaaaagggttatttttacttagcttagctatgtcagccaatccgattgccttaggtgaaagaaaccaccgaaatccctcaggtcccttggtcaggagcctctcaagattttttttgtcagaggctccaaatagaaaataagaaaaggttttcttcattcatggctagagctagatttaactcagtttctaggcacctcagaccaatcatcaactaccattctattccatgtttgcacctgtgcattttctgtttgcccccattcactttgtcaggaaaccttggcctctgctaaggtgtatttggtccttgagaagtgggagcaccctacagggacactatcactcatgctggtggcattgtttacagctagaaagctgcactggtgctaatgccccttggggaaatggggctgtgaggaggaggattataacttaggcctagcctcttttaacagcctctgaaatttatcttttcttctatggggtctataaatgtatcttataataaaaaggaaggacaggaggaagacaggcaaatgtacttctcacccagtcttctacacagatggaatctctttggggctaagagaaaggttttattctatattgcttacctgatctcatgttaggcctaagaggctttctccaggaggattagcttggagttctctatactcaggtacctctttcagggttttctaaccctgacacggactgtgcatactttccctcatccatgctgtgctgtgttatttaatttttcctggctaagatcatgtctgaattatgtatgaaaattattctatgtttttataataaaaataatatatcagacatcga

SEQ ID NO: 4633 - DNA, 1773 bp, Homo sapiens
ggaaaacagcagaggtgacagagcagccgtgctcgaagcgttcctggagcccaagctctcctccacaggtgaagacagggccagcaggagacaccatggggcacctctcagccccacttcacagagtgcgtgtaccctggcaggggcttctgctcacagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccatgtatacccggagctgcccaagccctccatctccagcaacaactccaaccctgtggaggacaaggatgctgtggccttcacctgtgaacctgagactcaggacacaacctacctgtggtggataaacaatcagagcctcccggtcagtcccaggctgcagctgtccaatggcaacaggaccctcactctactcagtgtcacaaggaatgacacaggaccctatgagtgtgaaatacagaacccagtgagtgcgaaccgcagtgacccagtcaccttgaatgtcacctatggcccggacacccccaccatttccccttcagacacctattaccgtccaggggcaaacctcagcctctcctgctatgcagcctctaacccacctgcacagtactcctggcttatcaatggaacattccagcaaagcacacaagagctctttatccctaacatcactgtgaataatagtggatcctatacctgccacgccaataactcagtcactggctgcaacaggaccacagtcaagacgatcatagtcactgagctaagtccagtagtagcaaagccccaaatcaaagccagcaagaccacagtcacaggagataaggactctgtgaacctgacctgctccacaaatgacactggaatctccatccgttggttcttcaaaaaccagagtctcccgtcctcggagaggatgaagctgtcccagggcaacaccaccctcagcataaaccctgtcaagagggaggatgctgggacgtattggtgtgaggtcttcaacccaatcagtaagaaccaaagcgaccccatcatgctgaacgtaaactgtaagtgactcctcaccccttcctatatgtccctctaggattactctgtcaatggtgtgcaaaatggataaaactcacaggaggcagaatatcaatgaagagaccattatagcaaacagaattgcaaagtggttaagagctcagctcaggccgggcacagtggctcacgcctgtaatcccagcagtttgggaggccaaggcgggcggatcacgagggcaggagatcgagaccatcctggctaatatggtgaaaccccgtgtctactaaaaatacaaaaaaaaattagccgggcatggtggcgggcgcctgtagtcccagctactcgggaggctgaggcgggagaatggcgtgaacctgggaggcggagctttcagtgagccgagatggtgccactgcactccagtctaggcaacagagcaagactctgtctc

SEQ ID NO: 4634 - DNA, 3677 bp, Homo sapiens
aggctcagcacagagagtggaaaacagcagaggtgacagagcagccgtgctcgaagcgttcctggagcccaagctctcctccacaggtgaagacagggccagcaggagacaccatggggcacctctcagccccacttcacagagtgcgtgtaccctggcaggggcttctgctcacagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccatgtatacccggagctgcccaagccctccatctccagcaacaactccaaccctgtggaggacaaggatgctgtggccttcacctgtgaacctgagactcaggacacaacctacctgtggtggataaacaatcagagcctcccggtcagtcccaggctgcagctgtccaatggcaacaggaccctcactctactcagtgtcacaaggaatgacacaggaccctatgagtgtgaaatacagaacccagtgagtgcgaaccgcagtgacccagtcaccttgaatgtcacctatggcccggacacccccaccatttccccttcagacacctattaccgtccaggggcaaacctcagcctctcctgctatgcagcctctaacccacctgcacagtactcctggcttatcaatggaacattccagcaaagcacacaagagctctttatccctaacatcactgtgaataatagtggatcctatacctgccacgccaataactcagtcactggctgcaacaggaccacagtcaagacgatcatagtcactgagctaagtccagtagtagcaaagccccaaatcaaagccagcaagaccacagtcacaggagataaggactctgtgaacctgacctgctccacaaatgacactggaatctccatccgttggttcttcaaaaaccagagtctcccgtcctcggagaggatgaagctgtcccagggcaacaccaccctcagcataaaccctgtcaagagggaggatgctgggacgtattggtgtgaggtcttcaacccaatcagtaagaaccaaagcgaccccatcatgctgaacgagatggcgtttcaccatgttgccaaggctggtctcaaactcctgagctcaagcaatccacccgcctccacctcccaaagtgctaagattacagagagacagaatctcaccatgttacccaggctggactcgaactcctgggctcaagcaatcctcccatctgtttcccaaagtgctgagattacagataatgctctaccacaagaaaatggcctctcacctggggccattgctggcattgtgattggagtagtggccctggttgctctgatagcagtagccctggcatgttttctgcatttcgggaagaccggcagggcaagcgaccagcgtgatctcacagagcacaaaccctcagtctccaaccacactcaggaccactccaatgacccacctaacaagatgaatgaagttacttattctaccctgaactttgaagcccagcaacccacacaaccaacttcagcctccccatccctaacagccacagaaataatttattcagaagtaaaaaagcagtaatgaaacctgtcctgctcactgcagtgctgatgtatttcaagtctctcaccctcatcactaggagattcctttcccctgtaggggtagaggggtggggacagaaacaactttctcctactcttccttcctaataggcatctccaggctgcctggtcactgcccctctctcagtgtcaatagatgaaagtacattgggagtctgtaggaaacccaaccttcttgtcattgaaatttggcaaagctgactttgggaaagagggaccagaacttcccctcccttccccttttcccaacctggacttgttttaaacttgcctgttcagagcactcattccttcccacccccagtcctgtcctatcactctaattcggatttgccatagccttgaggttatgtccttttccattaagtacatgtgccaggaaacaagagagagagaaagtaaaggcagtaatgccttctcctatttctccaaagccttgtgtgaactcaccaaacacaagaaaatcaaatatataaccaatagtgaaatgccacacctttgtccactgtcagggttgtctacctgtaggatcagggtctaagcaccttggtgcttagctagaataccacctaatccttctggcaagcctgtcttcagagaacccactagaagcaactaggaaaatcacttgccaaaatccaaggcaattcctgatggaaaatgcaaaagcacatatatgttttaatatctttatgggctctgttcaaggcagtgctgagagggaggggttatagcttcaggagggaaccagcttctgataaacacaatctgctaggaacttgggaaaggaatcagagagctgcccttcagcgattatttaaattattgttaaagaatacacaatttggggtattgggatttttctccttttctctgagacattccaccattttaatttttgtaactgcttatttatgtgaaaagggttatttttacttagcttagctatgtcagccaatccgattgccttaggtgaaagaaaccaccgaaatccctcaggtcccttggtcaggagcctctcaagattttttttgtcagaggctccaaatagaaaataagaaaaggttttcttcattcatggctagagctagatttaactcagtttctaggcacctcagaccaatcatcaactaccattctattccatgtttgcacctgtgcattttctgtttgcccccattcactttgtcaggaaaccttggcctctgctaaggtgtatttggtccttgagaagtgggagcaccctacagggacactatcactcatgctggtggcattgtttacagctagaaagctgcactggtgctaatgccccttggggaaatggggctgtgaggaggaggattataacttaggcctagcctcttttaacagcctctgaaatttatcttttcttctatggggtctataaatgtatcttataataaaaaggaaggacaggaggaagacaggcaaatgtacttctcacccagtcttctacacagatggaatctctttggggctaagagaaaggttttattctatattgcttacctgatctcatgttaggcctaagaggctttctccaggaggattagcttggagttctctatactcaggtacctctttcagggttttctaaccctgacacggactgtgcatactttccctcatccatgctgtgctgtgttatttaatttttcctggctaagatcatgtctgaattatgtatgaaaattattctatgtttttataataaaaataatatatcagacatcga

SEQ ID NO: 4635 - DNA, 1778 bp, Homo sapiens
ggaaaacagcagaggtgacagagcagccgtgctcgaagcgttcctggagcccaagctctcctccacaggtgaagacagggccagcaggagacaccatggggcacctctcagccccacttcacagagtgcgtgtaccctggcaggggcttctgctcacagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccatgtatacccggagctgcccaagccctccatctccagcaacaactccaaccctgtggaggacaaggatgctgtggccttcacctgtgaacctgagactcaggacacaacctacctgtggtggataaacaatcagagcctcccggtcagtcccaggctgcagctgtccaatggcaacaggaccctcactctactcagtgtcacaaggaatgacacaggaccctatgagtgtgaaatacagaacccagtgagtgcgaaccgcagtgacccagtcaccttgaatgtcacctatggcccggacacccccaccatttccccttcagacacctattaccgtccaggggcaaacctcagcctctcctgctatgcagcctctaacccacctgcacagtactcctggcttatcaatggaacattccagcaaagcacacaagagctctttatccctaacatcactgtgaataatagtggatcctatacctgccacgccaataactcagtcactggctgcaacaggaccacagtcaagacgatcatagtcactggtaagtaattcctggagcatcaacactaagatctggggtacaagctttctggttttcaaataggagcagagaagaaattttcttttgcagcctgtatccaacaggcacaaacaagtccaaattctcccctgaaccctctcaattcatctgtgcagactctcttccctttgtttttctgatttctcacagctgaccttaggtccagcctggaatgtggggagggggttctctcagccccagaaagccccgtgtagcaggaggggcttcacagagggggaagcagaaagggtcctcaaggtcaatttgcttctgtcactaacatgtccctttctgtaacttcttggccttcttttacctattccatgagatataaggaatatgtgaggttttaaaacagactcacaatagttttccctaaatgagagaaggaaatgcccttcatcagggatgagcagctcagactctgctccctgctctactcccggcttgcccggtgattggctctgccctgatcccatgtggggtaggacgcaggtgtgtgcagaaggtgtccaggtggcctgtcatgaatccagctaaatcaagatggcagtcaatggctgggcgctgtggttcatgcctgtgatcccagtactttggaaggccgaggtgagaggatcacctgaggtcaggagttcgagaccagcctgaccaacatggcaaaactccatctctactaaaaatac

SEQ ID NO: 4636 - DNA, 3465 bp, Homo sapiens
agaggtgacagagcagccgtgctcgaagcgttcctggagcccaagctctcctccacaggtgaagacagggccagcaggagacaccatggggcacctctcagccccacttcacagagtgcgtgtaccctggggcttctgctcacagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccatgtatacccggagctgcccaagccctccatctccagcaacaactccaaccctgtggaggacaaggatgctgtggccttcacctgtgaacctgagactcaggacacaacctacctgtggtggataaacaatcagagcctcccggtcagtcccaggctgcagctgtccaatggcaacaggaccctcactctactcagtgtcacaaggaatgacacaggaccctatgagtgtgaaatacagaacccagtgagtgcgaaccgcagtgacccagtcaccttgaatgtcacctatggcccggacacccccaccatttccccttcagacacctattaccgtccaggggcaaacctcagcctctcctgctatgcagcctctaacccacctgcacagtactcctggcttatcaatggaacattccagcaaagcacacaagagctctttatccctaacatcactgtgaataatagtggatcctatacctgccacgccaataactcagtcactggctgcaacaggaccacagtcaagacgatcatagtcactgagctaagtccagtagtagcaaagccccaaatcaaagccagcaagaccacagtcacaggagataaggactctgtgaacctgacctgctccacaaatgacactggaatctccatccgttggttcttcaaaaaccagagtctcccgtcctcggagaggatgaagctgtcccagggcaacaccaccctcagcataaaccctgtcaagagggaggatgctgggacgtattggtgtgaggtcttcaacccaatcagtaagaaccaaagcgaccccatcatgctgaacgtaaactataatgctctaccacaagaaaatggcctctcacctggggccattgctggcattgtgattggagtagtggccctggttgctctgatagcagtagccctggcatgttttctgcatttcgggaagaccggcagggcaagcgaccagcgtgatctcacagagcacaaaccctcagtctccaaccacactcaggaccactccaatgacccacctaacaagatgaatgaagttacttattctaccctgaactttgaagcccagcaacccacacaaccaacttcagcctccccatccctaacagccacagaaataatttattcagaagtaaaaaagcagtaatgaaacctgtcctgctcactgcagtgctgatgtatttcaagtctctcaccctcatcactaggagattcctttcccctgtaggggtagaggggtggggacagaaacaactttctcctactcttccttcctaataggcatctccaggctgcctggtcactgcccctctctcagtgtcaatagatgaaagtacattgggagtctgtaggaaacccaaccttcttgtcattgaaatttggcaaagctgactttgggaaagagggaccagaacttcccctcccttccccttttcccaacctggacttgttttaaacttgcctgttcagagcactcattccttcccacccccagtcctgtcctatcactctaattcggatttgccatagccttgaggttatgtccttttccattaagtacatgtgccaggaaacaagagagagagaaagtaaaggcagtaatgccttctcctatttctccaaagccttgtgtgaactcaccaaacacaagaaaatcaaatatataaccaatagtgaaatgccacacctttgtccactgtcagggttgtctacctgtaggatcagggtctaagcaccttggtgcttagctagaataccacctaatccttctggcaagcctgtcttcagagaacccactagaagcaactaggaaaatcacttgccaaaatccaaggcaattcctgatggaaaatgcaaaagcacatatatgttttaatatctttatgggctctgttcaaggcagtgctgagagggaggggttatagcttcaggagggaaccagcttctgataaacacaatctgctaggaacttgggaaaggaatcagagagctgcccttcagcgattatttaaattattgttaaagaatacacaatttggggtattgggatttttctccttttctctgagacattccaccattttaatttttgtaactgcttatttatgtgaaaagggttatttttacttagcttagctatgtcagccaatccgattgccttaggtgaaagaaaccaccgaaatccctcaggtcccttggtcaggagcctctcaagattttttttgtcagaggctccaaatagaaaataagaaaaggttttcttcattcatggctagagctagatttaactcagtttctaggcacctcagaccaatcatcaactaccattctattccatgtttgcacctgtgcattttctgtttgcccccattcactttgtcaggaaaccttggcctctgctaaggtgtatttggtccttgagaagtgggagcaccctacagggacactatcactcatgctggtggcattgtttacagctagaaagctgcactggtgctaatgccccttggggaaatggggctgtgaggaggaggattataacttaggcctagcctcttttaacagcctctgaaatttatcttttcttctatggggtctataaatgtatcttataataaaaaggaaggacaggaggaagacaggcaaatgtacttctcacccagtcttctacacagatggaatctctttggggctaagagaaaggttttattctatattgcttacctgatctcatgttaggcctaagaggctttctccaggaggattagcttggagttctctatactcaggtacctctttcagggttttctaaccctgacacggactgtgcatactttccctcatccatgctgtgctgtgttatttaatttttcctggctaagatcatgtctgaattatgtatgaaaattattctatgtttttataataaaaataatatatcagacatcga

SEQ ID NO: 4637 - DNA, 3427 bp, Homo sapiens
acagagagtggaaaacagcagaggtgacagagcagccgtgctcgaagcgttcctggagcccaagctctcctccacaggtgaagacagggccagcaggagacaccatggggcacctctcagccccacttcacagagtgcgtgtaccctggcaggggcttctgctcacagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccatgtatacccggagctgcccaagccctccatctccagcaacaactccaaccctgtggaggacaaggatgctgtggccttcacctgtgaacctgagactcaggacacaacctacctgtggtggataaacaatcagagcctcccggtcagtcccaggctgcagctgtccaatggcaacaggaccctcactctactcagtgtcacaaggaatgacacaggaccctatgagtgtgaaatacagaacccagtgagtgcgaaccgcagtgacccagtcaccttgaatgtcacctatggcccggacacccccaccatttccccttcagacacctattaccgtccaggggcaaacctcagcctctcctgctatgcagcctctaacccacctgcacagtactcctggcttatcaatggaacattccagcaaagcacacaagagctctttatccctaacatcactgtgaataatagtggatcctatacctgccacgccaataactcagtcactggctgcaacaggaccacagtcaagacgatcatagtcactgagctaagtccagtagtagcaaagccccaaatcaaagccagcaagaccacagtcacaggagataaggactctgtgaacctgacctgctccacaaatgacactggaatctccatccgttggttcttcaaaaaccagagtctcccgtcctcggagaggatgaagctgtcccagggcaacaccaccctcagcataaaccctgtcaagagggaggatgctgggacgtattggtgtgaggtcttcaacccaatcagtaagaaccaaagcgaccccatcatgctgaacgtaaactataatgctctaccacaagaaaatggcctctcacctggggccattgctggcattgtgattggagtagtggccctggttgctctgatagcagtagccctggcatgttttctgcatttcgggaagaccggcagctcaggaccactccaatgacccacctaacaagatgaatgaagttacttattctaccctgaactttgaagcccagcaacccacacaaccaacttcagcctccccatccctaacagccacagaaataatttattcagaagtaaaaaagcagtaatgaaacctgtcctgctcactgcagtgctgatgtatttcaagtctctcaccctcatcactaggagattcctttcccctgtaggggtagaggggtggggacagaaacaactttctcctactcttccttcctaataggcatctccaggctgcctggtcactgcccctctctcagtgtcaatagatgaaagtacattgggagtctgtaggaaacccaaccttcttgtcattgaaatttggcaaagctgactttgggaaagagggaccagaacttcccctcccttccccttttcccaacctggacttgttttaaacttgcctgttcagagcactcattccttcccacccccagtcctgtcctatcactctaattcggatttgccatagccttgaggttatgtccttttccattaagtacatgtgccaggaaacaagagagagagaaagtaaaggcagtaatgccttctcctatttctccaaagccttgtgtgaactcaccaaacacaagaaaatcaaatatataaccaatagtgaaatgccacacctttgtccactgtcagggttgtctacctgtaggatcagggtctaagcaccttggtgcttagctagaataccacctaatccttctggcaagcctgtcttcagagaacccactagaagcaactaggaaaatcacttgccaaaatccaaggcaattcctgatggaaaatgcaaaagcacatatatgttttaatatctttatgggctctgttcaaggcagtgctgagagggaggggttatagcttcaggagggaaccagcttctgataaacacaatctgctaggaacttgggaaaggaatcagagagctgcccttcagcgattatttaaattattgttaaagaatacacaatttggggtattgggatttttctccttttctctgagacattccaccattttaatttttgtaactgcttatttatgtgaaaagggttatttttacttagcttagctatgtcagccaatccgattgccttaggtgaaagaaaccaccgaaatccctcaggtcccttggtcaggagcctctcaagattttttttgtcagaggctccaaatagaaaataagaaaaggttttcttcattcatggctagagctagatttaactcagtttctaggcacctcagaccaatcatcaactaccattctattccatgtttgcacctgtgcattttctgtttgcccccattcactttgtcaggaaaccttggcctctgctaaggtgtatttggtccttgagaagtgggagcaccctacagggacactatcactcatgctggtggcattgtttacagctagaaagctgcactggtgctaatgccccttggggaaatggggctgtgaggaggaggattataacttaggcctagcctcttttaacagcctctgaaatttatcttttcttctatggggtctataaatgtatcttataataaaaaggaaggacaggaggaagacaggcaaatgtacttctcacccagtcttctacacagatggaatctctttggggctaagagaaaggttttattctatattgcttacctgatctcatgttaggcctaagaggctttctccaggaggattagcttggagttctctatactcaggtacctctttcagggttttctaaccctgacacggactgtgcatactttccctcatccatgctgtgctgtgttatttaatttttcctggctaagatcatgtctgaattatgtatgaaaattattctatgtttttataataaaaataatatatca

SEQ ID NO: 4638 - DNA, 1263 bp, Homo sapiens
gacaccatggggcacctctcagccccacttcacagagtgcgtgtaccctggcaggggcttctgctcacagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccatgtatacccggagctgcccaagccctccatctccagcaacaactccaaccctgtggaggacaaggatgctgtggccttcacctgtgaacctgagactcaggacacaacctacctgtggtggataaacaatcagagcctcccggtcagtcccaggctgcagctgtccaatggcaacaggaccctcactctactcagtgtcacaaggaatgacacaggaccctatgagtgtgaaatacagaacccagtgagtgcgaaccgcagtgacccagtcaccttgaatgtcacctatggcccggacacccccaccatttccccttcagacacctattaccgtccaggggcaaacctcagcctctcctgctatgcagcctctaacccacctgcacagtactcctggcttatcaatggaacattccagcaaagcacacaagagctctttatccctaacatcactgtgaataatagtggatcctatacctgccacgccaataactcagtcactggctgcaacaggaccacagtcaagacgatcatagtcactgataatgctctaccacaagaaaatggcctctcacctggggccattgctggcattgtgattggagtagtggccctggttgctctgatagcagtagccctggcatgttttctgcatttcgggaagaccggcagctcaggaccactccaatgacccacctaacaagatgaatgaagttacttattctaccctgaactttgaagcccagcaacccacacaaccaacttcagcctccccatccctaacagccacagaaataatttattcagaagtaaaaaagcagtaatgaaacctgtcctgctc

SEQ ID NO: 4639 - DNA, 3958 bp, Homo sapiens
tgtataagtggagtgtgctggggtgtgtaaagtagtatggaggcagcggtagcccagtgtctgagtggttgccgggtctccatggagaagcggctcgccagtgtcccaggctgctgagctctcgccgcccgagaccccgcggcgcggccgcagggccatgctagccttgcgcgtggcgcgcggctcgtggggggccctgcgcggcgccgcttgggctccgggaacgcggccgagtaagcgacgcgcctgctgggccctgctgccgcccgtgccctgctgcttgggctgcctggccgaacgctggaggctgcgtccggccgctcttggcttgcggctgcccgggatcggccagcggaaccactgttcgggcgcggggaaggcggctcccaggccagcggccggagcgggcgccgctgccgaagccccgggcggccagtggggcccggcgagcacccccagcctgtatgaaaacccatggacaatcccgaatatgttgtcaatgacgagaattggcttggccccagttctgggctatttgattattgaagaagattttaatattgcactaggagtttttgctttagctggactaacagatttgttggatggatttattgctcgaaactgggccaatcaaagatcagctttgggaagtgctcttgatccacttgctgataaaatacttatcagtatcttatatgttagcttgacctatgcagatcttattccagttccacttacttacatgatcatttcgagagatgtaatgttgattgctgctgttttttatgtcagataccgaactcttccaacaccacgaacacttgccaagtatttcaatccttgctatgccactgctaggttaaaaccaacattcatcagcaaggtgaatacagcagtccagttaatcttggtggcagcttctttggcagctccagttttcaactatgctgacagcatttatcttcagatactatggtgttttacagctttcaccacagctgcatcagcttatagttactatcattatggccggaagactgttcaggtgataaaagactgatgaaagtcatccctcactgttagtaaggaagcagtatacatcaatgggaacagggcccatggaaatgtacaggagtttccctattttggtgttcagcttgaaaaaggacttgtcagaatcaactgtgtcatcaaaatttaagtaatgtgcattgaaaataaggttgatcatgggaatatgcagaatttccaatgtatttttaaatacaaataaaattgtaatttagaatttttaatcttaggtttcttgattaatttataagagatcaattattgtcagtcttttttgtatgttttttaaaaacatagtccagagcatgggcagaattgacacctctcttttaagtgaaatttggattgctcacaaagcactaggaaatgtcatggggttcaaatatatatcctacacaactgggcaatacatttttgtttgatttttaggtctgtgtatacattaacagttcatgtaattaatacctgatcatttgggataatgaaagtgaagttagttgtagatgaagtaaagttataaaagagattaaaaatgcggtaactttttaagataataatcatacagaaggtatgaagttcattttcggtagtcttccaacctctcaggtgcctaataatttatgtttgaggataacaggtaacaaagatagtcgagataggagaacgtgtctattagtctttgcatctaaaaggcagtgagttacgttcctgccttccactgtgtttctgacatagcaatgtttgtttgatattggaacctggattcatattttatgtaaataatatcaagctgtatatttttcaaaggttttttaaactttggagactctttcttttgttaagcagttaaaggaataaaagagctggaaaaaaaattgtaccttcaactcaggttgttccatataacatacgtattctctgctgttacgtaagttttccgattcacagagtccattcatgtacatcacttacacttaaattgtaaaaataattagtctgaccatctgactttaaaagactgttgctacacgtacatcatgtttaggagaatgtgggatatggggaaggggagaagaagacagtccagtggtgactagttgctgctgcttaacctatggcctattgctgcccattgtccctggttttaatccaagcctattatggaatactgcagtgagattatccattctcagcctgttgagctgcattaaattagaatgggaggctgtaagtaaaactcatgcctcttggccaggcattctgcaccagcgtgtccctctgtggcttgctggtcctggttgttctcagactggcagctgagctgcgcttggcttgaagcatactgaagcctgcagccagggacaccgccattgaatcagatggagggggatgaaaaagcagagaagggggcatgtggctggctattcttgctctctggagaacagcttcattgttaggagtagttaggctgaaagtggacttcccactgctgagccacccaagaggcacactgagcattagtgacgggtgagccacataagaataatgtttaaaaaagagaggacttgaagtagctatgcgaaaatttagaactttgcactttgttaacgcttatttatggtttagtgttgatgccatttggagtgacctatgggttggacccatatctttttattattaaggtctcaatctggctctggttaataaacgtttcccgcttcatcccttaggaaaatggtccaagtctcctcaggcttttggatactgaattgttataaaacacatcaattctgccagtttataaaacactggaattgtattagacatgtctgagtatgtacttgtttatagactcaaaacatgatgaaaattcatttcattgtcttcactgaatagacttaaccttgacagtaagcttaaagcattagtgtcatttaattacatgtctgaggaatttatgctaactagattttgggcttttgcagcgaattttagtcggggcctcattcctgagcccaagtgaccctttcacctcagcttcccaagtagctgggattacaggtgcacaccaactgtgctttgcagttttgtttgtgtgtgtgtgtgtgtgtgtgtgtgtgtgtgtgtgtgtgtgtattttgttttttttacaagcccacaacatcatagctttgcagtttttaaccaggagctggtggagatctttgaaatcatttaggccaattcttttagttacatttatgatgaaactagggatctaccttaaagttttgggaagctctttcaaaacttcagacacctagaaatatatatagtgcagttcagttttagtttctgcagcatggtttggaaacaaaagatacataggatttaaactcgatttgttttcttcttacagtagaagtaaatgctcttgtggcttgaatcgcatctcccaagaaagatacgttcacgttcaaacccccagtactgtacatgtgaccttatttggaaatagggtctttttagatgcagtcaagatagaattagatcatactggattacagtgggccccaataactaggtttttttgttaaaaaaaaaaaaaaaggaaatgtgaacagagagagaatgccgtgagatgatggagggatagattggaatgatgtctgcgagctaaggaatactgaggattgctgccaaccatccgaagctgggagaggagatggaacaactccctcggagcctccaagaggaaccaaccccactgatgctttgatttgggatttccggcctgaactgtaggaaaataaatttctgttcttttaagccatttttaccagtttgtggtaacttgttacagcagctgcaggaaattaataaatgccaatgttgaaaattaaaa

SEQ ID NO: 4640 - DNA, 3650 bp, Homo sapiens
agttgtacagcatgggttgaggtggccagatcctggcaggggtctcaactccactgatagctaaagcatgttggggtttgaatgctggatactttgaagttgccatatcctgactgaagtccttcccagaacggcagtagttggtcgagtatgccacagtatgaaaacccatggacaatcccgaatatgttgtcaatgacgagaattggcttggccccagttctgggctatttgattattgaagaagattttaatattgcactaggagtttttgctttagctggactaacagatttgttggatggatttattgctcgaaactgggccaatcaaagatcagctttgggaagtgctcttgatccacttgctgataaaatacttatcagtatcttatatgttagcttgacctatgcagatcttattccagttccacttacttacatgatcatttcgagagatgtaatgttgattgctgctgttttttatgtcagataccgaactcttccaacaccacgaacacttgccaagtatttcaatccttgctatgccactgctaggttaaaaccaacattcatcagcaaggtgaatacagcagtccagttaatcttggtggcagcttctttggcagctccagttttcaactatgctgacagcatttatcttcagatactatggtgttttacagctttcaccacagctgcatcagcttatagttactatcattatggccggaagactgttcaggtgataaaagactgatgaaagtcatccctcactgttagtaaggaagcagtatacatcaatgggaacagggcccatggaaatgtacaggagtttccctattttggtgttcagcttgaaaaaggacttgtcagaatcaactgtgtcatcaaaatttaagtaatgtgcattgaaaataaggttgatcatgggaatatgcagaatttccaatgtatttttaaatacaaataaaattgtaatttagaatttttaatcttaggtttcttgattaatttataagagatcaattattgtcagtcttttttgtatgttttttaaaaacatagtccagagcatgggcagaattgacacctctcttttaagtgaaatttggattgctcacaaagcactaggaaatgtcatggggttcaaatatatatcctacacaactgggcaatacatttttgtttgatttttaggtctgtgtatacattaacagttcatgtaattaatacctgatcatttgggataatgaaagtgaagttagttgtagatgaagtaaagttataaaagagattaaaaatgcggtaactttttaagataataatcatacagaaggtatgaagttcattttcggtagtcttccaacctctcaggtgcctaataatttatgtttgaggataacaggtaacaaagatagtcgagataggagaacgtgtctattagtctttgcatctaaaaggcagtgagttacgttcctgccttccactgtgtttctgacatagcaatgtttgtttgatattggaacctggattcatattttatgtaaataatatcaagctgtatatttttcaaaggttttttaaactttggagactctttcttttgttaagcagttaaaggaataaaagagctggaaaaaaaattgtaccttcaactcaggttgttccatataacatacgtattctctgctgttacgtaagttttccgattcacagagtccattcatgtacatcacttacacttaaattgtaaaaataattagtctgaccatctgactttaaaagactgttgctacacgtacatcatgtttaggagaatgtgggatatggggaaggggagaagaagacagtccagtggtgactagttgctgctgcttaacctatggcctattgctgcccattgtccctggttttaatccaagcctattatggaatactgcagtgagattatccattctcagcctgttgagctgcattaaattagaatgggaggctgtaagtaaaactcatgcctcttggccaggcattctgcaccagcgtgtccctctgtggcttgctggtcctggttgttctcagactggcagctgagctgcgcttggcttgaagcatactgaagcctgcagccagggacaccgccattgaatcagatggagggggatgaaaaagcagagaagggggcatgtggctggctattcttgctctctggagaacagcttcattgttaggagtagttaggctgaaagtggacttcccactgctgagccacccaagaggcacactgagcattagtgacgggtgagccacataagaataatgtttaaaaaagagaggacttgaagtagctatgcgaaaatttagaactttgcactttgttaacgcttatttatggtttagtgttgatgccatttggagtgacctatgggttggacccatatctttttattattaaggtctcaatctggctctggttaataaacgtttcccgcttcatcccttaggaaaatggtccaagtctcctcaggcttttggatactgaattgttataaaacacatcaattctgccagtttataaaacactggaattgtattagacatgtctgagtatgtacttgtttatagactcaaaacatgatgaaaattcatttcattgtcttcactgaatagacttaaccttgacagtaagcttaaagcattagtgtcatttaattacatgtctgaggaatttatgctaactagattttgggcttttgcagcgaattttagtcggggcctcattcctgagcccaagtgaccctttcacctcagcttcccaagtagctgggattacaggtgcacaccaactgtgctttgcagttttgtttgtgtgtgtgtgtgtgtgtgtgtgtgtgtgtgtgtgtgtgtgtattttgttttttttacaagcccacaacatcatagctttgcagtttttaaccaggagctggtggagatctttgaaatcatttaggccaattcttttagttacatttatgatgaaactagggatctaccttaaagttttgggaagctctttcaaaacttcagacacctagaaatatatatagtgcagttcagttttagtttctgcagcatggtttggaaacaaaagatacataggatttaaactcgatttgttttcttcttacagtagaagtaaatgctcttgtggcttgaatcgcatctcccaagaaagatacgttcacgttcaaacccccagtactgtacatgtgaccttatttggaaatagggtctttttagatgcagtcaagatagaattagatcatactggattacagtgggccccaataactaggtttttttgttaaaaaaaaaaaaaaaggaaatgtgaacagagagagaatgccgtgagatgatggagggatagattggaatgatgtctgcgagctaaggaatactgaggattgctgccaaccatccgaagctgggagaggagatggaacaactccctcggagcctccaagaggaaccaaccccactgatgctttgatttgggatttccggcctgaactgtaggaaaataaatttctgttcttttaagccatttttaccagtttgtggtaacttgttacagcagctgcaggaaattaataaatgccaatgttgaaaatt

SEQ ID NO: 4641 - DNA, 1150 bp, Homo sapiens
ctgagtggttgccgggtctccatggagaagcggctcgccagtgtcccaggctgctgagctctcgccgcccgagaccccgcggcgcggccgcagggccatgctagccttgcgcgtggcgcgcggctcgtggggggccctgcgcggcgccgcttgggctccgggaacgcggccgagtaagcgacgcgcctgctgggccctgctgccgcccgtgccctgctgcttgggctgcctggccgaacgctggaggctgcgtccggccgctcttggcttgcggctgcccgggatcggccagcggaaccactgttcgggcgcggggaaggcggctcccaggccagcggccggagcgggcgccgctgccgaagccccgggcggccagtggggcccggcgagcacccccagcctgtatgaaaacccatggacaatcccgaatatgttgtcaatgacgagaattggcttggccccagttctgggctatttgattattgaagaagattttaatattgcactaggagtttttgctttagctggactaacagatttgttggatggatttattgctcgaaactgggccaatcaaagatcagctttgggaagtgctcttgatccacttgctgataaaatacttatcagtatcttatatgttagcttgacctatgcagatcttattccagcgaacacttgccaagtatttcaatccttgctatgccactgctaggttaaaaccaacattcatcagcaaggtgaatacagcagtccagttaatcttggtggcagcttctttggcagctccagttttcaactatgctgacagcatttatcttcagatactatggtgttttacagctttcaccacagctgcatcagcttatagttactatcattatggccggaagactgttcaggtgataaaagactgatgaaagtcatccctcactgttagtaaggaagcagtatacatcaatgggaacagggcccatggaaatgtacaggagtttccctattttggtgttcagcttgaaaaaggacttgtcagaatcaactgtgtcatcaaaatttaagtaatgtgcattgaaaataaggttgatcatgggaatatgcagaatttccaatgtatttttaaatacaaataaaattgtaatttagaattttt

SEQ ID NO: 4642 - DNA, 12847 bp, Homo sapiens
ctccggccccggcccaggcccgggagaggcgatggcgagccgcgatagcaaccacgctggcgagagctttctcggctccgacggggacgaggaggcgacccgggagctggagaccgaggaggagtcggagggcgaggaggacgagacggcggcggagtcggaggaggagccggactccaggttatcagaccaggatgaagagggaaagatcaagcaggagtatatcatatctgacccctccttttccatggtgacagtccaaagggaagatagtgggataacctgggaaaccaattcaagtagatcttctactccttgggcttcagaagaaagtcagacttctggtgtgtgtagtcgggaagggtcaactgtgaattctcctcctggaaatgtttcctttattgtggatgaagtgaaaaaggttcggaaaaggactcataagtcaaagcatggttcaccatcattacgccggaaaggcaacagaaaaagaaattcttttgaatcccaagatgttccaacaaacaaaaaaggcagtcctttaacttcagcaagccaggtactaaccacggagaaagagaagtcatatactggcatttatgataaagcaagaaaaaagaagaccacttcaaatacacctccgattactggggcaatatacaaagaacacaagccattagtgttaagaccagtctacataggaacagtacaatataaaattaagatgtttaattcggttaaagaagaattaattcctctacaattttatggaacattgccaaagggttatgtaattaaagaaatacattataggaaagggaaagatgcatccattagtctagagccagatttggacaatagtggttctaatacagtgtccaaaacacgcaaattagtagcccaaagcatagaggataaagtaaaagaggtttttccaccctggagaggcgcactctccaaaggatcagagtccctaaccttaatgttcagtcatgaagatcaaaagaaaatttatgctgattctcccctaaatgccacatctgcattggagcacacagttccctcttattcaagtagtggcagagcagaacaaggaatacagctcaggcattcacagtcagtgccacaacagccagaagatgaagcaaaaccacatgaagtggaacctccatctgtgacacccgacacacctgcaactatgttcctgagaacaacaaaggaagaatgtgagcttgcttcaccaggaactgcagcttcagagaatgactcttcagtctcaccatcatttgctaatgaggtaaagaaggaagatgtgtattctgctcaccattccatttctctggaggcagcgtcaccaggtctggcagcatctacccaggatggtttggacccagaccaagaacagccggacctgacttcaatagaaagggcagaaccagtctccgcaaaactgacccctacccatcccagtgtcaaaggagagaaggaggaaaacatgcttgagccatccatttctctttctgaacctctaatgttagaagaaccagagaaagaagaaatagaaacttccctacccatagctattacccctgaacctgaagattctaatttagtagaagaagagatcgtagaacttgattacccagaaagcccattggtttccgagaagcccttcccaccacatatgtcccctgaagtggagcacaaagaagaagagcttattctaccattattggcagcatcatctcctgaacatgttgctttgtctgaggaagaaagagaggaaattgcatctgtttctactggttctgcttttgtatcagagtattcagtaccacaggatttgaaccatgaattacaggagcaagaaggtgagccagttcccccatccaatgtagaagctatagctgaacatgcagttttgtcagaagaagagaatgaggaatttgaggcttattccccagctgcagcccctacatctgagagctctctctcaccatccacaactgagaagacttcagagaaccagtctccactgttttcaacagttacaccagaatacatggtcctatcaggagacgaggcctcagaaagtgggtgttacacaccagactccacatctgcttctgaatattcagttccatcactggcaacaaaagagtcactgaagaaaacaattgaccgtaagtccccgttaatattgaaaggtgtttctgagtacatgattccatcagaagagaaggaagacactggatcgtttactccagctgtggcccctgcttctgagccctctctctcaccatccacaaccgaaaagacttctgaatgccagtcaccactgccttctactgccacatcagaacacgtggtcccatcagaaggagaggacctaggaagtgaacgtttcacaccggattcaaagttgatctccaaatatgcagccccactcaatgcaacacaggaatctcaaaagaaaataatcaatgaggcatcccaattcaaaccaaaaggtatttctgagcacacagttctgtcagtagacggcaaggaggtcattggaccatcttccccagatttggttgttgcatctgaacactctttcccaccacacacaaccgagatgacttctgaatgccaggccccaccactttcagccaccccatctgaatatgttgttctatcagacgaagaggcagtcgagttggaacgatacacaccctcttctacatctgcttctgaattttcagtaccaccatatgcaacaccggaggcacaggaggaagaaattgtccatagatctctaaatctaaaaggtgcatcctcacccatgaatttatcagaagaagatcaagaagacattggacctttttctccagattctgcatttgtgtcagaattctcatttccaccgtatgcaacccaggaagcagagaaaagagaatttgagtgcgattctccaatatgtttaacatcaccatctgagcacactattttgtcagatgaagacactgaagaagcggaactgttctctccagactcagcatcacaagtttcaatccctccctttagaatctcagaaacagagaaaaatgaacttgagcctgattcactattaactgcagtgtctgcttcaggttattcctgcttttcagaagcagatgaggaagacattggatccacagctgctacacctgtatctgagcagttcagttcatcacagaagcaaaaagctgaaactttccctttgatgtctccgcttgaagacttaagtctgccgccttcaacagataaatcagagaaagcagaaattaagccagagattccaacaacctcaacatctgtatctgaatatctcattttggcacagaagcagaaaactcaagcatatttagagcctgagtctgaagacttgattccttcacatttaaccagtgaagtggagaagggagaaagggaggcaagttcatcagtagctgcaatacctgctgctttacctgcacaatcatctatagtaaaggaagaaaccaaacctgcatctccacattcagttttacctgattcagtccctgcaatcaagaaagaacaggaacccacagcagcactcactctaaaagctgcagatgaacagatggctttgtcaaaagtcagaaaggaagaaattgtgcctgattctcaagaagctacagcacatgtatcacaggatcaaaaaatggagcctcagcctccaaatgttccagagtctgagatgaaatattcagttttgcctgacatggtagatgagccaaagaagggtgtcaagcccaaattagttctaaatgtgacttctgaactagaacagagaaagttgtccaagaatgagcctgaagtaataaaaccatattcacctctaaaggaaacatctttatctggacctgaggctttatcagcagtgaaaatggagatgaaacatgattccaaaataacaactacacctatagtgcttcattcagcttcctcaggagtggaaaagcaagttgaacatggtccacctgcactagcattttcagctttgtcagaagaaattaaaaaagaaattgaacccagttcctcaacaactacagcatctgtaactaagcttgattcaaacttaaccagagcagtaaaagaagaaatcccaacagattcatctcttatcactcctgtagatcgtccagtcttaacaaaagtaggaaagggtgaattaggaagtggtttgccaccactggtaacatctgcagatgaacattcagttcttgcagaagaagacaaggtggcaattaaaggtgcttctcccattgaaacttcatccaaacatttagcttggtcagaagcagagaaggaaattaaatttgattcacttccaagtgtctcctctatagcagagcattctgttttgtcagaagtagaagccaaagaagttaaagctgggttgccagtaatcaaaacatcatcttctcagcattcagataaatctgaggaagcaagggtagaagacaaacaagatcttttattttctacagtctgtgactctgaacgtttggtttcatcacagaagaagagcttgatgtctacctcagaggtgttagagcctgaacatgagcttccactcagcctatggggtgagataaagaagaaagaaactgaacttccttcatcacaaaatgtgtcacctgcatccaaacatataatcccaaaaggcaaagatgaggaaacagcaagttcatctcctgagttggaaaatttagcatcaggtttagccccaacattactgctcctcagtgatgataagaacaaaccggcagtggaggtatcttctacagctcagggagacttcccatcagaaaaacaagatgttgctttggcagagctgtctttggaacctgagaagaaagacaagccacaccaaccgttggaattaccaaatgctgggtcagaattttctagtgatttaggtagacaaagtggatccataggtacaaaacaagcaaagtctcccataactgaaacagaggattctgttttagaaaaaggcccagctgagcttaggagcagagaaggaaaagaagaaaatagagagctttgtgcatcttctacgatgcctgcaatttcagagctttcatcattgcttagggaggaatctcagaatgaagaaattaaacctttctctcccaagatcatcagcctagagtcgaaagaaccacctgcctctgtagctgaaggaggcaacccagaagaatttcagccatttactttttctttaaaaggattatcagaggaggttagccatccagccgactttaaaaagggaggaaatcaagaaataggcccattaccaccaactggaaatttgaaggcacaagtcatgggagatattttagataagctaagtgaagaaacaggccacccaaattcatcccaggtactccagagtataacagaaccatcaaagattgctccttctgacctccttgtagaacaaaaaaagacagaaaaagcacttcattcagatcaaactgttaaattacctgatgtaagcacctcttctgaagataaacaagatctgggtattaagcagttttcacttatgagagagaatttgcctttggaacaatcaaaatcatttatgacaaccaagcctgcggatgtcaaagaaacaaaaatggaagaattctttatttctccaaaggatgaaaactggatgttgggaaagccagaaaatgtggctagtcaacacgaacagagaatagcaggatctgtgcagctggattcctctagcagcaatgagctgaggccagggcagctcaaggctgctgtgtccagtaaggaccatacatgtgaagtgagaaagcaggtcctgccgcattctgctgaagaatctcatttgtcatcacaagaagcagtatctgctcttgatacttccagtggtaatacagagaccttatcaagtaaaagttactcttctgaagaagtaaagctggctgaagaaccaaagtctttagtcctagctggaaatgtagagagaaacatagcagaggggaaggagattcattctttgatggagagtgaaagtttgctattggagaaagcaaacacagagctttcctggccttccaaagaagatagccaggaaaaaattaaactacctcctgaaagattcttccagaaaccagtgtctggcctatcagtggaacaggtgaagtcagaaacaatctcctcttctgtcaaaacagcccatttcccggcagaaggtgtggaacctgcattgggcaatgaaaaagaagcacacaggagcacacctccttttcctgaagagaagccattggaagaatcaaaaatggttcagtcaaaggttattgatgatgctgatgagggaaagaaaccatcacctgaagtaaaaatacccacacaaagaaaacccatctcctcaatccatgcaagagagcctcaatccccagagtcacctgaggtgacacaaaatccacctacacaaccaaaggtggctaagccggaccttcctgaggaaaagggaaagaaaggaatttcatctttcaaatcgtggatgtccagcttgttttttggatcgagcactccagataacaaagttgctgaacaagaagacttagaaacacagccaagtccatccgtagaaaaagcagtgactgtgatagatcctgaaggtacaattcccaccaattttaatgtagctgagaaaccagctgatcattcattatcagaggtaaaacttaaaactgctgatgaacccagaggtactttagtaaaatctggtgacggtcaaaacgttaaagaaaaatccatgattttatcaaatgtagaagatttacaacagccaaaattcatttctgaggtgtctagggaagattatggaaaaaaagaaatctcaggcgattcagaggaaatgaacataaactcagtagttacttctgctgatggtgagaaccttgaaattcaatcttattcactaatcggtgagaaattggttatggaagaagccaaaactattgttcctcctcatgttactgatagtaaaagagtccagaagccagcaatcgctcctccatctaaatggaatatttctatttttaaggaagagccaagaagtgatcaaaaacaaaaatcactcctttcatttgatgtagtagataaggtgccacaacagccaaaatcagcttcctccaactttgcaagtaaaaatatcacaaaggaatcagagaaaccagagtcaattattttgccagtagaagaatcaaaaggcagtttaattgatttcagtgaagacagactcaagaaagaaatgcaaaatcctacttccttgaaaatttctgaagaggaaacaaaactcaggtctgttagtccaactgagaagaaagataatttggaaaacagatcatataccttggcagaaaagaaggtgctggcagaaaaacaaaactctgtggccccattagagcttagagatagtaatgaaatagggaagacacaaattacacttggatctagatctactgaactgaaagaatcaaaagccgatgctatgccacagcacttctatcaaaatgaagactacaatgaaagacccaaaatcattgttggttctgaaaaggagaaaggtgaagaaaaagaaaatcaggtatatgtgctttcagaaggaaagaagcagcaggaacatcagccttattctgtgaatgtagccgagtctatgagtagagaatcagatatctctttaggtcattctttgggtgaaactcaatcattttcattagttaaagctacatcagttactgaaaaatcagaagccatgctcgcagaggctcacccagaaatcagagaagcaaaggcagtaggaacccaaccacatcctttagaagaaagtaaagttttggtggagaaaaccaagactttcctgccggtggctctttcttgtcgtgatgaaatagagaaccactctttatctcaggaaggaaatctagtattagaaaagtcaagcagagatatgccagatcacagtgaagaaaaagaacagttcagagagtcagagctatcgaaaggcggttcagtagatatcacaaaagaaactgtgaaacaaggatttcaagaaaaggcagtaggaacccaaccacgtcctttagaagaaagtaaagttttggtggagaaaactaagactttcctgccagtggttctttcttgtcatgatgaaatagagaaccactctttgtctcaggaaggaaatctagtgttagaaaagtcaagcagagatatgccagatcacagtgaagaaaaagaacagttcaaagagtcagagctatggaaaggtggttcagtagatatcacaaaagaaagtatgaaagaaggatttccatctaaagaatccgaaaggactttagctcgtccttttgatgaaactaagagctcagaaacaccgccatatttgctgtcacctgtaaaaccacaaactcttgcttcaggagcttctccagaaattaacgcagtgaagaaaaaagaaatgccacgatcagaattgactccagaaaggcatacagttcatactattcagacatctaaagatgacacatccgatgtgcctaaacaatctgttcttgtttcaaagcaccacttggaggctgcggaagatacccgtgtaaaggaaccactgtcttcagcaaaaagcaactatgctcaatttatatctaatacatcagcaagcaatgctgataaaatggtttctaataaagaaatgcccaaggaacctgaagacacatatgcaaaaggtgaagactttacagtgactagtaagccagccggactttcagaagatcagaagactgcctttagtatcatttctgaaggctgtgagatattgaatattcatgctccggcctttatttcttcaatcgatcaggaagaaagtgaacaaatgcaagataaattagaatatttggaagagaaagcctcatttaaaaccataccactccctgatgatagtgaaacagttgcttgtcataaaacattaaagagcaggttagaagatgaaaaagttaccccattgaaagaaaataaacaaaaggaaactcataagacaaaagaagagatatccacagattcagaaactgatttatcatttattcagcccacaattcccagtgaagaggattattttgaaaaatatactttgattgattataacatctccccagacccagaaaaacagaaagctccacagaaattaaatgttgaagagaaactctcaaaggaagttacagaagaaactatctctttcccagtaagttcagtggaaagtgcactagaacatgaatatgacttggtgaaattagatgaaagtttttatggaccagaaaagggccacaacatattatctcatccagagacccaaagccaaaactcagctgacaggaatgtttcaaaggacacaaagagagatgtggactcaaagtcaccggggatgcctttatttgaagcagaggaaggagttctatcacgaacccagatatttcctaccactattaaagtcattgatccagaatttctggaggagccacctgcacttgcatttttatataaggatctgtatgaagaagcagttggagagaaaaagaaggaagaggagacagcttctgaaggtgacagtgtgaattctgaggcatcatttcccagcagaaattctgacactgatgatggaacaggaatatattttgagaagtacatactcaaagatgacattctccatgacacatctctaactcaaaaggaccagggccaaggtctggaagaaaaacgagttggtaaggatgattcataccaaccgatagctgcagaaggggaaatttggggaaagtttggaactatttgcagggagaagagtctggaagaacagaaaggtgtttatggggaaggagaatcagtagaccatgtggagaccgttggtaacgtagcgatgcagaagaaagctcccatcacagaggacgtcagagtggctacccagaaaataagttatgcggttccatttgaagacacccatcatgttctggagcgtgcagatgaagcaggcagtcacggtaatgaagtcggaaatgcaagtccagaggtcaatctgaatgtcccagtacaagtgtccttcccggaggaagaatttgcatctggtgcaactcatgttcaagaaacatcactagaagaacctaaaatcctggtcccacctgagccaagtgaagagaggctccgtaatagccctgttcaggatgagtatgaatttacagaatccctgcataatgaagtggttcctcaagacatattatcagaagaactgtcttcagaatccacacctgaagatgtcttatctcaaggaaaggaatcctttgagcacatcagtgaaaatgaatttgcgagtgaggcagaacaaagtacacctgctgaacaaaaagagttgggcagcgagaggaaagaagaagaccaattatcatctgaggtagtaactgaaaaggcacaaaaagagctgaaaaagtcccagattgacacatactgttacacctgcaaatgtccaatttctgccactgacaaggtgtttggcacccacaaagaccatgaagtttcaacgcttgacacagctataagtgctgtaaaggttcaattagcagaatttctagaaaatttacaagaaaagtccttgaggattgaagcctttgttagtgagatagaatccttttttaataccattgaggaaaactgtagtaaaaatgagaaaaggctagaagaacagaatgaggaaatgatgaagaaggttttagcacagtatgatgagaaagcccagagctttgaggaagtgaagaagaagaagatggagttcctgcatgagcagatggtccactttctgcagagcatggacactgccaaagacaccctggagaccatcgtgagagaagcagaggagcttgatgaggccgtcttcctgacttcgtttgaggaaatcaatgaaaggttgctttctgcaatggagagcactgcttctttagagaaaatgcctgctgcgttttcccttttcgaacattatgatgacagctcggcaagaagtgaccagatgttaaaacaagtggctgttccacagcctcctagattagaacctcaggaaccaaattctgccaccagcacaacaattgcagtttactggagcatgaacaaggaagatgtcattgattcatttcaggtttactgcatggaggagccacaagatgatcaagaagtaaatgagttggtagaagaatacagactgacagtgaaagaaagctactgcatttttgaagatctggaacctgaccgatgctatcaagtgtgggtgatggctgtgaacttcactggatgtagcctgcccagtgaaagggccatctttaggacagcaccctccacccctgtgatccgcgctgaggactgtactgtgtgttggaacacagccactatccgatggcggcccaccaccccagaggccacggagacctacactctggagtactgcagacagcactctcctgagggagagggcctcagatctttctctggaatcaaaggactccagctgaaagttaacctccaacccaatgataactactttttctatgtgagggccatcaatgcatttgggacaagtgaacagagtgaagctgctctcatctccaccagaggaaccagatttctcttgttgagagaaacagctcatcctgctctacacatttcctcaagtgggacagtgatcagctttggtgagaggagacggctgacggaaatcccgtcagtgctgggtgaggagctgccttcctgtggccagcattactgggaaaccacagtcacagactgcccagcatatcgactcggcatctgctccagctcggctgtgcaggcaggtgccctaggacaaggggagacctcatggtacatgcactgctctgagccacagagatacacatttttctacagtggtattgtgagtgatgttcatgtgactgagcgtccagccagagtgggcatcctgctggactacaacaaccagagacttatcttcatcaacgcagagagcgagcagttgctcttcatcatcaggcacaggtttaatgagggtgtccaccctgcctttgccctggagaaacctggaaaatgtactttgcacctggggatagagcccccggattctgtaaggcacaagtgatccttggctttcagaatttgcaagaacagcgatttgaattttgggggggtctgctgttcattcctttaggtgctatacattattcaaaaagtctcccgcgcatttgcactaatgatggctgcatgcatagcaatcagcatgtgagcaaaatcgacaagaaaaccttgactttacagagcagtgtgtgagtaaacagaatgaaaacaacaacctccactctttagtttatataagtttgagttctttcctaaattaaaagatctacacttgagttgggaaccgaaagagaaaaatggacttccatctgttttactggtaaaggaaatcctctgatggacaggtcagagtgaaggaaggttgtgctggtaagacatctctgacgaagagccatggatgctttccacaaaatgtcacctcgctgcactaaaggatgatgaatcctaatcattaaaggaattgtttcagctgatttaaatttataatgaactcttttgtaataatgtatactgtagaacatgagtctctcctccctaaaattttaaatgtagaaatgtgctatatattagaaatttccattttgttaaataaatggttagagtctataaa

SEQ ID NO: 4643 - DNA, 1844 bp, Homo sapiens
acacgtcagaaaaaaaaaaaaaaagtttgcagaatgtcccacaccgaaaaaaaaaaaaaatccgaaaccgagcgaaaaaaacctgcgagtgggcctggcggatgggattattaaagcttcgccggagccgcggctcgccctcccactccgccagcctccgggagaggagccgcacccggccggcccggccccagccccatggacctccgagcaggggactcgtgggggatgttagcgtgcctgtgcacggtgctctggcacctccctgcagtgccagctctcaatcgcacaggggacccagggcctggcccctccatccagaaaacctatgacctcacccgctacctggagcaccaactccgcagcttggctgggacctatctgaactacctgggcccccctttcaacgagccagacttcaaccctccccgcctgggggcagagactctgcccagggccactgttgacttggaggtgtggcgaagcctcaatgacaaactgcggctgacccagaactacgaggcctacagccaccttctgtgttacttgcgtggcctcaaccgtcaggctgccactgctgagctgcgccgcagcctggcccacttctgcaccagcctccagggcctgctgggcagcattgcgggcgtcatggcagctctgggctacccactgccccagccgctgcctgggactgaacccacttggactcctggccctgcccacagtgacttcctccagaagatggacgacttctggctgctgaaggagctgcagacctggctgtggcgctcggccaaggacttcaaccggctcaagaagaagatgcagcctccagcagctgcagtcaccctgcacctgggggctcatggcttctgacttctgaccttctcctcttcgctcccccttcaaaccctgctcccactttgtgagagccagccctgtatgccaacacctgttgagccaggagacagaagctgtgagcctctggccctttcctggaccggctgggcgtgtgatgcgatcagccctgtctcctccccacctcccaaaggtctaccgagctggggaggaggtacagtaggccctgtcctgtcctgtttctacaggaagtcatgctcgagggagtgtgaagtggttcaggttggtgcagaggcgctcatggcctcctgcttcttgcctaccacttggccagtgcccacccagcccctcaggtggcacatctggagggcaggggttgaggggccaccaccacacatgcctttctggggtgaagccctttggctgccccactctccttggatgggtgttgctcccttatccccaaatcactctatacatccaattcaggaaacaaacatggtggcaattctacacaaaaagagatgagattaacagtgcagggttggggtctgcattggaggtgccctataaaccagaagagaaaatactgaaagcacaggggcagggacagaccagaccagacccaggagtctccaaagcacagagtggcaaacaaaacccgagctgagcatcaggaccttgcctcgaattgtcttccagtattacggtgcctcttctctgccccctttcccagggtatctgtgggttgccaggctggggagggcaaccatagccacaccacaggatttcctgaaagtttacaatgcagtagcattttggggtgtagggtggcagctccccaaggccctgccccccagccccacccactcatgactctaagtgtgttgtattaatatttatttatttggagatgttatttattagatgatatttattgcagaatttctattcttgtattaacaaataaaatgcttgccccagaa

SEQ ID NO: 4644 - DNA, 781 bp, Homo sapiens
cctgcccacaggggactcgtgggggatgttagcgtgcctgtgcacggtgctctggcacctccctgcagtgccagctctcaatcgcacaggggacccagggcctggcccctccatccagaaaacctatgacctcacccgctacctggagcaccaactccgcagcttggctgggacctatctgaactacctgggcccccctttcaacgagccagacttcaaccctccccgcctgggggcagagactctgcccagggccactgttgacttggaggtgtggcgaagcctcaatgacaaactgcggctgacccagaactacgaggcctacagccaccttctgtgttacttgcgtggcctcaaccgtcaggctgccactgctgagctgcgccgcagcctggcccacttctgcaccagcctccagggcctgctgggcagcattgcgggcgtcatggcagctctgggctacccactgccccagccgctgcctgggactgaacccacttggactcctggccctgcccacagtgacttcctccagaagatggacgacttctggctgctgaaggagctgcagacctggctgtggcgctcggccaaggacttcaaccggctcaagaagaagatgcagcctccagcagctgcagtcaccctgcacctgggggctcatggcttctgacttctgaccttctcctcttcgctcccccttcaaaccctgctcccactttgtgagagccagccctgtatgccaacacctgttgagccaggagacagaagctgtgagcct

SEQ ID NO: 4645 - DNA, 967 bp, Homo sapiens
acttgctcccaggccagctcgctggcatttgggagaatgtgtcattgcatttactcaagggggaggaggagggaaggttagagatgaggaggcagaggtagggtgggagcagggacctcgcacaggcagaggggactcgtgggggatgttagcgtgcctgtgcacggtgctctggcacctccctgcagtgccagctctcaatcgcacaggggacccagggcctggcccctccatccagaaaacctatgacctcacccgctacctggagcaccaactccgcagcttggctgggacctatctgaactacctgggcccccctttcaacgagccagacttcaaccctccccgcctgggggcagagactctgcccagggccactgttgacttggaggtgtggcgaagcctcaatgacaaactgcggctgacccagaactacgaggcctacagccaccttctgtgttacttgcgtggcctcaaccgtcaggctgccactgctgagctgcgccgcagcctggcccacttctgcaccagcctccagggcctgctgggcagcattgcgggcgtcatggcagctctgggctacccactgccccagccgctgcctgggactgaacccacttggactcctggccctgcccacagtgacttcctccagaagatggacgacttctggctgctgaaggagctgcagacctggctgtggcgctcggccaaggacttcaaccggctcaagaagaagatgcagcctccagcagctgcagtcaccctgcacctgggggctcatggcttctgacttctgaccttctcctcttcgctcccccttcaaaccctgctcccactttgtgagagccagccctgtatgccaacacctgttgagccaggagacagaagctgtgagcctctggccctttcctggaccggctgggcgtgtgatgcgatcagccctgtctcctccccacctcccaaa

SEQ ID NO: 4646 - DNA, 2763 bp, Homo sapiens
atcgatgccccgtccccgccccacagccaacctcccgggcaccgttgcccgcccggggcccgctaccggcccaggccccgcctcgcgagtcctcctccccgggtgccttcccgcagcccgctcggcccagagggtgggcgcggggctgcctctaccggctggcggctgtaactcagcgaccttggcccgaaggctctagcaaggacccaccgaccccagccgcggcggcggcggcgcggactttgcccggtgtgtggggcggagcggactgcgtgtccgcggacgggcagcgaagatgttagccttcgctgccaggaccgtggtgaagcctctgggcttcctgaagcccttctccttgatgaaggcttccagccgcttcaaggcacaccaggatgcactgccacggctgcccgtgccccctctccagcagtccctggaccactacctgaaggcgctgcagcccatcgtgagtgaggaggagtgggcccacaccaagcagctggtggatgagtttcaggcctcaggaggtgtaggggagcgcctgcagaaggggctggagcgtcgggccaggaagacggagaactggctgtctgagtggtggctcaagaccgcctacctccagtaccgccagcctgtggtcatctactcgagcccaggcgtgatgctacccaagcaggacttcgtggacctgcagggtcagctccgatttgctgccaaactcattgagggtgtgttggatttcaaggtcatgattgacaacgagaccctgcccgtggagtacctgggggggaagccactgtgcatgaaccagtactatcagatcttgtcctcctgccgagtgccgggccccaagcaggacacagtcagcaacttcagcaagaccaagaagcctcccacgcacatcaccgtggtacacaactaccagttttttgagctggatgtgtaccacagtgacgggacacccctcactgcggatcagatctttgtgcagctggagaagatctggaactcatccctacagaccaacaaggagcctgtgggcatcctcacctccaaccaccgcaactcctgggccaaggcatacaacaccctcatcaaagacaaggtgaaccgggattccgtgcgctccatccagaagagcatcttcaccgtgtgcctagatgcaaccatgcccagggtctcagaagacgtgtaccgcagccacgtggcaggccagatgctgcatgggggcggcagcaggctcaacagcggcaaccgctggttcgacaagacgctgcagttcatcgtggcagaagatggctcctgtgggcttgtgtacgagcatgctgcagcggaggggccccctattgtcacccttctggactatgtcatcgagtacacgaagaaacccgagcttgtgcggtctcccctggtgcccctgcccatgcccaagaagctgcggttcaacatcacccccgagatcaagagcgacatcgagaaggccaagcagaacctcagcatcatgatccaggacctggatatcaccgtgatggtgttccaccattttggaaaagacttccccaagtcggagaagctaagcccagatgccttcatccagatggctttgcagctggcctactacaggatctacggacaggcatgtgccacctatgaaagtgcctccctgcgcatgtttcacctgggccgcaccgacaccatccgctcggcttccatggactcactcacctttgtcaaggccatggatgactccagcgtcacggagcaccagaaggtggagctgctgcggaaggccgtgcaggcccaccgaggctacaccgaccgggccatccgcggggaggcctttgatcgacacctgctgggcctgaagctgcaggccatcgaggacctggtgagcatgcccgacatcttcatggacacctcctacgccatcgccatgcacttccacctctccaccagccaggtccctgccaagacagactgtgtcatgttcttcgggcccgtggtccccgacggctacggtgtctgctataaccccatggaggcccacatcaacttctccctgtcggcctacaacagctgcgcggagaccaacgccgcccgcctggcgcattacctggagaaggcgctcctggacatgcgtgccctgctgcagagccacccccgggccaagctctgagcccctaggactcaggcctgccaatgccacagccaagcccaccctgggatgggccacccaccagggctcagctccttggttccctcttccttggttccctcttccctggtccccccaaatctactgagccacggaccgcatcctccagggggcctgcaggccccagccaagtgccttccgtgggtcatcccagcacctgccagggcccgacctggggctgagtgcagaggctgagcaggacgttaggcccgggcccctggcacgtcctccaccggtgcctcctctggggaagggaaccagccctccagagcaggagactggcaagagctctttgtctcaccagctcagccccggccactccctgccaactccatgaccaggccaccatctgtaccctgcttcccaaactcccaggacctggagacaggattgtctggggccgaggggccagggtgtgaggtttcacctccgttgcggctgtgctcctgtggataacattgctagcgagccgcctctggttccactcagcttggttcctgcccccgccctgctgtatgatattaatgtggaaggtcatcaataaaggg

SEQ ID NO: 4647 - DNA, 2523 bp, Homo sapiens
ccccgccccacagccaacctcccgggcaccgttgcccgcccggggcccgctaccggcccaggccccgcctcgcgagtcctcctccccgggtgccttcccgcagcccgctcggcccagagggtgggcgcggggctgcctctaccggctggcggctgtaactcagcgaccttggcccgaaggctctagcaaggacccaccgaccccagccgcggcggcggcggcgcggactttgcccggtgtgtggggcggagcggactgcgtgtccgcggacgggcagcgaagatgttagccttcgctgccaggaccgtggtgaagcctctgggcttcctgaagcccttctccttgatgaaggcttccagccgcttcaaggcacaccaggatgcactgccacggctgcccgtgccccctctccagcagtccctggaccactacctgaaggcgctgcagcccatcgtgagtgaggaggagtgggcccacaccaagcagctggtggatgagtttcaggcctcaggaggtgtaggggagcgcctgcagaaggggctggagcgtcgggccaggaagacggagaactggctgtctgagtggtggctcaagaccgcctacctccagtaccgccagcctgtggtcatctactcgagcccaggcgtgatgctacccaagcaggacttcgtggacctgcagggtcagctccgatttgctgccaaactcattgagggtgtgttggatttcaaggtcatgattgacaacgagaccctgcccgtggagtacctgggggggaagccactgtgcatgaaccagtactatcagatcttgtcctcctgccgagtgccgggccccaagcaggacacagtcagcaacttcagcaagaccaagaagcctcccacgcacatcaccgtggtacacaactaccagttttttgagctggatgtgtaccacagtgacgggacacccctcactgcggatcagatctttgtgcagctggagaagatctggaactcatccctacagaccaacaaggagcctgtgggcatcctcacctccaaccaccgcaactcctgggccaaggcatacaacaccctcatcaaagacaaggtgaaccgggattccgtgcgctccatccagaagaagaaacccgagcttgtgcggtctcccctggtgcccctgcccatgcccaagaagctgcggttcaacatcacccccgagatcaagagcgacatcgagaaggccaagcagaacctcagcatcatgatccaggacctggatatcaccgtgatggtgttccaccattttggaaaagacttccccaagtcggagaagctaagcccagatgccttcatccagatggctttgcagctggcctactacaggatctacggacaggcatgtgccacctatgaaagtgcctccctgcgcatgtttcacctgggccgcaccgacaccatccgctcggcttccatggactcactcacctttgtcaaggccatggatgactccagcgtcacggagcaccagaaggtggagctgctgcggaaggccgtgcaggcccaccgaggctacaccgaccgggccatccgcggggaggcctttgatcgacacctgctgggcctgaagctgcaggccatcgaggacctggtgagcatgcccgacatcttcatggacacctcctacgccatcgccatgcacttccacctctccaccagccaggtccctgccaagacagactgtgtcatgttcttcgggcccgtggtccccgacggctacggtgtctgctataaccccatggaggcccacatcaacttctccctgtcggcctacaacagctgcgcggagaccaacgccgcccgcctggcgcattacctggagaaggcgctcctggacatgcgtgccctgctgcagagccacccccgggccaagctctgagcccctaggactcaggcctgccaatgccacagccaagcccaccctgggatgggccacccaccagggctcagctccttggttccctcttccttggttccctcttccctggtccccccaaatctactgagccacggaccgcatcctccagggggcctgcaggccccagccaagtgccttccgtgggtcatcccagcacctgccagggcccgacctggggctgagtgcagaggctgagcaggacgttaggcccgggcccctggcacgtcctccaccggtgcctcctctggggaagggaaccagccctccagagcaggagactggcaagagctctttgtctcaccagctcagccccggccactccctgccaactccatgaccaggccaccatctgtaccctgcttcccaaactcccaggacctggagacaggattgtctggggccgaggggccagggtgtgaggtttcacctccgttgcggctgtgctcctgtggataacattgctagcgagccgcctctggttccactcagcttggttcctgcccccgccctgctgtatgatattaatgtggaaggtcatcaataaaggggaattgtgttggtgaa

SEQ ID NO: 4648 - DNA, 5249 bp, Homo sapiens
ggacccgcctcagccaatccgctgctgccggcgtcgggtgcgctcggcctcgcccgcggccctccttccccggctcccgctcgccgctcgttcactccaccgccgccgccgccgccgccgctgccgctgccgctgccgcacctccgtagctgactcggtactctctgaagatggcagaagctcaccaagctgtggcctttcagttcacggtcactccggacgggattgacctgcggctgagccatgaagctcttagacaaatctatctctctggacttcattcctggaaaaagaagttcatcagattcaagaacggcatcatcactggcgtgtacccggcaagcccctccagttggcttatcgtggtggtgggcgtgatgacaacgatgtacgccaagatcgacccctcgttaggaataattgcaaaaatcaatcggactctggaaacggccaactgcatgtccagccagacgaagaacgtggtcagcggcgtgctgtttggcaccggcctgtgggtggccctcatcgtcaccatgcgctactccctgaaagtgctgctctcctaccacgggtggatgttcactgagcacggcaagatgagtcgtgccaccaagatctggatgggtatggtcaagatcttttcaggccgaaaacccatgttgtacagcttccagacatcgctgcctcgcctgccggtcccggctgtcaaagacactgtgaacaggtatctacagtcggtgaggcctcttatgaaggaagaagacttcaaacggatgacagcacttgctcaagattttgctgtcggtcttggaccaagattacagtggtatttgaagttaaaatcctggtgggctacaaattacgtgagcgactggtgggaggagtacatctacctccgaggacgagggccgctcatggtgaacagcaactattatgccatggatctgctgtatatccttccaactcacattcaggcagcaagagccggcaacgccatccatgccatcctgctttacaggcgcaaactggaccgggaggaaatcaaaccaattcgtcttttgggatccacgattccactctgctccgctcagtgggagcggatgtttaatacttcccggatcccaggagaggagacagacaccatccagcacatgagagacagcaagcacatcgtcgtgtaccatcgaggacgctacttcaaggtctggctctaccatgatgggcggctgctgaagccccgggagatggagcagcagatgcagaggatcctggacaatacctcggagcctcagcccggggaggccaggctggcagccctcaccgcaggagacagagttccctgggccaggtgtcgtcaggcctattttggacgtgggaaaaataagcagtctcttgatgctgtggagaaagcagcgttctttgtgacgttagatgaaactgaagaaggatacagaagtgaagacccggatacgtcaatggacagctacgccaaatctctactacacggccgatgttacgacaggtggtttgacaagtcgttcacgtttgttgtcttcaaaaacgggaagatgggcctcaacgctgaacactcctgggcagatgcgccgatcgtggcccacctttgggagtacgtcatgtccattgacagcctccagctgggctatgcggaggatgggcactgcaaaggcgacatcaatccgaacattccgtaccccaccaggctgcagtgggacatcccgggggaatgtcaagaggttatagagacctccctgaacaccgcaaatcttctggcaaacgacgtggatttccattccttcccattcgtagcctttggtaaaggaatcatcaagaaatgtcgcacgagcccagacgcctttgtgcagctggccctccagctggcgcactacaaggacatgggcaagttttgcctcacatacgaggcctccatgacccggctcttccgagaggggaggacggagaccgtgcgctcctgcaccactgagtcatgcgacttcgtgcgggccatggtggacccggcccagacggtggaacagaggctgaagttgttcaagttggcgtctgagaagcatcagcatatgtatcgcctcgccatgaccggctctgggatcgatcgtcacctcttctgcctttacgtggtgtctaaatatctcgctgtggagtcccctttccttaaggaagttttatctgagccttggagattatcaacaagccagacccctcagcagcaagtggagctgtttgacttggagaataacccagagtacgtgtccagcggagggggctttggaccggttgctgatgacggctatggtgtgtcgtacatccttgtgggagagaacctcatcaatttccacatttcttccaagttctcttgccctgagacggattctcatcgctttggaaggcacctgaaagaagcaatgactgacatcatcactttgtttggtctcagttctaattccaaaaagtaattccactggagctgctgggaaggaaaacgagctcttctgatgcaaaccaaatgaaaaataggcattaatcctgaccttagctcgggatgaaacactgctcttaaaaaaactcagttttccttccagaaaatgtgggtgtttttttttcctagaacagtatctctcccctgtgaagcataaccccactacttccagacttgccctcccttgggggacatctgataaagtctcccctgatgtctccgcatcggcttggatttattaagggatgcaaatcttgttgagttaatgaaggaattagtagggttgtggcttcacacacagtggaatggaaatggtgtgctttctcagtggcaaccgaaggcctagtgcttaagggcatttagcatcatccaagcagggtaaacttttgttttgttaaaagaaaaatgtgttattcaagttggtgtccccagttgtagctaacacatctggaatgcactaaccaaaatgctgtgctttggagacctgcttttgtcaccgtgggtaaccgttcccgtctggtccagtagcctgtgtttgcctctccacatttgaagcaagcaggatgcaaggtcttcagttttactgaccttgtatgtcttcaagtcttcacaacccagtgccttaaaaatgaaaggccctaaatgtaagggagatggagagaaagatttattttgtagagtctttgggtggaattgtgggtatactgttcccttcacaattgactgagtatggataaccgtacataagcatttgctacaccccaccagccccctccccctcagaaacaccagttccttcccaagggcagctgtgccagactcccctcccgggactgccttcttgtcatcataagcaacaaaagaaataacaggcacatgtcataaaaggggagcaagggccgtgatggtcagataattcactcaagaataaaacatgacacgtgcctcaggaggatctctttcccaaagtgacagcaaggagggcagggcatcggccaccaagcggggactagcaagtgaggaaggggagggcagcccaccgtggtgaggagagagtggctccacgaccccaagggatggccttctcctcccacccggtgaggggaaagactcaccagagggtgatggagacagtatgccggctcaccttggtgaccagccaagatgtctcaagtgacagtgctaggtgttcacccagcctgtccttcagataggagtgccttcacgaaagcgtctcatggaccacaaagcaattatgcactgagtcatcttcagtatttaatgcaaaaatgaagcatcatggaatgaaattcccactgtctgtcatgacaagcttagctgtccattgttttaaattgtgtatttatttttttgaccacttggttctagttgggcctgactccttcagagtgctgcaccccgatagtacaacagcgatggctgaactgttggagtcgatggaaggtgcttgccggagaacacgtgcctttttttttttttttttttttgagatggagtttcactcttgttgcccaggctggagtgcagtggtgcaatctcggctcactgcagcatctgccttgcaggttcaagcgattctcctgtctcagcctcccaagtagctgggattacacgcccaacaccatgccctgctaatttttgtatttttagtagagacggggtttcatcatattggtcaggctggtctcgaactcctgacctcaggtgatccacctgcctcagcctcccaaagtgctgggattacaggcatgagccaccatgcgcggcccacatgcatgttttatgtatgtatacttcatgatgtaaaaatcccacctttatgggccaaagattttttttctcctgaaagcaagaaaaaatgaaaacaaaagacaaaaaaaaaaaaaaaagcgtccaggcgcggtggctcatgcgtgtaatcccagcactttgggaggccaaggcgggcggatcacgaggtcaggagatggagaccatcctggctaacacggtgaaaccccgtctctactaaaaattcaaaaaatgagccgggcgtggtggcgggcgcctgtagtcccagctactcaggaggctgaggcaggagaatggcgtgaacccgggaggcggagcttgcagtgagccgagatcgctccactgcactccagcctgggcgacagagcgagactccgtctaaaaaaaaaagcaaaaacaaaccaacaacaaaagcccctgactgtccgtcaagcaggcagcggggatgtagctctctctgccctgggcaagaatagcacttcccgttaaaagccagcagccggcgtcagtccctatcagagccagctagatcatgcactgttgaccactgagcaatctgtgttacactagagttcacagggcattttgagtgtagacgtgagtgcttaaacatatttgggtttctctctcaggttttaaatgtttcaaatgtaattgttgctcatcagtgcagttatcaatgcaattttatattccttgaggggagaaagaggggtcttattgtacatgtccaaggggggtgataagagtattatctgtttaatttaattggaacaaaccattgtcttaacgcagccatggtttgaatttgttatcttgggctgaccggtgcatgtaaatacagtatgctctttggatgtaaatcttagaaatgcagtgtgaatgtaggttatcattaataaaacattaaccccagtctact

SEQ ID NO: 4649 - DNA, 2635 bp, Homo sapiens
ggacccgcctcagccaatccgctgctgccggcgtcgggtgcgctcggcctcgcccgcggccctccttccccggctcccgctcgccgctcgttcactccaccgccgccgccgccgccgccgctgccgctgccgctgccgcacctccgtagctgactcggtactctctgaagatggcagaagctcaccaagctgtggcctttcagttcacggtcactccggacgggattgacctgcggctgagccatgaagctcttagacaaatctatctctctggacttcattcctggaaaaagaagttcatcagattcaagaacggcatcatcactggcgtgtacccggcaagcccctccagttggcttatcgtggtggtgggcgtgatgacaacgatgtacgccaagatcgacccctcgttaggaataattgcaaaaatcaatcggactctggaaacggccaactgcatgtccagccagacgaagaacgtggtcagcggcgtgctgtttggcaccggcctgtgggtggccctcatcgtcaccatgcgctactccctgaaagtgctgctctcctaccacgggtggatgttcactgagcacggcaagatgagtcgtgccaccaagatctggatgggtatggtcaagatcttttcaggccgaaaacccatgttgtacagcttccagacatcgctgcctcgcctgccggtcccggctgtcaaagacactgtgaacaggtatctacagtcggtgaggcctcttatgaaggaagaagacttcaaacggatgacagcacttgctcaagattttgctgtcggtcttggaccaagattacagtggtatttgaagttaaaatcctggtgggctacaaattacgtgagcgactggtgggaggagtacatctacctccgaggacgagggccgctcatggtgaacagcaactattatgccatggatctgctgtatatccttccaactcacattcaggcagcaagagccggcaacgccatccatgccatcctgctttacaggcgcaaactggaccgggaggaaatcaaaccaattcgtcttttgggatccacgattccactctgctccgctcagtgggagcggatgtttaatacttcccggatcccaggagaggagacagacaccatccagcacatgagagacagcaagcacatcgtcgtgtaccatcgaggacgctacttcaaggtctggctctaccatgatgggcggctgctgaagccccgggagatggagcagcagatgcagaggatcctggacaatacctcggagcctcagcccggggaggccaggctggcagccctcaccgcaggagacagagttccctgggccaggtgtcgtcaggcctattttggacgtgggaaaaataagcagtctcttgatgctgtggagaaagcagcgttctttgtgacgttagatgaaactgaagaaggatacagaagtgaagacccggatacgtcaatggacagctacgccaaatctctactacacggccgatgttacgacaggtggtttgacaagtcgttcacgtttgttgtcttcaaaaacgggaagatgggcctcaacgctgaacactcctgggcagatgcgccgatcgtggcccacctttgggagtacgtcatgtccattgacagcctccagctgggctatgcggaggatgggcactgcaaaggcgacatcaatccgaacattccgtaccccaccaggctgcagtgggacatcccgggggaatgtcaagaggttatagagacctccctgaacaccgcaaatcttctggcaaacgacgtggatttccattccttcccattcgtagcctttggtaaaggaatcatcaagaaatgtcgcacgagcccagacgcctttgtgcagctggccctccagctggcgcactacaaggacatgggcaagttttgcctcacatacgaggcctccatgacccggctcttccgagaggggaggacggagaccgtgcgctcctgcaccactgagtcatgcgacttcgtgcgggccatggtggacccggcccagacggtggaacagaggctgaagttgttcaagttggcgtctgagaagcatcagcatatgtatcgcctcgccatgaccggctctgggatcgatcgtcacctcttctgcctttacgtggtgtctaaatatctcgctgtggagtcccctttccttaaggaagttttatctgagccttggagattatcaacaagccagacccctcagcagcaagtggagctgtttgacttggagaataacccagagtacgtgtccagcggagggggctttggaccggttgctgatgacggctatggtgtgtcgtacatccttgtgggagagaacctcatcaatttccacatttcttccaagttctcttgccctgagacggggattataagtcaaggaccaagttcagatacttgagacaaagtggaaagtctcagcatatggaaacaaggccttggaggagaccatggacatcaccaagttcatgtgctgggctggaaagaaaagcctgttgattttcacttgctgtgcatttattcatccattccattgcctcaatgctgagaacagtgcctgacacataaaagatgctcaataaatatgttaaaagt

SEQ ID NO: 4650 - DNA, 4594 bp, Homo sapiens
aatccgctgctgccggcgtcgggtgcgctcggcctcgcccgcggccctccttccccggctcccgctcgccgctcgttcactccaccgccgccgccgccgccgccgctgccgctgccgctgccgcacctccgtagctgactcggtactctctgaagatggcagaagctcaccaagctgtggcctttcagttcacggtcactccggacgggattgacctgcggctgagccatgaagctcttagacaaatctatctctctggacttcattcctggaaaaagaagttcatcagattcaagaacggcatcatcactggcgtgtacccggcaagcccctccagttggcttatcgtggtggtgggcgtgatgacaacgatgtacgccaagatcgacccctcgttaggaataattgcaaaaatcaatcggactctggaaacggccaactgcatgtccagccagacgaagaacgtggtcagcggcgtgctgtttggcaccggcctgtgggtggccctcatcgtcaccatgcgctactccctgaaagtgctgctctcctaccacgggtggatgttcactgagcacggcaagatgagtcgtgccaccaagatctggatgggtatggtcaagatcttttcaggccgaaaacccatgttgtacagcttccagacatcgctgcctcgcctgccggtcccggctgtcaaagacactgtgaacaggtatctacagtcggtgaggcctcttatgaaggaagaagacttcaaacggatgacagcacttgctcaagattttgctgtcggtcttggaccaagattacagtggtatttgaagttaaaatcctggtgggctacaaattacgtgagcgactggtgggaggagtacatctacctccgaggacgagggccgctcatggtgaacagcaactattatgccatggatctgctgtatatccttccaactcacattcaggcagcaagagccggcaacgccatccatgccatcctgctttacaggcgcaaactggaccgggaggaaatcaaaccaattcgtcttttgggatccacgattccactctgctccgctcagtgggagcggatgtttaatacttcccggatcccaggagaggagacagacaccatccagcacatgagagacagcaagcacatcgtcgtgtaccatcgaggacgctacttcaaggtctggctctaccatgatgggcggctgctgaagccccgggagatggagcagcagatgcagaggatcctggacaatacctcggagcctcagcccggggaggccaggctggcagccctcaccgcaggagacagagttccctgggccaggtgtcgtcaggcctattttggacgtgggaaaaataagcagtctcttgatgctgtggagaaagcagcgttctttgtgacgttagatgaaactgaagaaggatacagaagtgaagacccggatacgtcaatggacagctacgccaaatctctactacacggccgatgttacgacaggtggtttgacaagtcgttcacgtttgttgtcttcaaaaacgggaagatgggcctcaacgctgaacactcctgggcagatgcgccgatcgtggcccacctttgggagtacgtcatgtccattgacagcctccagctgggctatgcggaggatgggcactgcaaaggcgacatcaatccgaacattccgtaccccaccaggctgcagtgggacatcccgggggaatgtcaagaggttatagagacctccctgaacaccgcaaatcttctggcaaacgacgtggatttccattccttcccattcgtagcctttggtaaaggaatcatcaagaaatgtcgcacgagcccagacgcctttgtgcagctggccctccagctggcgcactacaaggacatgggcaagttttgcctcacatacgaggcctccatgacccggctcttccgagaggggaggacggagaccgtgcgctcctgcaccactgagtcatgcgacttcgtgcgggccatggtggacccggcccagacggtggaacagaggctgaagttgttcaagttggcgtctgagaagcatcagcatatgtatcgcctcgccatgaccggctctgggatcgatcgtcacctcttctgcctttacgtggtgtctaaatatctcgctgtggagtcccctttccttaaggaagttttatctgagccttggagattatcaacaagccagacccctcagcagcaagtggagctgtttgacttggagaataacccagagtacgtgtccagcggagggggctttggaccggttgctgatgacggctatggtgtgtcgtacatccttgtgggagagaacctcatcaatttccacatttcttccaagttctcttgccctgagacggattctcatcgctttggaaggcacctgaaagaagcaatgactgacatcatcactttgtttggtctcagttctaattccaaaaagtaattccactggagctgctgggaaggaaaacgagctcttctgatgcaaaccaaatgaaaaataggcattaatcctgaccttagctcgggatgaaacactgctcttaaaaaaactcagttttccttccagaaaatgtgggtgtttttttttcctagaacagtatctctcccctgtgaagcataaccccactacttccagacttgccctcccttgggggacatctgataaagtctcccctgatgtctccgcatcggcttggatttattaagggatgcaaatcttgttgagttaatgaaggaattagtagggttgtggcttcacacacagtggaatggaaatggtgtgctttctcagtggcaaccgaaggcctagtgcttaagggcatttagcatcatccaagcagggtaaacttttgttttgttaaaagaaaaatgtgttattcaagttggtgtccccagttgtagctaacacatctggaatgcactaaccaaaatgctgtgctttggagacctgcttttgtcaccgtgggtaaccgttcccgtctggtccagtagcctgtgtttgcctctccacatttgaagcaagcaggatgcaaggtcttcagttttactgaccttgtatgtcttcaagtcttcacaacccagtgccttaaaaatgaaaggccctaaatgtaagggagatggagagaaagatttattttgtagagtctttgggtggaattgtgggtatactgttcccttcacaattgactgagtatggataaccgtacataagcatttgctacaccccaccagccccctccccctcagaaacaccagttccttcccaagggcagctgtgccagactcccctcccgggactgccttcttgtcatcataagcaacaaaagaaataacaggcacatgtcataaaaggggagcaagggccgtgatggtcagataattcactcaagaataaaacatgacacgtgcctcaggaggatctctttcccaaagtgacagcaaggagggcagggcatcggccaccaagcggggactagcaagtgaggaaggggagggcagcccaccgtggtgaggagagagtggctccacgaccccaagggatggccttctcctcccacccggtgaggggaaagactcaccagagggtgatggagacagtatgccggctcaccttggtgaccagccaagatgtctcaagtgacagtgctaggtgttcacccagcctgtccttcagataggagtgccttcacgaaagcgtctcatggaccacaaagcaattatgcactgagtcatcttcagtatttaatgcaaaaatgaagcatcatggaatgaaattcccactgtctgtcatgacaagcttagctgtccattgttttaaattgtgtatttatttttttgaccacttggttctagttgggcctgactccttcagagtgctgcaccccgatagtacaacagcgatggctgaactgttggagtcgatggaaggtgcttgccggagaacacgtgcctttttttttttttttttttttgagatggagtttcactcttcctgggcgacagagcgagactccgtctaaaaaaaaaagcaaaaacaaaccaacaacaaaagcccctgactgtccgtcaagcaggcagcggggatgtagctctctctgccctgggcaagaatagcacttcccgttaaaagccagcagccggcgtcagtccctatcagagccagctagatcatgcactgttgaccactgagcaatctgtgttacactagagttcacagggcattttgagtgtagacgtgagtgcttaaacatatttgggtttctctctcaggttttaaatgtttcaaatgtaattgttgctcatcagtgcagttatcaatgcaattttatattccttgaggggagaaagaggggtcttattgtacatgtccaaggggggtgataagagtattatctgtttaatttaattggaacaaaccattgtcttaacgcagccatggtttgaatttgttatcttgggctgaccggtgcatgtaaatacagtatgctctttggatgtaaatcttagaaatgcagtgtgaatgtaggttatcattaataaaacattaaccccagtcta

SEQ ID NO: 4651 - DNA, 2382 bp, Homo sapiens
ctccttctccttccaggtactctctgaagatggcagaagctcaccaagctgtggcctttcagttcacggtcactccggacgggattgacctgcggctgagccatgaagctcttagacaaatctatctctctggacttcattcctggaaaaagaagttcatcagattcaagaacggcatcatcactggcgtgtacccggcaagcccctccagttggcttatcgtggtggtgggcgtgatgacaacgatgtacgccaagatcgacccctcgttaggaataattgcaaaaatcaatcggactctggaaacggccaactgcatgtccagccagacgaagaacgtggtcagcggcgtgctgtttggcaccggcctgtgggtggccctcatcgtcaccatgcgctactccctgaaagtgctgctctcctaccacgggtggatgttcactgagcacggcaagatgagtcgtgccaccaagatctggatgggtatggtcaagatcttttcaggccgaaaacccatgttgtacagcttccagacatcgctgcctcgcctgccggtcccggctgtcaaagacactgtgaacaggtatctacagtcggtgaggcctcttatgaaggaagaagacttcaaacggatgacagcacttgctcaagattttgctgtcggtcttggaccaagattacagtggtatttgaagttaaaatcctggtgggctacaaattacgtgagcgactggtgggaggagtacatctacctccgaggacgagggccgctcatggtgaacagcaactattatgccatggatctgctgtatatccttccaactcacattcaggcagcaagagccggcaacgccatccatgccatcctgctttacaggcgcaaactggaccgggaggaaatcaaaccaattcgtcttttgggatccacgattccactctgctccgctcagtgggagcggatgtttaatacttcccggatcccaggagaggagacagacaccatccagcacatgagagacagcaagcacatcgtcgtgtaccatcgaggacgctacttcaaggtctggctctaccatgatgggcggctgctgaagccccgggagatggagcagcagatgcagaggatcctggacaatacctcggagcctcagcccggggaggccaggctggcagccctcaccgcaggagacagagttccctgggccaggtgtcgtcaggcctattttggacgtgggaaaaataagcagtctcttgatgctgtggagaaagcagcgttctttgtgacgttagatgaaactgaagaaggatacagaagtgaagacccggatacgtcaatggacagctacgccaaatctctactacacggccgatgttacgacaggtggtttgacaagtcgttcacgtttgttgtcttcaaaaacgggaagatgggcctcaacgctgaacactcctgggcagatgcgccgatcgtggcccacctttgggagtacgtcatgtccattgacagcctccagctgggctatgcggaggatgggcactgcaaaggcgacatcaatccgaacattccgtaccccaccaggctgcagtgggacatcccgggggaatgtcaagaggttatagagacctccctgaacaccgcaaatcttctggcaaacgacgtggatttccattccttcccattcgtagcctttggtaaaggaatcatcaagaaatgtcgcacgagcccagacgcctttgtgcagctggccctccagctggcgcactacaaggacatgggcaagttttgcctcacatacgaggcctccatgacccggctcttccgagaggggaggacggagaccgtgcgctcctgcaccactgagtcatgcgacttcgtgcgggccatggtggacccggcccagacggtggaacagaggctgaagttgttcaagttggcgtctgagaagcatcagcatatgtatcgcctcgccatgaccggctctgggatcgatcgtcacctcttctgcctttacgtggtgtctaaatatctcgctgtggagtcccctttccttaaggaagttttatctgagccttggagattatcaacaagccagacccctcagcagcaagtggagctgtttgacttggagaataacccagagtacgtgtccagcggagggggctttggaccggttgctgatgacggctatggtgtgtcgtacatccttgtgggagagaacctcatcaatttccacatttcttccaagttctcttgccctgagacggattctcatcgctttggaaggcacctgaaagaagcaatgactgacatcatcactttgtttggtctcagttctaattccaaaaagtaattccactggagctgctgggaaggaaaacgag

SEQ ID NO: 4652 - DNA, 2496 bp, Homo sapiens
ctccttctccttccaggtactctctgaagatggcagaagctcaccaagctgtggcctttcagttcacggtcactccggacgggattgacctgcggctgagccatgaagctcttagacaaatctatctctctggacttcattcctggaaaaagaagttcatcagattcaagaacggcatcatcactggcgtgtacccggcaagcccctccagttggcttatcgtggtggtgggcgtgatgacaacgatgtacgccaagatcgacccctcgttaggaataattgcaaaaatcaatcggactctggaaacggccaactgcatgtccagccagacgaagaacgtggtcagcggcgtgctgtttggcaccggcctgtgggtggccctcatcgtcaccatgcgctactccctgaaagtgctgctctcctaccacgggtggatgttcactgagcacggcaagatgagtcgtgccaccaagatctggatgggtatggtcaagatcttttcaggccgaaaacccatgttgtacagcttccagacatcgctgcctcgcctgccggtcccggctgtcaaagacactgtgaacaggtatctacagtcggtgaggcctcttatgaaggaagaagacttcaaacggatgacagcacttgctcaagattttgctgtcggtcttggaccaagattacagtggtatttgaagttaaaatcctggtgggctacaaattacgtgagcgactggtgggaggagtacatctacctccgaggacgagggccgctcatggtgaacagcaactattatgccatggatctgctgtatatccttccaactcacattcaggcagcaagagccggcaacgccatccatgccatcctgctttacaggcgcaaactggaccgggaggaaatcaaaccaattcgtcttttgggatccacgattccactctgctccgctcagtgggagcggatgtttaatacttcccggatcccaggagaggagacagacaccatccagcacatgagagacagcaagcacatcgtcgtgtaccatcgaggacgctacttcaaggtctggctctaccatgatgggcggctgctgaagccccgggagatggagcagcagatgcagaggatcctggacaatacctcggagcctcagcccggggaggccaggctggcagccctcaccgcaggagacagagttccctgggccaggtgtcgtcaggcctattttggacgtgggaaaaataagcagtctcttgatgctgtggagaaagcagcgttctttgtgacgttagatgaaactgaagaaggatacagaagtgaagacccggatacgtcaatggacagctacgccaaatctctactacacggccgatgttacgacaggtggtttgacaagtcgttcacgtttgttgtcttcaaaaacgggaagatgggcctcaacgctgaacactcctgggcagatgcgccgatcgtggcccacctttgggagtacgtcatgtccattgacagcctccagctgggctatgcggaggatgggcactgcaaaggcgacatcaatccgaacattccgtaccccaccaggctgcagtgggacatcccgggggaatgtcaagaggttatagagacctccctgaacaccgcaaatcttctggcaaacgacgtggatttccattccttcccattcgtagcctttggtaaaggaatcatcaagaaatgtcgcacgagcccagacgcctttgtgcagctggccctccagctggcgcactacaaggacatgggcaagttttgcctcacatacgaggcctccatgacccggctcttccgagaggggaggacggagaccgtgcgctcctgcaccactgagtcatgcgacttcgtgcgggccatggtggacccggcccagacggtggaacagaggctgaagttgttcaagttggcgtctgagaagcatcagcatatgtatcgcctcgccatgaccggctctgggatcgatcgtcacctcttctgcctttacgtggtgtctaaatatctcgctgtggagtcccctttccttaaggaagttttatctgagccttggagattatcaacaagccagacccctcagcagcaagtggagctgtttgacttggagaataacccagagtacgtgtccagcggagggggctttggaccggttgctgatgacggctatggtgtgtcgtacatccttgtgggagagaacctcatcaatttccacatttcttccaagttctcttgccctgagacggggattataagtcaaggaccaagttcagatacttgagacaaagtggaaagtctcagcatatggaaacaaggccttggaggagaccatggacatcaccaagttcatgtgctgggctggaaagaaaagcctgttgattttcacttgctgtgcatttattcatccattccattgcctcaatgctgagaacagtgcctgacacataaaagatgctcaataaatatgttaaaagtaa

SEQ ID NO: 4653 - DNA, 2592 bp, Homo sapiens
gccccacgcacggacaggagtgaacccgagctgtgccgaccaacccccaggatggcggaagctcaccaggccgtggccttccagttcacggtgaccccagacggggtcgacttccggctcagtcgggaggccctgaaacacgtctacctgtctgggatcaactcctggaagaaacgcctgatccgcatcaagaatggcatcctcaggggcgtgtaccctggcagccccaccagctggctggtcgtcatcatggcaacagtgggttcctccttctgcaacgtggacatctccttggggctggtcagttgcatccagagatgcctccctcaggggtgtggcccctaccagaccccgcagacccgggcacttctcagcatggccatcttctccacgggcgtctgggtgacgggcatcttcttcttccgccaaaccctgaagctgcttctctgctaccatgggtggatgtttgagatgcatggcaagaccagcaacttgaccaggatctgggctatgtgtatccgccttctatccagccggcaccctatgctctacagcttccagacatctctgcccaagcttcctgtgcccagggtgtcagccacaattcagcggtacctagagtctgtgcgccccttgttggatgatgaggaatattaccgcatggagttgctggccaaagaattccaggacaagactgcccccaggctgcagaaatacctggtgctcaagtcatggtgggcaagtaactatgtgagtgactggtgggaagagtacatctaccttcgaggcaggagccctctcatggtgaacagcaactattatgtcatggaccttgtgctcatcaagaatacagacgtgcaggcagcccgcctgggaaacatcatccacgccatgatcatgtatcgccgtaaactggaccgtgaagaaatcaagcctgtgatggcactgggcatagtgcctatgtgctcctaccagatggagaggatgttcaacaccactcggatcccgggcaaggacacagatgtgctacagcacctctcagacagccggcacgtggctgtctaccacaagggacgcttcttcaagctgtggctctatgagggcgcccgtctgctcaagcctcaggatctggagatgcagttccagaggatcctggacgacccctccccacctcagcctggggaggagaagctggcagccctcactgcaggaggaagggtggagtgggcgcaggcacgccaggccttctttagctctggaaagaataaggctgccttggaggccatcgagcgtgccgctttcttcgtggccctggatgaggaatcctactcctatgaccccgaagatgaggccagcctcagcctctatggcaaggccctgctacatggcaactgctacaacaggtggtttgacaaatccttcactctcatttccttcaagaatggccagttgggtctcaatgcagagcatgcgtgggcagatgctcccatcattgggcacctctgggagtttgtcctgggcacagacagcttccacctgggctacacggagaccgggcactgcctgggcaaaccgaaccctgcgctcgcacctcctacacggctgcagtgggacattccaaaacagtgccaggcggtcatcgagagttcctaccaggtggccaaggcgttggcagacgacgtggagttgtactgcttccagttcctgccctttggcaaaggcctcatcaagaagtgccggaccagccctgatgcctttgtgcagatcgcgctgcagctggctcacttccgggacaggggtaagttctgcctgacctatgaggcctcaatgaccagaatgttccgggagggacggactgagactgtgcgttcctgtaccagcgagtccacagcctttgtgcaggccatgatggaggggtcccacacaaaagcagacctgcgagatctcttccagaaggctgctaagaagcaccagaatatgtaccgcctggccatgaccggggcagggatcgacaggcacctcttctgcctttacttggtctccaagtacctaggagtcagctctcctttccttgctgaggtgctctcggaaccctggcgtctctccaccagccagatcccccaatcccagatccgcatgttcgacccagagcagcaccccaatcacctgggcgctggaggtggctttggccctgtagcagatgatggctatggagtttcctacatgattgcaggcgagaacacgatcttcttccacatctccagcaagttctcaagctcagagacgaacgcccagcgctttggaaaccacatccgcaaagccctgctggacattgctgatcttttccaagttcccaaggcctacagctgaagcccttaggtacctgtgttttgtttgggaactcggaggccctccccctcccccagctcagaccacagaggtggcaagagaagggctgaagctggaagactgttcatgagggacttgtgtgacctgctttgaaatgtgtgactctgctgagtgacgtaggctctgagatagctgtccacgcccacgtgtttgcttggaataaatacttgcctcagaaccttc

SEQ ID NO: 4654 - DNA, 2933 bp, Homo sapiens
atttttagctctaaagccaccatcctcacgagactctggggccccccaggctcccagacctttgagcaaccttcaccgcacagaaacccagccgcgccctgcaattcccaccgcggaaggtgccgaccaacccccaggatggcggaagctcaccaggccgtggccttccagttcacggtgaccccagacggggtcgacttccggctcagtcgggaggccctgaaacacgtctacctgtctgggatcaactcctggaagaaacgcctgatccgcatcaagaatggcatcctcaggggcgtgtaccctggcagccccaccagctggctggtcgtcatcatggcaacagtgggttcctccttctgcaacgtggacatctccttggggctggtcagttgcatccagagatgcctccctcaggggtgtggcccctaccagaccccgcagacccgggcacttctcagcatggccatcttctccacgggcgtctgggtgacgggcatcttcttcttccgccaaaccctgaagctgcttctctgctaccatgggtggatgtttgagatgcatggcaagaccagcaacttgaccaggatctgggctatgtgtatccgccttctatccagccggcaccctatgctctacagcttccagacatctctgcccaagcttcctgtgcccagggtgtcagccacaattcagcggtacctagagtctgtgcgccccttgttggatgatgaggaatattaccgcatggagttgctggccaaagaattccaggacaagactgcccccaggctgcagaaatacctggtgctcaagtcatggtgggcaagtaactatgtgagtgactggtgggaagagtacatctaccttcgaggcaggagccctctcatggtgaacagcaactattatgtcatggaccttgtgctcatcaagaatacagacgtgcaggcagcccgcctgggaaacatcatccacgccatgatcatgtatcgccgtaaactggaccgtgaagaaatcaagcctgtgatggcactgggcatagtgcctatgtgctcctaccagatggagaggatgttcaacaccactcggatcccgggcaaggacacagatgtgctacagcacctctcagacagccggcacgtggctgtctaccacaagggacgcttcttcaagctgtggctctatgagggcgcccgtctgctcaagcctcaggatctggagatgcagttccagaggatcctggacgacccctccccacctcagcctggggaggagaagctggcagccctcactgcaggaggaagggtggagtgggcgcaggcacgccaggccttctttagctctggaaagaataaggctgccttggaggccatcgagcgtgccgctttcttcgtggccctggatgaggaatcctactcctatgaccccgaagatgaggccagcctcagcctctatggcaaggccctgctacatggcaactgctacaacaggtggtttgacaaatccttcactctcatttccttcaagaatggccagttgggtctcaatgcagagcatgcgtgggcagatgctcccatcattgggcacctctgggagtttgtcctgggcacagacagcttccacctgggctacacggagaccgggcactgcctgggcaaaccgaaccctgcgctcgcacctcctacacggctgcagtgggacattccaaaacagtgccaggcggtcatcgagagttcctaccaggtggccaaggcgttggcagacgacgtggagttgtactgcttccagttcctgccctttggcaaaggcctcatcaagaagtgccggaccagccctgatgcctttgtgcagatcgcgctgcagctggctcacttccgggacaggggtaagttctgcctgacctatgaggcctcaatgaccagaatgttccgggagggacggactgagactgtgcgttcctgtaccagcgagtccacagcctttgtgcaggccatgatggaggggtcccacacaaaagcagacctgcgagatctcttccagaaggctgctaagaagcaccagaatatgtaccgcctggccatgaccggggcagggatcgacaggcacctcttctgcctttacttggtctccaagtacctaggagtcagctctcctttccttgctgaggtgctctcggaaccctggcgtctctccaccagccagatcccccaatcccagatccgcatgttcgacccagagcagcaccccaatcacctgggcgctggaggtggctttggccctgtagcagatgatggctatggagtttcctacatgattgcaggcgagaacacgatcttcttccacatctccagcaagttctcaagctcagagacgaacgcccagcgctttggaaaccacatccgcaaagccctgctggacattgctgatcttttccaagttcccaaggcctacagctgaaggttggagaaatgccagctgccctttcgtccccacactgtggaggaagggacctgtggcagctcacaggcatgaggggtggccgtgcacaggtgcccaggctccaaggacagctccggcagcaggtcctcgctgggcagatgctgctccctgagggcccaggtggtggaggtggggttggagcaggaagggaattttgatttttttttttcttgatagatactaataaaaataaggctgtgtaattttctctcagcccttaggtacctgtgttttgtttgggaactcggaggccctccccctcccccagctcagaccacagaggtggcaagagaagggctgaagctggaagactgttcatgagggacttgtgtgacctgctttgaaatgtgtgactctgctgagtgacgtaggctctgagatagctgtccacgcccacgtgtttgcttggaataaatacttgcctcagaaccttc

SEQ ID NO: 4655 - DNA, 2662 bp, Homo sapiens
aggcctgaaggacgtggggacacgggccagagtggctggccccacgcacggacaggagtgaacccgagctgtgccgaccaacccccaggatggcggaagctcaccaggccgtggccttccagttcacggtgaccccagacggggtcgacttccggctcagtcgggaggccctgaaacacgtctacctgtctgggatcaactcctggaagaaacgcctgatccgcatcaagaatggcatcctcaggggcgtgtaccctggcagccccaccagctggctggtcgtcatcatggcaacagtgggttcctccttctgcaacgtggacatctccttggggctggtcagttgcatccagagatgcctccctcaggggtgtggcccctaccagaccccgcagacccgggcacttctcagcatggccatcttctccacgggcgtctgggtgacgggcatcttcttcttccgccaaaccctgaagctgcttctctgctaccatgggtggatgtttgagatgcatggcaagaccagcaacttgaccaggatctgggctatgtgtatccgccttctatccagccggcaccctatgctctacagcttccagacatctctgcccaagcttcctgtgcccagggtgtcagccacaattcagcggtacctagagtctgtgcgccccttgttggatgatgaggaatattaccgcatggagttgctggccaaagaattccaggacaagactgcccccaggctgcagaaatacctggtgctcaagtcatggtgggcaagtaactatgtgagtgactggtgggaagagtacatctaccttcgaggcaggagccctctcatggtgaacagcaactattatgtcatggaccttgtgctcatcaagaatacagacgtgcaggcagcccgcctgggaaacatcatccacgccatgatcatgtatcgccgtaaactggaccgtgaagaaatcaagcctgtgatggcactgggcatagtgcctatgtgctcctaccagatggagaggatgttcaacaccactcggatcccgggcaaggacacagatgtgctacagcacctctcagacagccggcacgtggctgtctaccacaagggacgcttcttcaagctgtggctctatgagggcgcccgtctgctcaagcctcaggatctggagatgcagttccagaggatcctggacgacccctccccacctcagcctggggaggagaagctggcagccctcactgcaggaggaagggtggagtgggcgcaggcacgccaggccttctttagctctggaaagaataaggctgccttggaggccatcgagcgtgccgctttcttcgtggccctggatgaggaatcctactcctatgaccccgaagatgaggccagcctcagcctctatggcaaggccctgctacatggcaactgctacaacaggtggtttgacaaatccttcactctcatttccttcaagaatggccagttgggtctcaatgcagagcatgcgtgggcagatgctcccatcattgggcacctctgggagtttgtcctgggcacagacagcttccacctgggctacacggagaccgggcactgcctgggcaaaccgaaccctgcgctcgcacctcctacacggctgcagtgggacattccaaaacagtgccaggcggtcatcgagagttcctaccaggtggccaaggcgttggcagacgacgtggagttgtactgcttccagttcctgccctttggcaaaggcctcatcaagaagtgccggaccagccctgatgcctttgtgcagatcgcgctgcagctggctcacttccgggacaggggtaagttctgcctgacctatgaggcctcaatgaccagaatgttccgggagggacggactgagactgtgcgttcctgtaccagcgagtccacagcctttgtgcaggccatgatggaggggtcccacacaaaagcagacctgcgagatctcttccagaaggctgctaagaagcaccagaatatgtaccgcctggccatgaccggggcagggatcgacaggcacctcttctgcctttacttggtctccaagtacctaggagtcagctctcctttccttgctgaggtgctctcggaaccctggcgtctctccaccagccagatcccccaatcccagatccgcatgttcgacccagagcagcaccccaatcacctgggcgctggaggtggctttggccctgtagcagatgatggctatggagtttcctacatgattgcaggcgagaacacgatcttcttccacatctccagcaagttctcaagctcagagacgaacgcccagcgctttggaaaccacatccgcaaagccctgctggacattgctgatcttttccaagttcccaaggcctacagctgaaggttggagaaatgccagctgccctttcgtccccacactgtggaggaagggacctgtggcagctcacaggcatgaggggtggccgtgcacaggtgcccaggctccaaggacagctccggcagcaggtcctcgctgggcagatgctgctccctgagggcccaggtggtggaggtggggttggagcaggaagggaattttgatttttttttttcttgatagatactaataaaaataaggctgtgtaattttctctc

SEQ ID NO: 4656 - DNA, 2647 bp, Homo sapiens
gtcgcggactggctgggggcgtctcggcgcggctggcggcggggccggcctaagcgcgcccgcgcacccatctgcccccgtcctaggtgccgaccaacccccaggatggcggaagctcaccaggccgtggccttccagttcacggtgaccccagacggggtcgacttccggctcagtcgggaggccctgaaacacgtctacctgtctgggatcaactcctggaagaaacgcctgatccgcatcaagaatggcatcctcaggggcgtgtaccctggcagccccaccagctggctggtcgtcatcatggcaacagtgggttcctccttctgcaacgtggacatctccttggggctggtcagttgcatccagagatgcctccctcaggggtgtggcccctaccagaccccgcagacccgggcacttctcagcatggccatcttctccacgggcgtctgggtgacgggcatcttcttcttccgccaaaccctgaagctgcttctctgctaccatgggtggatgtttgagatgcatggcaagaccagcaacttgaccaggatctgggctatgtgtatccgccttctatccagccggcaccctatgctctacagcttccagacatctctgcccaagcttcctgtgcccagggtgtcagccacaattcagcggtacctagagtctgtgcgccccttgttggatgatgaggaatattaccgcatggagttgctggccaaagaattccaggacaagactgcccccaggctgcagaaatacctggtgctcaagtcatggtgggcaagtaactatgtgagtgactggtgggaagagtacatctaccttcgaggcaggagccctctcatggtgaacagcaactattatgtcatggaccttgtgctcatcaagaatacagacgtgcaggcagcccgcctgggaaacatcatccacgccatgatcatgtatcgccgtaaactggaccgtgaagaaatcaagcctgtgatggcactgggcatagtgcctatgtgctcctaccagatggagaggatgttcaacaccactcggatcccgggcaaggacacagatgtgctacagcacctctcagacagccggcacgtggctgtctaccacaagggacgcttcttcaagctgtggctctatgagggcgcccgtctgctcaagcctcaggatctggagatgcagttccagaggatcctggacgacccctccccacctcagcctggggaggagaagctggcagccctcactgcaggaggaagggtggagtgggcgcaggcacgccaggccttctttagctctggaaagaataaggctgccttggaggccatcgagcgtgccgctttcttcgtggccctggatgaggaatcctactcctatgaccccgaagatgaggccagcctcagcctctatggcaaggccctgctacatggcaactgctacaacaggtggtttgacaaatccttcactctcatttccttcaagaatggccagttgggtctcaatgcagagcatgcgtgggcagatgctcccatcattgggcacctctgggagtttgtcctgggcacagacagcttccacctgggctacacggagaccgggcactgcctgggcaaaccgaaccctgcgctcgcacctcctacacggctgcagtgggacattccaaaacagtgccaggcggtcatcgagagttcctaccaggtggccaaggcgttggcagacgacgtggagttgtactgcttccagttcctgccctttggcaaaggcctcatcaagaagtgccggaccagccctgatgcctttgtgcagatcgcgctgcagctggctcacttccgggacaggggtaagttctgcctgacctatgaggcctcaatgaccagaatgttccgggagggacggactgagactgtgcgttcctgtaccagcgagtccacagcctttgtgcaggccatgatggaggggtcccacacaaaagcagacctgcgagatctcttccagaaggctgctaagaagcaccagaatatgtaccgcctggccatgaccggggcagggatcgacaggcacctcttctgcctttacttggtctccaagtacctaggagtcagctctcctttccttgctgaggtgctctcggaaccctggcgtctctccaccagccagatcccccaatcccagatccgcatgttcgacccagagcagcaccccaatcacctgggcgctggaggtggctttggccctgtagcagatgatggctatggagtttcctacatgattgcaggcgagaacacgatcttcttccacatctccagcaagttctcaagctcagagacgaacgcccagcgctttggaaaccacatccgcaaagccctgctggacattgctgatcttttccaagttcccaaggcctacagctgaagcccttaggtacctgtgttttgtttgggaactcggaggccctccccctcccccagctcagaccacagaggtggcaagagaagggctgaagctggaagactgttcatgagggacttgtgtgacctgctttgaaatgtgtgactctgctgagtgacgtaggctctgagatagctgtccacgcccacgtgtttgcttggaataaatacttgcctcagaaccttca

SEQ ID NO: 4657 - DNA, 558 bp, Homo sapiens
acttccaggggcgcctctctcccctgcccgcgccctcgctgacgccccccaactccaggctgcccttcgccgtccttggggctcctggagctttcaaggcccaaatcccctgcaccacagtggctgtgcccacccggaaggctggcgcgaggatttggcggcggtgccgaccaacccccaggatggcggaagctcaccaggccgtggccttccagttcacggtgaccccagacggggtcgacttccggctcagtcgggaggccctgaaacacgtctacctgtctgggatcaactcctggaagaaacgcctgatccgcatcaagaatggcatcctcaggggcgtgtaccctggcagccccaccagctggctggtcgtcatcatggcaacagtgggttcctccttctgcaacgtggacatctccttggggctggtcagttgcatccagagatgcctccctcaggggtgtggcccctaccagaccccgcagacccgggcacttctcagcatggccatcttctccacgggcgtctgggtgacgggcatcttcttcttccgcc

SEQ ID NO: 4658 - DNA, 2753 bp, Homo sapiens
tccatcctccaggcatccatgtccaccatagaatttggttacttggactatgcccagtctcggttccagttctacttccagcagaaggggcagctgaccagtgtccactcctcatcctgactccaccctcccactccttggatttctcctggagcctccagggcaggaccttggagggaggaacaacgagcagaaggccctggcgactgggctgagcccccaagtgaaactgaggttcaggagaccggcctgttcctgagtttgactctaaagccaccatcctcacgagactctggggccccccaggctcccagacctttgagcaaccttcaccgcacagaaacccagccgcgccctgcaattcccaccgcggaaggtgccgaccaacccccaggatggcggaagctcaccaggccgtggccttccagttcacggtgaccccagacggggtcgacttccggctcagtcgggaggccctgaaacacgtctacctgtctgggatcaactcctggaagaaacgcctgatccgcatcaagaatggcatcctcaggggcgtgtaccctggcagccccaccagctggctggtcgtcatcatggcaacagtgggttcctccttctgcaacgtggacatctccttggggctggtcagttgcatccagagatgcctccctcaggggtgtggcccctaccagaccccgcagacccgggcacttctcagcatggccatcttctccacgggcgtctgggtgacgggcatcttcttcttccgccaaaccctgaagctgcttctctgctaccatgggtggatgtttgagatgcatggcaagaccagcaacttgaccaggatctgggctcttccagacatctctgcccaagcttcctgtgcccagggtgtcagccacaattcagcggtacctagagtctgtgcgccccttgttggatgatgaggaatattaccgcatggagttgctggccaaagaattccaggacaagactgcccccaggctgcagaaatacctggtgctcaagtcatggtgggcaagtaactatgtgagtgactggtgggaagagtacatctaccttcgaggcaggagccctctcatggtgaacagcaactattatgtcatggaccttgtgctcatcaagaatacagacgtgcaggcagcccgcctgggaaacatcatccacgccatgatcatgtatcgccgtaaactggaccgtgaagaaatcaagcctgtgatggcactgggcatagtgcctatgtgctcctaccagatggagaggatgttcaacaccactcggatcccgggcaaggacacagatgtgctacagcacctctcagacagccggcacgtggctgtctaccacaagggacgcttcttcaagctgtggctctatgagggcgcccgtctgctcaagcctcaggatctggagatgcagttccagaggatcctggacgacccctccccacctcagcctggggaggagaagctggcagccctcactgcaggaggaagggtggagtgggcgcaggcacgccaggccttctttagctctggaaagaataaggctgccttggaggccatcgagcgtgccgctttcttcgtggccctggatgaggaatcctactcctatgaccccgaagatgaggccagcctcagcctctatggcaaggccctgctacatggcaactgctacaacaggtggtttgacaaatccttcactctcatttccttcaagaatggccagttgggtctcaatgcagagcatgcgtgggcagatgctcccatcattgggcacctctgggagtttgtcctgggcacagacagcttccacctgggctacacggagaccgggcactgcctgggcaaaccgaaccctgcgctcgcacctcctacacggctgcagtgggacattccaaaacaggcggtcatcgagagttcctaccaggtggccaaggcgttggcagacgacgtggagttgtactgcttccagttcctgccctttggcaaaggcctcatcaagaagtgccggaccagccctgatgcctttgtgcagatcgcgctgcagctggctcacttccgggacaggggtaagttctgcctgacctatgaggcctcaatgaccagaatgttccgggagggacggactgagactgtgcgttcctgtaccagcgagtccacagcctttgtgcaggccatgatggaggggtcccacacaaaagcagacctgcgagatctcttccagaaggctgctaagaagcaccagaatatgtaccgcctggccatgaccggggcagggatcgacaggcacctcttctgcctttacttggtctccaagtacctaggagtcagctctcctttccttgctgaggtgctctcggaaccctggcgtctctccaccagccagatcccccaatcccagatccgcatgttcgacccagagcagcaccccaatcacctgggcgctggaggtggctttggccctgtagcagatgatggctatggagtttcctacatgattgcaggcgagaacacgatcttcttccacatctccagcaagttctcaagctcagagacgaacgcccagcgctttggaaaccacatccgcaaagccctgctggacattgctgatcttttccaagttcccaaggcctacagctgaagcccttaggtacctgtgttttgtttgggaactcggaggccctccccctcccccagctcagaccacagaggtggcaagagaagggctga

SEQ ID NO: 4659 - DNA, 2436 bp, Homo sapiens
atttttagctctaaagccaccatcctcacgagactctggggccccccaggctcccagacctttgagcaaccttcaccgcacagaaacccagccgcgccctgcaattcccaccgcggaaggtgccgaccaacccccaggatggcggaagctcaccaggccgtggccttccagttcacggtgaccccagacggggtcgacttccggctcagtcgggaggccctgaaacacgtctacctgtctgggatcaactcctggaagaaacgcctgatccgcatcaagaatggcatcctcaggggcgtgtaccctggcagccccaccagctggctggtcgtcatcatggcaacagtgggttcctccttctgcaacgtggacatctccttggggctggtcagttgcatccagagatgcctccctcaggggtgtggcccctaccagaccccgcagacccgggcacttctcagcatggccatcttctccacgggcgtctgggtgacgggcatcttcttcttccgccaaaccctgaagctgcttctctgctaccatgggtggatgtttgagatgcatggcaagaccagcaacttgaccaggatctgggctatgtgtatccgccttctatccagccggcaccctatgctctacagcttccagacatctctgcccaagcttcctgtgcccagggtgtcagccacaattcagcggtacctagagtctgtgcgccccttgttggatgatgaggaatattaccgcatggagttgctggccaaagaattccaggacaagactgcccccaggctgcagaaatacctggtgctcaagtcatggtgggcaagtaactatgtgagtgactggtgggaagagtacatctaccttcgaggcaggagccctctcatggtgaacagcaactattatgtcatggaccttgtgctcatcaagaatacagacgtgcaggcagcccgcctgggaaacatcatccacgccatgatcatgtatcgccgtaaactggaccgtgaagaaatcaagcctgtgatggcactgggcatagtgcctatgtgctcctaccagatggagaggatgttcaacaccactcggatcccgggcaaggacacagatgtgctacagcacctctcagacagccggcacgtggctgtctaccacaagggacgcttcttcaagctgtggctctatgagggcgcccgtctcctcagcctctatggcaaggccctgctacatggcaactgctacaacaggtggtttgacaaatccttcactctcatttccttcaagaatggccagttgggtctcaatgcagagcatgcgtgggcagatgctcccatcattgggcacctctgggagtttgtcctgggcacagacagcttccacctgggctacacggagaccgggcactgcctgggcaaaccgaaccctgcgctcgcacctcctacacggctgcagtgggacattccaaaacagtgccaggcggtcatcgagagttcctaccaggtggccaaggcgttggcagacgacgtggagttgtactgcttccagttcctgccctttggcaaaggcctcatcaagaagtgccggaccagccctgatgcctttgtgcagatcgcgctgcagctggctcacttccgggacaggggtaagttctgcctgacctatgaggcctcaatgaccagaatgttccgggagggacggactgagactgtgcgttcctgtaccagcgagtccacagcctttgtgcaggccatgatggaggggtcccacacaaaagcagacctgcgagatctcttccagaaggctgctaagaagcaccagaatatgtaccgcctggccatgaccggggcagggatcgacaggcacctcttctgcctttacttggtctccaagtacctaggagtcagctctcctttccttgctgaggtgctctcggaaccctggcgtctctccaccagccagatcccccaatcccagatccgcatgttcgacccagagcagcaccccaatcacctgggcgctggaggtggctttggccctgtagcagatgatggctatggagtttcctacatgattgcaggcgagaacacgatcttcttccacatctccagcaagttctcaagctcagagacgaacgcccagcgctttggaaaccacatccgcaaagccctgctggacattgctgatcttttccaagttcccaaggcctacagctgaagcccttaggtacctgtgttttgtttgggaactcggaggccctccccctcccccagctcagaccacagaggtggcaagagaagggctgaagctggaagactgttcatgagggacttgtgtgacctgctttgaaatgtgtgactctgctgagtgacgtaggctctgagatagctgtccacgcccacgtgtttgcttggaataaatacttgcctcagaaccttc

SEQ ID NO: 4660 - DNA, 2577 bp, Homo sapiens
atttttagctctaaagccaccatcctcacgagactctggggccccccaggctcccagacctttgagcaaccttcaccgcacagaaacccagccgcgccctgcaattcccaccgcggaaggtgccgaccaacccccaggatggcggaagctcaccaggccgtggccttccagttcacggtgaccccagacggggtcgacttccggctcagtcgggaggccctgaaacacgtctacctgtctgggatcaactcctggaagaaacgcctgatccgcatcaagaatggcatcctcaggggcgtgtaccctggcagccccaccagctggctggtcgtcatcatggcaacagtgggttcctccttctgcaacgtggacatctccttggggctggtcagttgcatccagagatgcctccctcaggggtgtggcccctaccagaccccgcagacccgggcacttctcagcatggccatcttctccacgggcgtctgggtgacgggcatcttcttcttccgccaaaccctgaagctgcttctctgctaccatgggtggatgtttgagatgcatggcaagaccagcaacttgaccaggatctgggcttacctagagtctgtgcgccccttgttggatgatgaggaatattaccgcatggagttgctggccaaagaattccaggacaagactgcccccaggctgcagaaatacctggtgctcaagtcatggtgggcaagtaactatgtgagtgactggtgggaagagtacatctaccttcgaggcaggagccctctcatggtgaacagcaactattatgtcatggaccttgtgctcatcaagaatacagacgtgcaggcagcccgcctgggaaacatcatccacgccatgatcatgtatcgccgtaaactggaccgtgaagaaatcaagcctgtgatggcactgggcatagtgcctatgtgctcctaccagatggagaggatgttcaacaccactcggatcccgggcaaggacacagatgtgctacagcacctctcagacagccggcacgtggctgtctaccacaagggacgcttcttcaagctgtggctctatgagggcgcccgtctgctcaagcctcaggatctggagatgcagttccagaggatcctggacgacccctccccacctcagcctggggaggagaagctggcagccctcactgcaggaggaagggtggagtgggcgcaggcacgccaggccttctttagctctggaaagaataaggctgccttggaggccatcgagcgtgccgctttcttcgtggccctggatgaggaatcctactcctatgaccccgaagatgaggccagcctcagcctctatggcaaggccctgctacatggcaactgctacaacaggtggtttgacaaatccttcactctcatttccttcaagaatggccagttgggtctcaatgcagagcatgcgtgggcagatgctcccatcattgggcacctctgggagtttgtcctgggcacagacagcttccacctgggctacacggagaccgggcactgcctgggcaaaccgaaccctgcgctcgcacctcctacacggctgcagtgggacattccaaaacagtgccaggcggtcatcgagagttcctaccaggtggccaaggcgttggcagacgacgtggagttgtactgcttccagttcctgccctttggcaaaggcctcatcaagaagtgccggaccagccctgatgcctttgtgcagatcgcgctgcagctggctcacttccgggacaggggtaagttctgcctgacctatgaggcctcaatgaccagaatgttccgggagggacggactgagactgtgcgttcctgtaccagcgagtccacagcctttgtgcaggccatgatggaggggtcccacacaaaagcagacctgcgagatctcttccagaaggctgctaagaagcaccagaatatgtaccgcctggccatgaccggggcagggatcgacaggcacctcttctgcctttacttggtctccaagtacctaggagtcagctctcctttccttgctgaggtgctctcggaaccctggcgtctctccaccagccagatcccccaatcccagatccgcatgttcgacccagagcagcaccccaatcacctgggcgctggaggtggctttggccctgtagcagatgatggctatggagtttcctacatgattgcaggcgagaacacgatcttcttccacatctccagcaagttctcaagctcagagacgaacgcccagcgctttggaaaccacatccgcaaagccctgctggacattgctgatcttttccaagttcccaaggcctacagctgaagcccttaggtacctgtgttttgtttgggaactcggaggccctccccctcccccagctcagaccacagaggtggcaagagaagggctgaagctggaagactgttcatgagggacttgtgtgacctgctttgaaatgtgtgactctgctgagtgacgtaggctctgagatagctgtccacgcccacgtgtttgcttggaataaatacttgcctcagaaccttc

SEQ ID NO: 4661 - DNA, 1952 bp, Homo sapiens
ctaaaactaatgcttttctcaagaccccgcaactcagcctggaccagtttccctcctccacccacccccgaatcttgagaatcctgtactggggggagggcactgcccccgcaccatgttcttgggagagcagggctccagcgtgacatggctgaagcgcaccaggccgtgggcttccgaccctcgctgacctcggacggggctgaagtggaactcagtgcccctgtgctgcaggagatctacctctctggcctgcgctcctggaaaaggcatctctcacgtttctggaatgactttctcaccggtgtgtttcctgccagccccctcagttggcttttcctcttcagtgccatccagcttgcctggttcctccagctggatccttccttaggactgatggagaagatcaaagagttgctgcctgactggccctggtccgcatcttctctggccgccacccgatgctgttcagttaccagcgctccctgccacgccagcccgtgccctctgtgcaggacaccgtgcgcaagtacctggagtcggtccggcccatcctctccgacgaggacttcgactggaccgcggtcctggcgcaggaattcctgaggctgcaggcgtcgctgctgcagtggtacctgcggctcaagtcctggtgggcgtccaattatgtcagtgactggtgggaggaatttgtgtacctgcgctcccgaaatccgctgatggtgaacagcaactattacatgatggacttcctgtatgtcacacccacgcctctgcaggcagctcgcgctgggaatgccgtccatgccctcctcctgtaccgccaccgcctgaaccgccaggagatacccccggtgagagggccccagtgggttagggatggaggtgtggtcctgtggcctttgggccacgtgggtcctggaaggcagctcacagcccacggtttcctgcagactttgctgatgggaatgcgccccttatgctctgcccagtacgagaagatcttcaacaccacgcggattccaggggtccaaaaagactacatccgccacctccatgacagccaacacgtggctgtcttccaccggggccgattcttccgcatggggacccactcccgaaacagcctgctttccccgagagccctggagcagcagtttcagagaatcctggatgatccctcaccggcctgcccccacgaggaacatctggcagctctgacagctgctcccaggggcacgtgggcccaggtgcggacatccctgaagacccaggcagcggaggccctggaggcggtggaaggggccgctttctttgtgtcactggatgctgagcccgcggggctcaccagggaggacccggcagcgtcgttggatgcctacgcccatgctctgctggccggccggggccatgatcgctggtttgacaaatccttcaccctaatcgtcttctctaacgggaagctgggcctcagcgtggagcactcctgggccgactgccccatctcaggacacatgtgggagttcactctggctacagaatgctttcagctgggctactcaacagacggccactgcaaggggcacccggaccccacactaccccagccccagcggctgcaatgggaccttccagaccagatccactcctccatctctctagccctgaggggagccaagatcttgtctgaaaatgtcgactgccatgtcgttccattctccctatttggcaagagcttcatccgacgctgccacctctcttcagacagcttcatccagatcgccttgcaactggcccacttccgggtcagttgggttccccatccacagcccccgcagggtctcagtccacctgagcccccaagacctgcccctccacggttccttgtggtcgctgccattgtgggtcggccatcttgaattctctcttccaaccattcttgggctggctgg

SEQ ID NO: 4662 - DNA, 2743 bp, Homo sapiens
ggggtttctgggtgacggtgatctcggggtgggcaggactccaaaggcccgtcgacccggtggtggactccttgcactgggattggacatatgcaagcgggagatttggggccggcgctcaaaatcggggggcgggggtggactcgggtttggaccccaggatccgatcagcggacccttgattcaacgtgggctccagcgtgacatggctgaagcgcaccaggccgtgggcttccgaccctcgctgacctcggacggggctgaagtggaactcagtgcccctgtgctgcaggagatctacctctctggcctgcgctcctggaaaaggcatctctcacgtttctggaatgactttctcaccggtgtgtttcctgccagccccctcagttggcttttcctcttcagtgccatccagcttgcctggttcctccagctggatccttccttaggactgatggagaagatcaaagagttgctgcctgactggggtggacaacaccacgggctccggggggtcctggcagccgcgctgtttgcctcgtgtttgtggggagccctgatcttcacactgcacgtggccctgaggctgcttctgtcctaccacggctggcttcttgagccccacggagccatgtcctcccccaccaagacctggctggccctggtccgcatcttctctggccgccacccgatgctgttcagttaccagcgctccctgccacgccagcccgtgccctctgtgcaggacaccgtgcgcaagtacctggagtcggtccggcccatcctctccgacgaggacttcgactggaccgcggtcctggcgcaggaattcctgaggctgcaggcgtcgctgctgcagtggtacctgcggctcaagtcctggtgggcgtccaattatgtcagtgactggtgggaggaatttgtgtacctgcgctcccgaaatccgctgatggtgaacagcaactattacatgatggacttcctgtatgtcacacccacgcctctgcaggcagctcgcgctgggaatgccgtccatgccctcctcctgtaccgccaccgcctgaaccgccaggagatacccccgactttgctgatgggaatgcgccccttatgctctgcccagtacgagaagatcttcaacaccacgcggattccaggggtccaaaaagactacatccgccacctccatgacagccaacacgtggctgtcttccaccggggccgattcttccgcatggggacccactcccgaaacagcctgctttccccgagagccctggagcagcagtttcagagaatcctggatgatccctcaccggcctgcccccacgaggaacatctggcagctctgacagctgctcccaggggcacgtgggcccaggtgcggacatccctgaagacccaggcagcggaggccctggaggcggtggaaggggccgctttctttgtgtcactggatgctgagcccgcggggctcaccagggaggacccggcagcgtcgttggatgcctacgcccatgctctgctggccggccggggccatgatcgctggtttgacaaatccttcaccctaatcgtcttctctaacgggaagctgggcctcagcgtggagcactcctgggccgactgccccatctcaggacacatgtgggagttcactctggctacagaatgctttcagctgggctactcaacagacggccactgcaaggggcacccggaccccacactaccccagccccagcggctgcaatgggaccttccagaccagatccactcctccatctctctagccctgaggggagccaagatcttgtctgaaaatgtcgactgccatgtcgttccattctccctatttggcaagagcttcatccgacgctgccacctctcttcagacagcttcatccagatcgccttgcaactggcccacttccgggacaggggtcaattctgcctgacttatgagtcggccatgactcgcttattcctggaaggccggacggagacggtgcggtcttgcacgagggaggcctgcaactttgtcagggccatggaggacaaagagaagacggacccacagtgcctcgccctgttccgcgtggcagtggacaagcaccaggctctgctgaaggcagccatgagcgggcagggagttgaccgccacctgtttgcgctgtacatcgtgtcccgattcctccacctgcagtcgcccttcctgacccaggtccattcggagcagtggcagctgtccaccagccagatccctgttcagcaaatgcatctgtttgacgtccacaattacccggactatgtttcctcaggcggtggattcgggcctgctgatgaccatggttatggtgtttcttatatcttcatgggggatggcatgatcaccttccacatctccagcaaaaaatcaagcacaaaaacggattcccacaggctggggcagcacattgaggacgcactgctggatgtggcctccctgttccaggcgggacagcattttaagcgccggttcagagggtcagggaaggagaactccaggcacaggtgtggatttctctcccgccagactggggcctccaaggcctcaatgacatccaccgacttctgactccttccagcaggcagctggcctctccaaggaataagggtgaaattgccacagctggctgacacaggacaggggcaactggtttggcaaccccacatccaggccaataaagatgtgtgagctggg

SEQ ID NO: 4663 - DNA, 2500 bp, Homo sapiens
gagagagaggaatcggggtttctgggtgacggtgatctcggggtgggcaggactccaaaggcccgtcgacccggtggtggactccttgcactgggattggacatatgcaagcgggagatttggggccggcgctcaaaatcggggggcgggggtggactcgggtttggaccccaggatccgatcagcggacccttgattcaacgtgaggtcccgaattgacgtccttccctcaaaacctccgggtctacaaaccaggaccctcaagacccttcagggctccagcgtgacatggctgaagcgcaccaggccgtgggcttccgaccctcgctgacctcggacggggctgaagtggaactcagtgcccctgtgctgcaggagatctacctctctggcctgcgctcctggaaaaggcatctctcacgtttctggaatgactttctcaccggtgtgtttcctgccagccccctcagttggcttttcctcttcagtgccatccagcttgcctggttcctccagctggatccttccttaggactgatggagaagatcaaagagttgctgcctgactggggtggacaacaccacgggctccggggggtcctggcagccgcgctgtttgcctcgtgtttgtggggagccctgatcttcacactgcacgtggccctgaggctgcttctgtcctaccacggctggcttcttgagccccacggagccatgtcctcccccaccaagacctggctggccctggtccgcatcttctctggccgccacccgatgctgttcagttaccagcgctccctgccacgccagcccgtgccctctgtgcaggacaccgtgcgcaagtacctggagtcggtccggcccatcctctccgacgaggacttcgactggaccgcggtcctggcgcaggaattcctgaggctgcaggcgtcgctgctgcagtggtacctgcggctcaagtcctggtgggcgtccaattatgtcagtgactggtgggaggaatttgtgtacctgcgctcccgaaatccgctgatggtgaacagcaactattacatgatggacttcctgtatgtcacacccacgcctctgcaggcagctcgcgctgggaatgccgtccatgccctcctcctgtaccgccaccgcctgaaccgccaggagatacccccgactttgctgatgggaatgcgccccttatgctctgcccagtacgagaagatcttcaacaccacgcggattccaggggtccaaaaagactacatccgccacctccatgacagccaacacgtggctgtcttccaccggggccgattcttccgcatggggacccactcccgaaacagcctgctttccccgagagccctggagcagcagtttcagagaatcctggatgatccctcaccggcctgcccccacgaggaacatctggcagctctgacagctgctcccaggggcacgtgggcccaggtgcggacatccctgaagacccaggcagcggaggccctggaggcggtggaaggggccgctttctttgtgtcactggatgctgagcccgcggggctcaccagggaggacccggcagcgtcgttggatgcctacgcccatgctctgctggccggccggggccatgatcgctggtttgacaaatccttcaccctaatcgtcttctctaacgggaagctgggcctcagcgtggagcactcctgggccgactgccccatctcaggacacatgtgggagttcactctggctacagaatgctttcagctgggctactcaacagacggccactgcaaggggcacccggaccccacactaccccagccccagcggctgcaatgggaccttccagaccagatccactcctccatctctctagccctgaggggagccaagatcttgtctgaaaatgtcgactgccatgtcgttccattctccctatttggcaagagcttcatccgacgctgccacctctcttcagacagcttcatccagatcgccttgcaactggcccacttccgggacaggggtcaattctgcctgacttatgagtcggccatgactcgcttattcctggaaggccggacggagacggtgcggtcttgcacgagggaggcctgcaactttgtcagggccatggaggacaaagagaagacggctgatgaccatggttatggtgtttcttatatcttcatgggggatggcatgatcaccttccacatctccagcaaaaaatcaagcacaaaaacggattcccacaggctggggcagcacattgaggacgcactgctggatgtggcctccctgttccaggcgggacagcattttaagcgccggttcagagggtcagggaaggagaactccaggcacaggtgtggatttctctcccgccagactggggcctccaaggcctcaatgacatccaccgacttctgactccttccagcaggcagctggcctctccaaggaataagggtgaaattgccacagctggctgacacag

SEQ ID NO: 4664 - DNA, 2910 bp, Homo sapiens
gaatacccggctagggacacgagagagaggaatcggggtttctgggtgacggtgatctcggggtgggcaggactccaaaggcccgtcgacccggtggtggactccttgcactgggattggacatatgcaagcgggagatttggggccggcgctcaaaatcggggggcgggggtggactcgggtttggaccccaggatccgatcagcggacccttgattcaacgtgaggtcccgaattgacgtccttccctcaaaacctccgggtctacaaaccaggaccctcaagacccttcaggtgcttagagaaggatgagctaggttatgtagtcctgggtcggcgcaaaaaggcagctgaaagcggctccagcgtgacatggctgaagcgcaccaggccgtgggcttccgaccctcgctgacctcggacggggctgaagtggaactcagtgcccctgtgctgcaggagatctacctctctggcctgcgctcctggaaaaggcatctctcacgtttctggaatgactttctcaccggtgtgtttcctgccagccccctcagttggcttttcctcttcagtgccatccagcttgcctggttcctccagctggatccttccttaggactgatggagaagatcaaagagttgctgcctgactggggtggacaacaccacgggctccggggggtcctggcagccgcgctgtttgcctcgtgtttgtggggagccctgatcttcacactgcacgtggccctgaggctgcttctgtcctaccacggctggcttcttgagccccacggagccatgtcctcccccaccaagacctggctggccctggtccgcatcttctctggccgccacccgatgctgttcagttaccagcgctccctgccacgccagcccgtgccctctgtgcaggacaccgtgcgcaagtacctggagtcggtccggcccatcctctccgacgaggacttcgactggaccgcggtcctggcgcaggaattcctgaggctgcaggcgtcgctgctgcagtggtacctgcggctcaagtcctggtgggcgtccaattatgtcagtgactggtgggaggaatttgtgtacctgcgctcccgaaatccgctgatggtgaacagcaactattacatgatggacttcctgtatgtcacacccacgcctctgcaggcagctcgcgctgggaatgccgtccatgccctcctcctgtaccgccaccgcctgaaccgccaggagatacccccgactttgctgatgggaatgcgccccttatgctctgcccagtacgagaagatcttcaacaccacgcggattccaggggtccaaaaagactacatccgccacctccatgacagccaacacgtggctgtcttccaccggggccgattcttccgcatggggacccactcccgaaacagcctgctttccccgagagccctggagcagcagtttcagagaatcctggatgatccctcaccggcctgcccccacgaggaacatctggcagctctgacagctgctcccaggggcacgtgggcccaggtgcggacatccctgaagacccaggcagcggaggccctggaggcggtggaaggggccgctttctttgtgtcactggatgctgagcccgcggggctcaccagggaggacccggcagcgtcgttggatgcctacgcccatgctctgctggccggccggggccatgatcgctggtttgacaaatccttcaccctaatcgtcttctctaacgggaagctgggcctcagcgtggagcactcctgggccgactgccccatctcaggacacatgtgggagttcactctggctacagaatgctttcagctgggctactcaacagacggccactgcaaggggcacccggaccccacactaccccagccccagcggctgcaatgggaccttccagaccagatccactcctccatctctctagccctgaggggagccaagatcttgtctgaaaatgtcgactgccatgtcgttccattctccctatttggcaagagcttcatccgacgctgccacctctcttcagacagcttcatccagatcgccttgcaactggcccacttccgggacaggggtcaattctgcctgacttatgagtcggccatgactcgcttattcctggaaggccggacggagacggtgcggtcttgcacgagggaggcctgcaactttgtcagggccatggaggacaaagagaagacggacccacagtgcctcgccctgttccgcgtggcagtggacaagcaccaggctctgctgaaggcagccatgagcgggcagggagttgaccgccacctgtttgcgctgtacatcgtgtcccgattcctccacctgcagtcgcccttcctgacccaggtccattcggagcagtggcagctgtccaccagccagatccctgttcagcaaatgcatctgtttgacgtccacaattacccggactatgtttcctcaggcggtggattcgggcctgctgatgaccatggttatggtgtttcttatatcttcatgggggatggcatgatcaccttccacatctccagcaaaaaatcaagcacaaaaacggattcccacaggctggggcagcacattgaggacgcactgctggatgtggcctccctgttccaggcgggacagcattttaagcgccggttcagagggtcagggaaggagaactccaggcacaggtgtggatttctctcccgccagactggggcctccaaggcctcaatgacatccaccgacttctgactccttccagcaggcagctggcctctccaaggaataagggtgaaattgccacagctggctgacacaggacaggggcaactggtttggcaaccccacatccaggccaataaagatgtgtgagctggg

SEQ ID NO: 4665 - DNA, 2785 bp, Homo sapiens
ggaatcggggtttctgggtgacggtgatctcggggtgggcaggactccaaaggcccgtcgacccggtggtggactccttgcactgggattggacatatgcaagcgggagatttggggccggcgctcaaaatcggggggcgggggtggactcgggtttggaccccaggatccgatcagcggacccttgattcaacgtgaggtcccgaattgacgtccttccctcaaaacctccgggtctacaaaccaggaccctcaagacccttcagggctccagcgtgacatggctgaagcgcaccaggccgtgggcttccgaccctcgctgacctcggacggggctgaagtggaactcagtgcccctgtgctgcaggagatctacctctctggcctgcgctcctggaaaaggcatctctcacgtttctggaatgactttctcaccggtgtgtttcctgccagccccctcagttggcttttcctcttcagtgccatccagcttgcctggttcctccagctggatccttccttaggactgatggagaagatcaaagagttgctgcctgactggggtggacaacaccacgggctccggggggtcctggcagccgcgctgtttgcctcgtgtttgtggggagccctgatcttcacactgcacgtggccctgaggctgcttctgtcctaccacggctggcttcttgagccccacggagccatgtcctcccccaccaagacctggctggccctggtccgcatcttctctggccgccacccgatgctgttcagttaccagcgctccctgccacgccagcccgtgccctctgtgcaggacaccgtgcgcaagtacctggagtcggtccggcccatcctctccgacgaggacttcgactggaccgcggtcctggcgcaggaattcctgaggctgcaggcgtcgctgctgcagtggtacctgcggctcaagtcctggtgggcgtccaattatgtcagtgactggtgggaggaatttgtgtacctgcgctcccgaaatccgctgatggtgaacagcaactattacatgatggcagctcgcgctgggaatgccgtccatgccctcctcctgtaccgccaccgcctgaaccgccaggagatacccccgactttgctgatgggaatgcgccccttatgctctgcccagtacgagaagatcttcaacaccacgcggattccaggggtccaaaaagactacatccgccacctccatgacagccaacacgtggctgtcttccaccggggccgattcttccgcatggggacccactcccgaaacagcctgctttccccgagagccctggagcagcagtttcagagaatcctggatgatccctcaccggcctgcccccacgaggaacatctggcagctctgacagctgctcccaggggcacgtgggcccaggtgcggacatccctgaagacccaggcagcggaggccctggaggcggtggaaggggccgctttctttgtgtcactggatgctgagcccgcggggctcaccagggaggacccggcagcgtcgttggatgcctacgcccatgctctgctggccggccggggccatgatcgctggtttgacaaatccttcaccctaatcgtcttctctaacgggaagctgggcctcagcgtggagcactcctgggccgactgccccatctcaggacacatgtgggagttcactctggctacagaatgctttcagctgggctactcaacagacggccactgcaaggggcacccggaccccacactaccccagccccagcggctgcaatgggaccttccagaccagatccactcctccatctctctagccctgaggggagccaagatcttgtctgaaaatgtcgactgccatgtcgttccattctccctatttggcaagagcttcatccgacgctgccacctctcttcagacagcttcatccagatcgccttgcaactggcccacttccgggacaggggtcaattctgcctgacttatgagtcggccatgactcgcttattcctggaaggccggacggagacggtgcggtcttgcacgagggaggcctgcaactttgtcagggccatggaggacaaagagaagacggacccacagtgcctcgccctgttccgcgtggcagtggacaagcaccaggctctgctgaaggcagccatgagcgggcagggagttgaccgccacctgtttgcgctgtacatcgtgtcccgattcctccacctgcagtcgcccttcctgacccaggtccattcggagcagtggcagctgtccaccagccagatccctgttcagcaaatgcatctgtttgacgtccacaattacccggactatgtttcctcaggcggtggattcgggcctgctgatgaccatggttatggtgtttcttatatcttcatgggggatggcatgatcaccttccacatctccagcaaaaaatcaagcacaaaaacggattcccacaggctggggcagcacattgaggacgcactgctggatgtggcctccctgttccaggcgggacagcattttaagcgccggttcagagggtcagggaaggagaactccaggcacaggtgtggatttctctcccgccagactggggcctccaaggcctcaatgacatccaccgacttctgactccttccagcaggcagctggcctctccaaggaataagggtgaaattgccacagctggctgacacaggacaggggcaactggtttggcaaccccacatccaggccaataaagatgtgtgagctggg

SEQ ID NO: 4666 - DNA, 2767 bp, Homo sapiens
gagagagaggaatcggggtttctgggtgacggtgatctcggggtgggcaggactccaaaggcccgtcgacccggtggtggactccttgcactgggattggacatatgcaagcgggagatttggggccggcgctcaaaatcggggggcgggggtggactcgggtttggaccccaggatccgatcagcggacccttgattcaacgtgaggtcccgaattgacgtccttccctcaaaacctccgggtctacaaaccaggaccctcaagacccttcagggctccagcgtgacatggctgaagcgcaccaggccgtgggcttccgaccctcgctgacctcggacggggctgaagtggaactcagtgcccctgtgctgcaggagatctacctctctggcctgcgctcctggaaaaggcatctctcacgtttctggaatgactttctcaccggtgtgtttcctgccagccccctcagttggcttttcctcttcagtgccatccagcttgcctggttcctccagctggatccttccttaggactgatggagaagatcaaagagttgctgcctgactggggtggacaacaccacgggctccggggggtcctggcagccgcgctgtttgcctcgtgtttgtggggagccctgatcttcacactgcacgtggccctgaggctgcttctgtcctaccacggctggcttcttgagccccacggagccatgtcctcccccaccaagacctggctggccctggtccgcatcttctctggccgccacccgatgctgttcagttaccagcgctccctgccacgccagcccgtgccctctgtgcaggacaccgtgcgcaagtacctggagtcggtccggcccatcctctccgacgaggacttcgactggaccgcggtcctggcgcaggaattcctgaggctgcaggcgtcgctgctgcagtggtacctgcggctcaagtcctggtgggcgtccaattatgtcagtgactggtgggaggaatttgtgtacctgcgctcccgaaatccgctgatggtgaacagcaactattacatgatggacttcctgtatgtcacacccacgcctctgcaggcagctcgcgctgggaatgccgtccatgccctcctcctgtaccgccaccgcctgaaccgccaggagatacccccgactttgctgatgggaatgcgccccttatgctctgcccagtacgagaagatcttcaacaccacgcggattccaggggtccaaaaagactacatccgccacctccatgacagccaacacgtggctgtcttccaccggggccgattcttccgcatggggacccactcccgaaacagcctgctttccccgagagccctggagcagcagtttcagagaatcctggatgatccctcaccggcctgcccccacgaggaacatctggcagctctgacagctgctcccaggggcacgtgggcccaggtgcggacatccctgaagacccaggcagcggaggccctggaggcggtggaaggggccgctttctttgtgtcactggatgctgagcccgcggggctcaccagggaggacccggcagcgtcgttggatgcctacgcccatgctctgctggccggccggggccatgatcgctggtttgacaaatccttcaccctaatcgtcttctctaacgggaagctgggcctcagcgtggagcactcctgggccgactgccccatctcaggacacatgtgggagttcactctggctacagaatgctttcagctgggctactcaacagacggccactgcaaggggcacccggaccccacactaccccagccccagcggctgcaatgggaccttccagaccagatccactcctccatctctctagccctgaggggagccaagatcttgtctgaaaatgtcgactgccatgtcgttccattctccctatttggcaagagcttcatccgacgctgccacctctcttcagacagcttcatccagatcgccttgcaactggcccacttccgggacaggggtcaattctgcctgacttatgagtcggccatgactcgcttattcctggaaggccggacggagacggtgcggtcttgcacgagggaggcctgcaactttgtcagggccatggaggacaaagagaagacggacccacagtgcctcgccctgttccgcgtggcagtggacaagcaccaggctctgctgaaggcagccatgagcgggcagggagttgaccgccacctgtttgcgctgtacatcgtgtcccgattcctccacctgcagtcgcccttcctgacccaggtccattcggagcagtggcagctgtccaccagccagatccctgttcagcaaatgcatctgtttgacgtccacaattacccggactatgtttcctcaggcggtggattcgggcctgctgatgaccatggttatggtgtttcttatatcttcatgggggatggcatgatcaccttccacatctccagcaaaaaatcaagcacaaaaacggattcccacaggctggggcagcacattgaggacgcactgctggatgtggcctccctgttccaggcgggacagcattttaagcgccggttcagagggtcagggaaggagaactccaggcacaggtgtggatttctctcccgccagactggggcctccaaggcctcaatgacatccaccgacttctgactccttccagcaggcagctggcctctccaaggaataagggtgaaattgccacagctggctgacacag

SEQ ID NO: 4667 - DNA, 2215 bp, Homo sapiens
gcattgtctcttcctctgcagttgagctgaatgaatacctccgaagccgctttgttctccagatgtgaatagctccactataccagcctcgtcttccttccgggggacaacgtgggtcagggcacagagagatatttaatgtcaccctcttggggctttcatgggactccctctgccacattttttggaggttgggaaagttgctagaggcttcagaactccagcctaatggatcccaaactcgggagaatggctgcgtccctgctggctgtgctgctgctgctgctggagcgcggcatgttctcctcaccctccccgcccccggcgctgttagagaaagtcttccagtacattgacctccatcaggatgaatttgtgcagacgctgaaggagtgggtggccatcgagagcgactctgtccagcctgtgcctcgcttcagacaagagctcttcagaatgatggccgtggctgcggacacgctgcagcgcctgggggcccgtgtggcctcggtggacatgggtcctcagcagctgcccgatggtcagagtcttccaatacctcccatcatcctggccgaactggggagcgatcccacgaaaggcaccgtgtgcttctacggccacttggacgtgcagcctgctgaccggggcgatgggtggctcacggacccctatgtgctgacggaggtagacgggaaactttatggacgaggagcgaccgacaacaaaggccctgtcttggcttggatcaatgctgtgagcgccttcagagccctggagcaagatcttcctgtgaatatcaaattcatcattgaggggatggaagaggctggctctgttgccctggaggaacttgtggaaaaagaaaaggaccgattcttctctggtgtggactacattgtaatttcagataacctgtggatcagccaaaggaagccagcaatcacttacggaacccgggggaacagctacttcatggtggaggtgaaatgcagagaccaggattttcactcaggaacctttggtggcatccttcatgaaccaatggctgatctggttgctcttctcggtagcctggtagactcgtctggtcatatcctggtccctggaatctatgatgaagtggttcctcttacagaagaggaaataaatacatacaaagccatccatctagacctagaagaataccggaatagcagccgggttgagaaatttctgttcgatactaaggaggagattctaatgcacctctggaggtacccatctctttctattcatgggatcgagggcgcgtttgatgagcctggaactaaaacagtcatacctggccgagttataggaaaattttcaatccgtctagtccctcacatgaatgtgtctgcggtggaaaaacaggtgacacgacatcttgaagatgtgttctccaaaagaaatagttccaacaagatggttgtttccatgactctaggactacacccgtggattgcaaatattgatgacacccagtatctcgcagcaaaaagagcgatcagaacagtgtttggaacagaaccagatatgatccgggatggatccaccattccaattgccaaaatgttccaggagatcgtccacaagagcgtggtgctaattccgctgggagctgttgatgatggagaacattcgcagaatgagaaaatcaacaggtggaactacatagagggaaccaaattatttgctgcctttttcttagagatggcccagctccattaatcacaagaaccttctagtctgatctgatccactgacagattcacctcccccacatccctagacagggatggaatgtaaatatccagagaatttgggtctagtatagtacattttcccttccatttaaaatgtcttgggatatctggatcagtaataaaatatttcaaaggcacagatgttggaaatggtttaaggtcccccactgcacaccttcctcaagtcatagctgcttgcagcaacttgatttccccaagtcctgtgcaatagccccaggattggattccttcaaaccttttagcatatctccaaccttgcaatttgattggcataatcactccagtttgctttctaggtcctcaagtgctcgtgacacataatcattccatccaatgatcgcctttgctttaccactctttccttttatcttattaataaaaatgttggtctccaccactgactacaa

SEQ ID NO: 4668 - DNA, 3942 bp, Homo sapiens
gctgtgccactgccaccgccgccgccgctgcatcccgcccggtccgagtccgcccgccacgcccgccgagccgctgccgccgccagctctccctggatccatcgggtcccgagtgggattgcccactgggctccaaggacctggaggaagagggcccctggggagggggctctggcctgccgcccacaggctgcttccctggctcctggcgccaggacgtgggcctggactgcaagggatcccccgagggggccgaggcccgggcttggactgtctactactacagcctcctgcagagctgtctgcagcaagctggccttccggagactcaggaccgcggccaggtgccccgcacaggctgtcctggggcggaggtgaccttgtgcgttctgggctcccccagcacctttctgcctgtgctgctggagggtggggtccagagcccgggaaacatgctcctttgcctgtcccctgcttggctgatgaaggtgccagcacccgggcagccgggtgaggcagccctgctagtctccaaggctgtgagcttccaccctgggggcctgacattcctggatgactttgtccccccgcgccgtgccacctactttttggcaggcctgggcctggggcctggccggggccgagaggcagcagaactcgcccgtgacctgacctgccccacaggagcttcggctgagctggcccggctgctggaggaccggctgctgacaaggcagttgctggcccagcagggtggtgtggctgtgccagcaaccctggctttcacctacaagccgccggggctgctgcggggaggggatgccagcctagggctacggctggtggagctgagtggcaaagagggccaggagacgctggtgaaagaggaagtggaggcttttctgcgctccgaggccctgggtgatatcctgcaggtagctgtgaagctcagtggctggcgctggcgggggcggcaggcatggcgtctgcacccgcgggcagagctgggtgcagtggtggacacagtgctggcgctgctggagaagctggaggaggaggagagtgtcctggtggaggctgtgtacccacctgcccagctgccctgctcagatggtccttcacccggccccggcctggccgtgcgaatctgtgctgtggtgtgtcggacacagggtgataggccactgctgagcaaggtggtgtgcggcgtgggccgcggggaccgccctctacggcaccacaactccctgccgaggacgctggaggtggcgctggcccagtgcggcctgggcgaggaggcgcaggtggcggctgtgcggcagcgcgtcaaggcggcggccgaggccgcgctggccgccgtgctggctctggaggccggcctgagtgccgagcagcgcggcgggcgccgggcgcacacggacttcctgggcgtggatttcgcgctgacagcggccggcggcgtgctgaccccagtggccctggagctgaacggcggcctgtgtctggaggcgtgcggcgcgctggaggggctgtgggccgcgccgcggctggggccggcggccgacgaggcggtggcggcgccgctggtggagaccatgcttcggcggtcggcgcgctgcctcatggagggaaaacagctgctggtggtcggcgctggcggcgtcagcaagaagttcgtgtgggaggcggcgcgcgactacgggctccagctgcacctcgtggagtcagaccccaaccactttgcatcccagttggtacagaccttcatccactttgacatgacagagcaccggagggatgaggagaacgcacggctgctggcagagttggtgcgggctcgcggcctcaagctagatggctgcttctcctactgggatgactgcctggtgctcacagccctgctctgccaggagctaggtctgccctgcagctccccagctgccatgcgcctggctaagcagaagagcctcacccagctgcacctgttgcaccaccatggcccaccctggcctgcgccctccctccatgctgtgccctgctgcccactggagagtgaggctgatgtggagagggccgtgcaccaggtacccctgccaggtgtcatgaagctggagttcggggcaggtgcagtgggtgtccggctggtagaggatgcgccacagtgccatgagcacttttcccggattacccgagacttgcagggcgaggccgaccacccaggcattgggctgggctggggcaatgccatgctgctgatggagtttgtggagggcaccgagcacgacgtggacctggtgttgtttggtgggcggttgctggctgcctttgtctccgacaatggccctacgaggctgcctggcttcactgagacggcggcctgcatgcccaccgggctggcaccagagcaggaggcacagatggttcaggcagccttccgctgttgcctgggctgcgggttgctcgatggagtcttcaacgtggagctcaagctgaccggggctgggcctcggcttatcgagatcaacccccgcatgggtggcttctacctgcgtgattggatcctggagctctatggtgttgacctgctgctggctgctgttatggtggcctgtggcttgcgtcctgccctgcccacccgcccacgtgctcgtggccatctggtgggcgtcatgtgccttgtgtcccagcacctgcaggccctgagttccaccgccagccgtgagaccctgcaggccctgcacgaccgtggactgctacgcctcaatctgctggaggaggccctggtgcctggcgagtatgaggagccctactgcagtgtggcctgtgccggacccagccccaccgaggcccgtctccgcctgctgggcctctgccagggcctgggcatcgatgggcccagctaccctgttgcccacttcctgtctcacttcaaatagcactggggtcagggggcagggaagcagtgctgggtggaggcactgtggtgccctctgctccctggagctcttcctgcttctctccccatcaccatgccccagccccagcctggcccgctgcaatgcctaggtctgttccagagcagcagggcaatttagacaccaaggcatcctggactcaagggcctcttgccctcccgaaggccccagtccagcctacagcttccccagcattctagccttggagaaatgacaatggccacacacacacacacacacacacacacacacctctgacgccagctccccaggtgggagtgggcccaaacccagcccctcctgtccacctctccaggtctcactctcttcctgccatctacaagaggagaggacctggctgggccccaagccttggacaaatcctgggaaaacctgagactagaacccttgtcttcctcttacccaaattctaggatagctctgaagcctgctggaaacttggtggcatccaacctgcctcattcggcctgaccggtagaggcaggtggcctgtggacagaagtaatcctctttctgctcaccccaggcagacacaactgcctatgttcccccgatgagaggaaacaggctgagagaagaaaaatgactgctccaggattataccacagtggagagcgggtcacaggacatgatgcagggtccaggtttctgttttgatcaagtcttacatgcccattcagcttctaggcccccctcacctccctgccctcattcacaagtggccctgagacacgtgaacacctccctcctatgcatcacaaaccttctccaccgagctttggtgctttggcctctggcacacctaactagcattggcagaggagagtctacactctcttcctcattcagggaagatgctttaagaaatcctgcctctgtgcagcagaggagctggaggcagctccccaggcatccctccccaaataaaggcttatgtactggtgaa

SEQ ID NO: 4669 - DNA, 3967 bp, Homo sapiens
gctgtgccactgccaccgccgccgccgctgcatcccgcccggtccgagtccgcccgccacgcccgccgagccgctgccgccgccagtctctcagccactccacccacgagatgctctccctggatccatcgggtcccgagtgggattgcccactgggctccaaggacctggaggaagagggcccctggggagggggctctggcctgccgcccacaggctgcttccctggctcctggcgccaggacgtgggcctggactgcaagggatcccccgagggggccgaggcccgggcttggactgtctactactacagcctcctgcagagctgtctgcagcaagctggccttccggagactcaggaccgcggccaggtgccccgcacaggctgtcctggggcggaggtgaccttgtgcgttctgggctcccccagcacctttctgcctgtgctgctggagggtggggtccagagcccgggaaacatgctcctttgcctgtcccctgcttggctgatgaaggtgccagcacccgggcagccgggtgaggcagccctgctagtctccaaggctgtgagcttccaccctgggggcctgacattcctggatgactttgtccccccgcgccgtgccacctactttttggcaggcctgggcctggggcctggccggggccgagaggcagcagaactcgcccgtgacctgacctgccccacaggagcttcggctgagctggcccggctgctggaggaccggctgctgacaaggcagttgctggcccagcagggtggtgtggctgtgccagcaaccctggctttcacctacaagccgccggggctgctgcggggaggggatgccagcctagggctacggctggtggagctgagtggcaaagagggccaggagacgctggtgaaagaggaagtggaggcttttctgcgctccgaggccctgggtgatatcctgcaggtagctgtgaagctcagtggctggcgctggcgggggcggcaggcatggcgtctgcacccgcgggcagagctgggtgcagtggtggacacagtgctggcgctgctggagaagctggaggaggaggagagtgtcctggtggaggctgtgtacccacctgcccagctgccctgctcagatggtccttcacccggccccggcctggccgtgcgaatctgtgctgtggtgtgtcggacacagggtgataggccactgctgagcaaggtggtgtgcggcgtgggccgcggggaccgccctctacggcaccacaactccctgccgaggacgctggaggtggcgctggcccagtgcggcctgggcgaggaggcgcaggtggcggctgtgcggcagcgcgtcaaggcggcggccgaggccgcgctggccgccgtgctggctctggaggccggcctgagtgccgagcagcgcggcgggcgccgggcgcacacggacttcctgggcgtggatttcgcgctgacagcggccggcggcgtgctgaccccagtggccctggagctgaacggcggcctgtgtctggaggcgtgcggcgcgctggaggggctgtgggccgcgccgcggctggggccggcggccgacgaggcggtggcggcgccgctggtggagaccatgcttcggcggtcggcgcgctgcctcatggagggaaaacagctgctggtggtcggcgctggcggcgtcagcaagaagttcgtgtgggaggcggcgcgcgactacgggctccagctgcacctcgtggagtcagaccccaaccactttgcatcccagttggtacagaccttcatccactttgacatgacagagcaccggagggatgaggagaacgcacggctgctggcagagttggtgcgggctcgcggcctcaagctagatggctgcttctcctactgggatgactgcctggtgctcacagccctgctctgccaggagctaggtctgccctgcagctccccagctgccatgcgcctggctaagcagaagagcctcacccagctgcacctgttgcaccaccatggcccaccctggcctgcgccctccctccatgctgtgccctgctgcccactggagagtgaggctgatgtggagagggccgtgcaccaggtacccctgccaggtgtcatgaagctggagttcggggcaggtgcagtgggtgtccggctggtagaggatgcgccacagtgccatgagcacttttcccggattacccgagacttgcagggcgaggccgaccacccaggcattgggctgggctggggcaatgccatgctgctgatggagtttgtggagggcaccgagcacgacgtggacctggtgttgtttggtgggcggttgctggctgcctttgtctccgacaatggccctacgaggctgcctggcttcactgagacggcggcctgcatgcccaccgggctggcaccagagcaggaggcacagatggttcaggcagccttccgctgttgcctgggctgcgggttgctcgatggagtcttcaacgtggagctcaagctgaccggggctgggcctcggcttatcgagatcaacccccgcatgggtggcttctacctgcgtgattggatcctggagctctatggtgttgacctgctgctggctgctgttatggtggcctgtggcttgcgtcctgccctgcccacccgcccacgtgctcgtggccatctggtgggcgtcatgtgccttgtgtcccagcacctgcaggccctgagttccaccgccagccgtgagaccctgcaggccctgcacgaccgtggactgctacgcctcaatctgctggaggaggccctggtgcctggcgagtatgaggagccctactgcagtgtggcctgtgccggacccagccccaccgaggcccgtctccgcctgctgggcctctgccagggcctgggcatcgatgggcccagctaccctgttgcccacttcctgtctcacttcaaatagcactggggtcagggggcagggaagcagtgctgggtggaggcactgtggtgccctctgctccctggagctcttcctgcttctctccccatcaccatgccccagccccagcctggcccgctgcaatgcctaggtctgttccagagcagcagggcaatttagacaccaaggcatcctggactcaagggcctcttgccctcccgaaggccccagtccagcctacagcttccccagcattctagccttggagaaatgacaatggccacacacacacacacacacacacacacacacctctgacgccagctccccaggtgggagtgggcccaaacccagcccctcctgtccacctctccaggtctcactctcttcctgccatctacaagaggagaggacctggctgggccccaagccttggacaaatcctgggaaaacctgagactagaacccttgtcttcctcttacccaaattctaggatagctctgaagcctgctggaaacttggtggcatccaacctgcctcattcggcctgaccggtagaggcaggtggcctgtggacagaagtaatcctctttctgctcaccccaggcagacacaactgcctatgttcccccgatgagaggaaacaggctgagagaagaaaaatgactgctccaggattataccacagtggagagcgggtcacaggacatgatgcagggtccaggtttctgttttgatcaagtcttacatgcccattcagcttctaggcccccctcacctccctgccctcattcacaagtggccctgagacacgtgaacacctccctcctatgcatcacaaaccttctccaccgagctttggtgctttggcctctggcacacctaactagcattggcagaggagagtctacactctcttcctcattcagggaagatgctttaagaaatcctgcctctgtgcagcagaggagctggaggcagctccccaggcatccctccccaaataaaggcttatgtactggtg

SEQ ID NO: 4670 - DNA, 3971 bp, Homo sapiens
ccactcccaaagtctaggggctggaaggccaggcagggacttggctgccctgactccttcgtctctctgtccctctgtctctgccatcagtctctcagccactccacccacgagatgctctccctggatccatcgggtcccgagtgggattgcccactgggctccaaggacctggaggaagagggcccctggggagggggctctggcctgccgcccacaggctgcttccctggctcctggcgccaggacgtgggcctggactgcaagggatcccccgagggggccgaggcccgggcttggactgtctactactacagcctcctgcagagctgtctgcagcaagctggccttccggagactcaggaccgcggccaggtgccccgcacaggctgtcctggggcggaggtgaccttgtgcgttctgggctcccccagcacctttctgcctgtgctgctggagggtggggtccagagcccgggaaacatgctcctttgcctgtcccctgcttggctgatgaaggtgccagcacccgggcagccgggtgaggcagccctgctagtctccaaggctgtgagcttccaccctgggggcctgacattcctggatgactttgtccccccgcgccgtgccacctactttttggcaggcctgggcctggggcctggccggggccgagaggcagcagaactcgcccgtgacctgacctgccccacaggagcttcggctgagctggcccggctgctggaggaccggctgctgacaaggcagttgctggcccagcagggtggtgtggctgtgccagcaaccctggctttcacctacaagccgccggggctgctgcggggaggggatgccagcctagggctacggctggtggagctgagtggcaaagagggccaggagacgctggtgaaagaggaagtggaggcttttctgcgctccgaggccctgggtgatatcctgcaggtagctgtgaagctcagtggctggcgctggcgggggcggcaggcatggcgtctgcacccgcgggcagagctgggtgcagtggtggacacagtgctggcgctgctggagaagctggaggaggaggagagtgtcctggtggaggctgtgtacccacctgcccagctgccctgctcagatggtccttcacccggccccggcctggccgtgcgaatctgtgctgtggtgtgtcggacacagggtgataggccactgctgagcaaggtggtgtgcggcgtgggccgcggggaccgccctctacggcaccacaactccctgccgaggacgctggaggtggcgctggcccagtgcggcctgggcgaggaggcgcaggtggcggctgtgcggcagcgcgtcaaggcggcggccgaggccgcgctggccgccgtgctggctctggaggccggcctgagtgccgagcagcgcggcgggcgccgggcgcacacggacttcctgggcgtggatttcgcgctgacagcggccggcggcgtgctgaccccagtggccctggagctgaacggcggcctgtgtctggaggcgtgcggcgcgctggaggggctgtgggccgcgccgcggctggggccggcggccgacgaggcggtggcggcgccgctggtggagaccatgcttcggcggtcggcgcgctgcctcatggagggaaaacagctgctggtggtcggcgctggcggcgtcagcaagaagttcgtgtgggaggcggcgcgcgactacgggctccagctgcacctcgtggagtcagaccccaaccactttgcatcccagttggtacagaccttcatccactttgacatgacagagcaccggagggatgaggagaacgcacggctgctggcagagttggtgcgggctcgcggcctcaagctagatggctgcttctcctactgggatgactgcctggtgctcacagccctgctctgccaggagctaggtctgccctgcagctccccagctgccatgcgcctggctaagcagaagagcctcacccagctgcacctgttgcaccaccatggcccaccctggcctgcgccctccctccatgctgtgccctgctgcccactggagagtgaggctgatgtggagagggccgtgcaccaggtacccctgccaggtgtcatgaagctggagttcggggcaggtgcagtgggtgtccggctggtagaggatgcgccacagtgccatgagcacttttcccggattacccgagacttgcagggcgaggccgaccacccaggcattgggctgggctggggcaatgccatgctgctgatggagtttgtggagggcaccgagcacgacgtggacctggtgttgtttggtgggcggttgctggctgcctttgtctccgacaatggccctacgaggctgcctggcttcactgagacggcggcctgcatgcccaccgggctggcaccagagcaggaggcacagatggttcaggcagccttccgctgttgcctgggctgcgggttgctcgatggagtcttcaacgtggagctcaagctgaccggggctgggcctcggcttatcgagatcaacccccgcatgggtggcttctacctgcgtgattggatcctggagctctatggtgttgacctgctgctggctgctgttatggtggcctgtggcttgcgtcctgccctgcccacccgcccacgtgctcgtggccatctggtgggcgtcatgtgccttgtgtcccagcacctgcaggccctgagttccaccgccagccgtgagaccctgcaggccctgcacgaccgtggactgctacgcctcaatctgctggaggaggccctggtgcctggcgagtatgaggagccctactgcagtgtggcctgtgccggacccagccccaccgaggcccgtctccgcctgctgggcctctgccagggcctgggcatcgatgggcccagctaccctgttgcccacttcctgtctcacttcaaatagcactggggtcagggggcagggaagcagtgctgggtggaggcactgtggtgccctctgctccctggagctcttcctgcttctctccccatcaccatgccccagccccagcctggcccgctgcaatgcctaggtctgttccagagcagcagggcaatttagacaccaaggcatcctggactcaagggcctcttgccctcccgaaggccccagtccagcctacagcttccccagcattctagccttggagaaatgacaatggccacacacacacacacacacacacacacacacctctgacgccagctccccaggtgggagtgggcccaaacccagcccctcctgtccacctctccaggtctcactctcttcctgccatctacaagaggagaggacctggctgggccccaagccttggacaaatcctgggaaaacctgagactagaacccttgtcttcctcttacccaaattctaggatagctctgaagcctgctggaaacttggtggcatccaacctgcctcattcggcctgaccggtagaggcaggtggcctgtggacagaagtaatcctctttctgctcaccccaggcagacacaactgcctatgttcccccgatgagaggaaacaggctgagagaagaaaaatgactgctccaggattataccacagtggagagcgggtcacaggacatgatgcagggtccaggtttctgttttgatcaagtcttacatgcccattcagcttctaggcccccctcacctccctgccctcattcacaagtggccctgagacacgtgaacacctccctcctatgcatcacaaaccttctccaccgagctttggtgctttggcctctggcacacctaactagcattggcagaggagagtctacactctcttcctcattcagggaagatgctttaagaaatcctgcctctgtgcagcagaggagctggaggcagctccccaggcatccctccccaaataaaggcttatgtactggtg

SEQ ID NO: 4671 - DNA, 2968 bp, Homo sapiens
gctgtgccactgccaccgccgccgccgctgcatcccgcccggtccgagtccgcccgccacgcccgccgagccgctgccgccgccagtctctcagccactccacccacgagatgctctccctggatccatcgggtcccgagtgggattgcccactgggctccaaggacctggaggaagagggcccctggggagggggctctggcctgccgcccacaggctgcttccctggctcctggcgccaggacgtgggcctggactgcaagggatcccccgagggggccgaggcccgggcttggactgtctactactacagcctcctgcagagctgtctgcagcaagctggccttccggagactcaggaccgcggccaggtgccccgcacaggctgtcctggggcggaggtgaccttgtgcgttctgggctcccccagcacctttctgcctgtgctgctggagggtggggtccagagcccgggaaacatgctcctttgcctgtcccctgcttggctgatgaaggtgccagcacccgggcagccgggtgaggcagccctgctagtctccaaggctgtgagcttccaccctgggggcctgacattcctggatgactttgtccccccgcgccgtgccacctactttttggcaggcctgggcctggggcctggccggggccgagaggcagcagaactcgcccgtgacctgacctgccccacaggagcttcggctgagctggcccggctgctggaggaccggctgctgacaaggcagttgctggcccagcagggtggtgtggctgtgccagcaaccctggctttcacctacaagccgccggggctgctgcggggaggggatgccagcctagggctacggctggtggagctgagtggcaaagagggccaggagacgctggtgaaagaggaagtggaggcttttctgcgctccgaggccctgggtgatatcctgcaggtagctgtgaagctcagtggctggcgctggcgggggcggcaggcatggcgtctgcacccgcgggcagagctgggtgcagtggtggacacagtgctggcgctgctggagaagctggaggaggaggagagtgtcctggtggaggctgtgtacccacctgcccagctgccctgctcagatggtccttcacccggccccggcctggccgtgcgaatctgtgctgtggtgtgtcggacacagggtgataggccactgctgagcaaggtggtgtgcggcgtgggccgcggggaccgccctctacggcaccacaactccctgccgaggacgctggaggccgcgctggccgccgtgctggctctggaggccggcctgagtgccgagcagcgcggcgggcgccgggcgcacacggacttcctgggcgtggatttcgcgctgacagcggccggcggcgtgctgaccccagtggccctggagctgaacggcggcctgtgtctggaggcgtgcggcgcgctggaggggctgtgggccgcgccgcggctggggccggcggccgacgaggcggtggcggcgccgctggtggagaccatgcttcggcggtcggcgcgctgcctcatggagggaaaacagctgctggtggtcggcgctggcggcgtcagcaagaagttcgtgtgggaggcggcgcgcgactacgggctccagctgcacctcgtggagtcagaccccaaccactttgcatcccagttggtacagaccttcatccactttgacatgacagagcaccggagggatgaggagaacgcacggctgctggcagagttggtgcgggctcgcggcctcaagctagatggctgcttctcctactgggatgactgcctggtgctcacagccctgctctgccaggagctaggtctgccctgcagctccccagctgccatgcgcctggctaagcagaagagcctcacccagctgcacctgttgcaccaccatggcccaccctggcctgcgccctccctccatgctgtgccctgctgcccactggagagtgaggctgatgtggagagggccgtgcaccaggtacccctgccaggtgtcatgaagctggagttcggggcaggtgcagtgggtgtccggctggtagaggatgcgccacagtgccatgagcacttttcccggattacccgagacttgcagggcgaggccgaccacccaggcattgggctgggctggggcaatgccatgctgctgatggagtttgtggagggcaccgagcacgacgtggacctggtgttgtttggtgggcggttgctggctgcctttgtctccgacaatggccctacgaggctgcctggcttcactgagacggcggcctgcatgcccaccgggctggcaccagagcaggaggcacagatggttcaggcagccttccgctgttgcctgggctgcgggttgctcgatggagtcttcaacgtggagctcaagctgaccggggctgggcctcggcttatcgagatcaacccccgcatgggtggcttctacctgcgtgattggatcctggagctctatggtgttgacctgctgctggctgctgttatggtggcctgtggcttgcgtcctgccctgcccacccgcccacgtgctcgtggccatctggtgggcgtcatgtgccttgtgtcccagcacctgcaggccctgagttccaccgccagccgtgagaccctgcaggccctgcacgaccgtggactgctacgcctcaatctgctggaggaggccctggtgcctggcgagtatgaggagccctactgcagtgtggcctgtgccggacccagccccaccgaggcccgtctccgcctgctgggcctctgccagggcctgggcatcgatgggcccagctaccctgttgcccacttcctgtctcacttcaaatagcactggggtcagggggcagggaagcagtgctgggtggaggcactgtggtgccctctgctccctggagctcttcctgcttctct

SEQ ID NO: 4672 - DNA, 2369 bp, Homo sapiens
gctgtgccactgccaccgccgccgccgctgcatcccgcccggtccgagtccgcccgccacgcccgccgagccgctgccgccgccagtctctcagccactccacccacgagatggtgagtcttctgtggtccctcccccacaaggcccaagtccctgggcagagagtgggcccagaggacagcaggcagcacctaggacctaagcctgggagttgccccctgcagacagcttagacccacgaccagctcccccacccccaccctgcggctgcatcctgggaggtgggcactcttagtgccctgtgacattcattcattccatggcccctcagggagctcaccttctaggagacggcacagaggctctggccctggcaaactgggattcgagcccaggcatgaggcccagtcctctgccgtctgggccacagcacaccatctcccaacaaccaagagattctcttcgtcccagcctcatcagcccccaggggatgggagagggcaggcaccaggcaacaaggtccaaagagacctcacgacttgctcaaggtggccgagcctgtcccctggaggacagactcagctgccaggcctgtccaggcctggggactgcaaagaacaagaattccattcacacgaagcctcccagcagccccatattgggggggcgccagcctcagagaggggagggacgttaggtttcatccaaagaaagcatttccgtgactcaaaatatctgcaggggggatactgtctagcctcctaatgtttagcccagggctgggcacacagtagggcttcaagacctacgtggggatgacagtggaatcacatttaggtgtcagcacactccatgccgggtcatgagacagaaataagccacctcagagtgatggctgggttcgttcattcatctactcttcagtcaacaaacacttactgagaagtggctgtgtgccaggcacgctttaggtgctggggttgcctccatgaacaaaacaagcagaaaactctgctgctgtgaagcaagctaaggcggagcccagcatggcaggggcgggaggggctggctggcaagacattgcttcctgccctccccccaggggcaccacacagaacagtttacaaagcactcccacggttgcgttcccattaacaagccttcgcccccaacacaagcctttcctctcctagtccccgggacggtgtcagccctgaacatagcccaggctgggagagtggggggcttacacccttgggtgacttaatgtgcccactggcccaccctgcccaagacctaccacttctgccctctcagctctccctggatccatcgggtcccgagtgggattgcccactgggctccaaggacctggaggaagagggcccctggggagggggctctggcctgccgcccacaggctgcttccctggctcctggcgccaggacgtgggcctggactgcaagggatcccccgagggggccgaggcccgggcttggactgtctactactacagcctcctgcagagctgtctgcagcaagctggccttccggagactcaggaccgcggccaggtgccccgcacaggctgtcctggggcggaggtgaccttgtgcgttctgggctcccccagcacctttctgcctgtgctgctggagggtggggtccagagcccgggaaacatgctcctttgcctgtcccctgcttggctgatgaaggtgccagcacccgggcagccgggtgaggcagccctgctagtctccaaggctgtgagcttccaccctgggggcctgacattcctggatgactttgtccccccgcgccgtgccacctactttttggcaggcctgggcctggggcctggccggggccgagaggcagcagaactcgcccgtgacctgacctgccccacaggagcttcggctgagctggcccggctgctggaggaccggctgctgacaaggcagttgctggcccagcagggtggtgtggctgtgccagcaaccctggctttcacctacaagccgccggggctgctgcggggaggggatgccagcctagggctacggctggtggagctgagtggcaaagagggccaggagacgctggtgaaagaggagaggacctggctgggccccaagccttggacaaatcctgggaaaacctgagactagaacccttgtcttcctcttacccaaattctaggatagctctgaagcctgctggaaacttggtggcatccaacctgcctcattcggcctgaccggtagaggcaggtggcctgtggacagaagtaatcctctttctgctcaccccaggcagacacaactgcctatgttcccccgatgagaggaaacaggctgagaga

SEQ ID NO: 4673 - DNA, 2968 bp, Homo sapiens
gctgtgccactgccaccgccgccgccgctgcatcccgcccggtccgagtccgcccgccacgcccgccgagccgctgccgccgccagtctctcagccactccacccacgagatgctctccctggatccatcgggtcccgagtgggattgcccactgggctccaaggacctggaggaagagggcccctggggagggggctctggcctgccgcccacaggctgcttccctggctcctggcgccaggacgtgggcctggactgcaagggatcccccgagggggccgaggcccgggcttggactgtctactactacagcctcctgcagagctgtctgcagcaagctggccttccggagactcaggaccgcggccaggtgccccgcacaggctgtcctggggcggaggtgaccttgtgcgttctgggctcccccagcacctttctgcctgtgctgctggagggtggggtccagagcccgggaaacatgctcctttgcctgtcccctgcttggctgatgaaggtgccagcacccgggcagccgggtgaggcagccctgctagtctccaaggctgtgagcttccaccctgggggcctgacattcctggatgactttgtccccccgcgccgtgccacctactttttggcaggcctgggcctggggcctggccggggccgagaggcagcagaactcgcccgtgacctgacctgccccacaggagcttcggctgagctggcccggctgctggaggaccggctgctgacaaggcagttgctggcccagcagggtggtgtggctgtgccagcaaccctggctttcacctacaagccgccggggctgctgcggggaggggatgccagcctagggctacggctggtggagctgagtggcaaagagggccaggagacgctggtgaaagaggaagtggaggcttttctgcgctccgaggccctgggtgatatcctgcaggtagctgtgaagctcagtggctggcgctggcgggggcggcaggcatggcgtctgcacccgcgggcagagctgggtgcagtggtggacacagtgctggcgctgctggagaagctggaggaggaggagagtgtcctggtggaggctgtgtacccacctgcccagctgccctgctcagatggtccttcacccggccccggcctggccgtgcgaatctgtgctgtggtgtgtcggacacagggtgataggccactgctgagcaaggtggtgtgcggcgtgggccgcggggaccgccctctacggcaccacaactccctgccgaggacgctggaggtggcgctggccgccgtgctggctctggaggccggcctgagtgccgagcagcgcggcgggcgccgggcgcacacggacttcctgggcgtggatttcgcgctgacagcggccggcggcgtgctgaccccagtggccctggagctgaacggcggcctgtgtctggaggcgtgcggcgcgctggaggggctgtgggccgcgccgcggctggggccggcggccgacgaggcggtggcggcgccgctggtggagaccatgcttcggcggtcggcgcgctgcctcatggagggaaaacagctgctggtggtcggcgctggcggcgtcagcaagaagttcgtgtgggaggcggcgcgcgactacgggctccagctgcacctcgtggagtcagaccccaaccactttgcatcccagttggtacagaccttcatccactttgacatgacagagcaccggagggatgaggagaacgcacggctgctggcagagttggtgcgggctcgcggcctcaagctagatggctgcttctcctactgggatgactgcctggtgctcacagccctgctctgccaggagctaggtctgccctgcagctccccagctgccatgcgcctggctaagcagaagagcctcacccagctgcacctgttgcaccaccatggcccaccctggcctgcgccctccctccatgctgtgccctgctgcccactggagagtgaggctgatgtggagagggccgtgcaccaggtacccctgccaggtgtcatgaagctggagttcggggcaggtgcagtgggtgtccggctggtagaggatgcgccacagtgccatgagcacttttcccggattacccgagacttgcagggcgaggccgaccacccaggcattgggctgggctggggcaatgccatgctgctgatggagtttgtggagggcaccgagcacgacgtggacctggtgttgtttggtgggcggttgctggctgcctttgtctccgacaatggccctacgaggctgcctggcttcactgagacggcggcctgcatgcccaccgggctggcaccagagcaggaggcacagatggttcaggcagccttccgctgttgcctgggctgcgggttgctcgatggagtcttcaacgtggagctcaagctgaccggggctgggcctcggcttatcgagatcaacccccgcatgggtggcttctacctgcgtgattggatcctggagctctatggtgttgacctgctgctggctgctgttatggtggcctgtggcttgcgtcctgccctgcccacccgcccacgtgctcgtggccatctggtgggcgtcatgtgccttgtgtcccagcacctgcaggccctgagttccaccgccagccgtgagaccctgcaggccctgcacgaccgtggactgctacgcctcaatctgctggaggaggccctggtgcctggcgagtatgaggagccctactgcagtgtggcctgtgccggacccagccccaccgaggcccgtctccgcctgctgggcctctgccagggcctgggcatcgatgggcccagctaccctgttgcccacttcctgtctcacttcaaatagcactggggtcagggggcagggaagcagtgctgggtggaggcactgtggtgccctctgctccctggagctcttcctgcttctct

SEQ ID NO: 4674 - DNA, 2518 bp, Homo sapiens
aagcactgggcccgccgcgtcgcaccgtcctctttcctttccttctccctccccttttcccttccttcgtcccttccttccttcctttcgccgggcgcgatggagccggggcgccggggggccgcggcgctgctagcgctgctgtgcgtggcctgcgcgctgcgcgccgggcgcgcccaatacgaacgctacagcttccgcagcttcccacgggacgagctgatgccgctcgagtcggcctaccggcacgcgctggacaagtacagcggcgagcactgggccgagagcgtgggctacctggagatcagcctgcggctgcaccgcttgctgcgcgacagcgaggccttctgccaccgcaactgcagcgccgcgccgcagcccgagcccgccgccggcctcgccagctatcccgagctgcgcctcttcgggggcctgctgcgccgcgcgcactgcctcaagcgctgcaagcagggcctgccagccttccgccagtcccagcccagccgcgaggtgctggcggacttccagcgccgcgagccctacaagttcctgcagttcgcttacttcaaggcaaataatctccccaaagccatcgccgctgctcacacctttctactgaagcatcctgatgacgaaatgatgaagaggaacatggcatattataagagcctgcctggtgccgaggactacattaaagacctggaaaccaagtcatatgaaagcctgttcatccgagcagtgcgggcatacaacggtgagaactggagaacatccatcacagacatggagctggcccttcccgacttcttcaaagccttttacgagtgtctcgcagcctgcgagggttccagggagatcaaggacttcaaggatttctacctttccatagcagatcattatgtagaagttctggaatgcaaaatacagtgtgaagagaacctcaccccagttataggaggctatccggttgagaaatttgtggctaccatgtatcattacttgcagtttgcctattataagttgaacgacctgaagaatgcagccccctgtgcagtcagctatctgctctttgatcagaatgacaaggtcatgcagcagaacctggtgtattaccagtaccacagggacacttggggcctctcggatgagcacttccagcccagacctgaagcagttcagttctttaatgtgaccacactccagaaggagctgtatgactttgctaaggaaaatataatggatgatgatgagggagaagttgtggaatatgtggatgacctcttggaactggaggagaccagctagcccacagcaaccaaagagacttcctcttggcgttcaggaaacacagattctttgtccttttcccaacagcccaggctgttgatacctcagagccttctctttactctccaaagtgaaagggaagcccccgtctctctaactgcatgtcatcaggggtgagcctgcctttcctatcttcacacctgccacctcatgttcacacctatctttctcaccttttttttgagatggagtctcgctctcttgcccaggctggagtgcaatggcacgttctcagctcactgcaacctccgcctcttgggttcaagcaattctgctgcatcagcctcccgagtacctgggattacaggcatgtgccaccacgcccggctaattttgtatttttagtagagacggggttttgccatgttggccaggctggtctcgaactcttgacttcagatgatccatctgccttggcctcccacagtgctgggattacaggcgtgagccaccatgcccggcctctttctcacctttacacctgtcttcttatcctcacatctgttttcacaccttcatccctgtcttcctcatgttcacacttgtcttccccatgttcatagctgcctttcttaccattttggtttgaagggcagtcttctctggcttgtttttttgtttttcccagaaaatcagtattattttttaaataagaaaaacattcctagaagatgataattgtgaaaacctcctttggcttatttgcttttccagattttagtctcctttctccccatccgggaaagatggtggaagacataggctaaatttctccagcctcacaatggtcttcacttggtctgacttgtaccaattctagcacccactgaaaaacaagttgagtagagagtgtagagtgcagaaatgtggcttttgccccactttgcatctccaaaattacaacggttggccgatcccatttgaggacaatgcttagttataagtctccgagttggaaaaggaagaaagccagagctgtctagtttcattcattctttcagtaaatatttattgagtacctactgtgtgctaggcattgacctgggaactagagatacttcacagaataacagggaaagttccctgtgctcatggagcttacattctacagggagaaagagatagccaatacataggaataaatatatacaaggtatcatgtagtgataat

SEQ ID NO: 4675 - DNA, 1810 bp, Homo sapiens
ccttccttcctttcgccgggcgcgatggagccggggcgccggggggccgcggcgctgctagcgctgctgtgcgtggcctgcgcgctgcgcgccgggcgcgcccaatacgaacgctacagcttccgcagcttcccacgggacgagctgatgccgctcgagtcggcctaccggcacgcgctggacaagtacagcggcgagcactgggccgagagcgtgggctacctggagatcagcctgcggctgcaccgcttgctgcgcgacagcgaggccttctgccaccgcaactgcagcgccgcgccgcagcccgagcccgccgccggcctcgccagctatcccgagctgcgcctcttcgggggcctgctgcgccgcgcgcactgcctcaagcgctgcaagcagggcctgccagccttccgccagtcccagcccagccgcgaggtgctggcggacttccagcgccgcgagccctacaagttcctgcagttcgcttacttcaaggcaaataatctccccaaagccatcgccgctgctcacacctttctactgaagcatcctgatgacgaaatgatgaagaggaacatggcatattataagagcctgcctggtgccgaggactacttaaagacctggaaaccaagtcatatgaaagcctgttcatccgagcagtgcgggcatacaacggtgagaactggagaacatccatcacagacatggagctggcccttcccgacttcttcaaagccttttacgagtgtctcgcagcctgcgagggttccagggagatcaaggacttcaaggatttctacctttccatagcagtgaacgacctgaagaatgcagccccctgtgcagtcagctatctgctctttgatcagaatgacaaggtcatgcagcagaacctggtgtattaccagtaccacagggacacttggggcctctcggatgagcacttccagcccagacctgaagcagttcagttctttaatgtgaccacactccagaaggagctgtatgactttgctaaggaaaatataatggatgatgatgagggagaagttgtggaatatgtggatgacctcttggaactggaggagaccagctagcccacagcaaccaaagagacttcctcttggcgttcaggaaacacagattctttgtccttttcccaacagcccaggctgttgatacctcagagccttctctttactctccaaagtgaaagggaagcccccgtctctctaactgcatgtcatcaggggtgagcctgcctttcctatcttcacacctgccacctcatgttcacacctatctttctcaccttttttttgagatggagtctcgctctcttgcccaggctggagtgcaatggcacgttctcagctcactgcaacctccgcctcttgggttcaagcaattctgctgcatcagcctcccgagtacctgggattacaggcatgtgccaccacgcccggctaattttgtatttttagtagagacggggttttgccatgttggccaggctggtctcgaactcttgacttcagatgatccatctgccttggcctcccacagtgctgggattacaggcgtgagccaccatgcccggcctctttctcacctttacacctgtcttcttatcctcacatctgttttcacaccttcatccctgtcttcctcatgttcacacttgtcttccccatgttcatagctgcctttcttaccattttggtttgaagggcagtcttctctggcttgtttttttgtttttcccagaaaatcagtattattttttaaataagaaaaacattcctag

SEQ ID NO: 4676 - DNA, 2010 bp, Homo sapiens
actgggcccgccgcgtcgcaccgtcctctttcctttccttctccctccccttttcccttccttcgtcccttccttccttcctttcgccgggcgcgatggagccggggcgccggggggccgcggcgctgctagcgctgctgtgcgtggcctgcgcgctgcgcgccgggcgcgcccaatacgaacgctacagcttccgcagcttcccacgggacgagctgatgccgctcgagtcggcctaccggcacgcgctggacaagtacagcggcgagcactgggccgagagcgtgggctacctggagatcagcctgcggctgcaccgcttgctgcgcgacagcgaggccttctgccaccgcaactgcagcgccgcgccgcagcccgagcccgccgccggcctcgccagctatcccgagctgcgcctcttcgggggcctgctgcgccgcgcgcactgcctcaagcgctgcaagcagggcctgccagccttccgccagtcccagcccagccgcgaggtgctggcggacttccagcgccgcgagccctacaagttcctgcagttcgcttacttcaaggcaaataatctccccaaagccatcgccgctgctcacacctttctactgaagcatcctgatgacgaaatgatgaagaggaacatggcatattataagagcctgcctggtgccgaggactacattaaagacctggaaaccaagtcatatgaaagcctgttcatcgagcagtgcgggcatacaacggtgagaactggagaacatccatcacagacatggagctggcccttcccgacttcttcaaagccttttacgagtgtctcgcagcctgcgagggttccagggagatcaaggacttcaaggatttctacctttccatagcagatcattatgtagaagttctggaatgcaaaatacagtgtgaagagaacctcaccccagttataggaggctatccggttgagaaatttgtggctaccatgtatcattacttgcagtttgcctattataagttgaacgacctgaagaatgcagccccctgtgcagtcagctatctgctctttgatcagaatgacaaggtcatgcagcagaacctggtgtattaccagtaccacagggacacttggggcctctcggatgagcacttccagcccagacctgaagcagttcagttctttaatgtgaccacactccagaaggagctgtatgactttgctaaggaaaatataatggatgatgatgagggagaagttgtggaatatgtggatgacctcttggaactggaggagaccagctagcccacagcaaccaaagagacttcctcttggcgttcaggaaacacagattctttgtccttttcccaacagcccaggctgttgatacctcagagccttctctttactctccaaagtgaaagggaagcccccgtctctctaactgcatgtcatcaggggtgagcctgcctttcctatcttcacacctgccacctcatgttcacacctatctttctcaccttttttttgagatggagtctcgctctcttgcccaggctggagtgcaatggcacgttctcagctcactgcaacctccgcctcttgggttcaagcaattctgctgcatcagcctcccgagtacctgggattacaggcatgtgccaccacgcccggctaattttgtatttttagtagagacggggttttgccatgttggccaggctggtctcgaactcttgacttcagatgatccatctgccttggcctcccacagtgctgggattacaggcgtgagccaccatgcccggcctctttctcacctttacacctgtcttcttatcctcacatctgttttcacaccttcatccctgtcttcctcatgttcacacttgtcttccccatgttcatagctgcctttcttaccattttggtttgaagggcagtcttctctggcttgtttttttgtttttcccagaaaatcagtattattttttaaataagaaaaacattcctag

SEQ ID NO: 4677 - DNA, 1922 bp, Homo sapiens
cttccttcgtcccttccttccttcctttcgccgggcgcgatggagccggggcgccggggggccgcggcgctgctagcgctgctgtgcgtggcctgcgcgctgcgcgccgggcgcgcccaatacgaacgctacagcttccgcagcttcccacgggacgagctgatgccgctcgagtcggcctaccggcacgcgctggacaagtacagcggcgagcactgggccgagagcgtgcgcgacagcgaggccttctgccaccgcaactgcagcgccgcgccgcagcccgagcccgccgccggcctcgccagctatcccgagctgcgcctcttcgggggcctgctgcgccgcgcgcactgcctcaagcgctgcaagcagggcctgccagccttccgccagtcccagcccagccgcgaggtgctggcggacttccagcgccgcgagccctacaagttcctgcagttcgcttacttcaaggcaaataatctccccaaagccatcgccgctgctcacacctttctactgaagcatcctgatgacgaaatgatgaagaggaacatggcatattataagagcctgcctggtgccgaggactacattaaagacctggaaaccaagtcatatgaaagcctgttcatccgagcagtgcgggcatacaacggtgagaactggagaacatccatcacagacatggagctggcccttcccgacttcttcaaagccttttacgagtgtctcgcagcctgcgagggttccagggagatcaaggacttcaaggatttctacctttccatagcagatcattatgtagaagttctggaatgcaaaatacagtgtgaagagaacctcaccccagttataggaggctatccggttgagaaatttgtggctaccatgtatcattacttgcagtttgcctattataagttgaacgacctgaagaatgcagccccctgtgcagtcagctatctgctctttgatcagaatgacaaggtcatgcagcagaacctggtgtattaccagtaccacagggacacttggggcctctcggatgagcacttccagcccagacctgaagcagttcagttctttaatgtgaccacactccagaaggagctgtatgactttgctaaggaaaatataatggatgatgatgagggagaagttgtggaatatgtggatgacctcttggaactggaggagaccagctagcccacagcaaccaaagagacttcctcttggcgttcaggaaacacagattctttgtccttttcccaacagcccaggctgttgatacctcagagccttctctttactctccaaagtgaaagggaagcccccgtctctctaactgcatgtcatcaggggtgagcctgcctttcctatcttcacacctgccacctcatgttcacacctatctttctcaccttttttttgagatggagtctcgctctcttgcccaggctggagtgcaatggcacgttctcagctcactgcaacctccgcctcttgggttcaagcaattctgctgcatcagcctcccgagtacctgggattacaggcatgtgccaccacgcccggctaattttgtatttttagtagagacggggttttgccatgttggccaggctggtctcgaactcttgacttcagatgatccatctgccttggcctcccacagtgctgggattacaggcgtgagccaccatgcccggcctctttctcacctttacacctgtcttcttatcctcacatctgttttcacaccttcatccctgtcttcctcatgttcacacttgtcttccccatgttcatagctgcctttcttaccattttggtttgaagggcagtcttctctggcttgtttttttgtttttcccagaaaatcagtattattttttaaataagaaaaacattcctagaagatg

SEQ ID NO: 4678 - DNA, 4199 bp, Homo sapiens
agtcccagcggccgccagacccgccggagttggacccgagcacgccgcggagcccggaccctccctcggacgctctgccccggccatggcgtcgctgctgccactgctctgtctctgtgtcgtcgctgcgcacctggcgggggcccgagacgccacccccaccgaggagccaatggcgactgcactgggcctggaaagacggtccgtgtacaccggccagccctcaccagccctggaggactgggaagaggccagcgagtggacgtcctggttcaacgtggaccaccccggaggcgacggcgacttcgagagcctggctgccatccgcttctactacgggccagcgcgcgtgtgcccgcgaccgctggcgctggaagcgcgcaccacggactgggccctgccgtccgccgtcggcgagcgcgtgcacttgaaccccacgcgcggcttctggtgcctcaaccgcgagcaaccgcgtggccgccgctgctccaactaccacgtgcgcttccgctgcccactagaagcctcgtggggcgcgtggggcccgtggggtccctgctcggggagctgtgggccaggccgtcgcttgcgccgccgccactgcccaagccccgctggggatgcgtgtcccgggcgtcctctggaggcgcagaagtgcgtgcggcctcggtgtccagggtgcagccttgacacctgtgaatgcccggaccacatcctcctgggctcggtggtcaccccatctgggcaaccactgctaggagccagggtctccctgcgagaccagcctggcactgtggccaccagcgatgctcacggaaccttccgggtgcctggtgtctgtgctgacagccgcgccaacatcagggcccagatggatggcttctctgcaggggaggcccaggcccaggccaacggatccatctctgtggtcaccatcatccttgataagttggagaagccgtacctggtgaaacaccctgagtcccgagtgcgagaggctggccagaatgtgactttctgctgcaaagcctccgggacccccatgcccaagaaatactcctggttccacaatgggaccctgctggacaggcgagctcatgggtacggggcccacctggagctgcggggactgcgcccagaccaggctggcatctaccactgcaaggcatggaatgaggcgggtgccgtgcgctcgggcactgcccggctcactgtacttgccccaggccagccagcctgcgacccccggccccgagagtacctgatcaagctccctgaggactgtggtcagccaggtagtggccctgcctacctggatgtgggcctctgtcccgacacccgctgccccagcctggcaggctccagcccccgctgcggggacgccagctcccgctgctgctctgtgcgccgtctggagagaagggagattcactgccctggctacgtcctcccagtgaaggtggtggcagagtgtggctgccagaagtgtctgccccctcgggggctggtccggggccgtgttgtggctgctgactccggggagccgctacgcttcgccaggattctgctgggccaggagcccatcggcttcaccgcctaccagggcgactttaccattgaggtgccgccctccacccagcggctggtggtgacttttgtggaccccagcggtgagttcatggacgctgtccgggtcttgccttttgatcctcgaggtgccggcgtgtaccacgaggtcaaggccatgcggaagaaagccccggtcattttacataccagccagagcaacacgatccccctgggcgagctggaagatgaggcgcccctgggcgagctggtcctgccttctggcgctttccgcagagccgacggcaaaccctactcggggcctgtggaggcccgggtgacgttcgtggacccccgagacctcacctcggcggcgtctgcccccagtgacctgcgcttcgtggacagcgacggcgagctggctccactgcgcacctacggcatgttctccgtggacctccgtgcgcccggctccgcggagcagctgcaggtggggccggtggccgtgcgggtggccgccagccagatccacatgccaggccacgtggaggccctcaagctgtggtcgctgaaccccgagaccggcttgtgggaggaggagagcggcttccggcgcgaggggtcctcgggcccccgggtgcgccgggaggagcgcgtcttcctggtgggcaacgtggagatccgggagcggcgcctgttcaatctggacgtgcctgagcgccgccgctgcttcgtgaaggtgcgcgcctacgccaacgacaagttcacccccagcgagcaggtggagggcgtggtggtcacgctggtcaatctggagcccgcccccggcttctccgccaacccccgtgcctggggccgctttgacagcgcggtcaccggccccaatggcgcctgcctccccgccttctgcgacgccgacaggccagacgcctacaccgccctggtcaccgccaccctgggcggcgaggagctggagccggccccttccttgccccgcccactcccggccaccgtgggcgtcacccagccctacctggacaggctggggtaccgtcggacggaccacgacgatcccgccttcaagcgtaacggcttccgcatcaacctcgccaagcccaggccaggtgaccccgccgaggccaatgggcctgtgtacccgtggcgcagcctgcgggaatgccagggggccccggtgactgccagccacttccgcttcgccagggtggaggcggacaagtacgagtacaacgtggtccccttccgagagggcacacctgcctcctggactggcgatctcctggcctggtggcccaacccgcaggagttccgggcctgcttcctcaaggtgaagatccagggtccccaggagtatatggtccgctcccacaacgcagggggcagccacccacgcacccgcggccagctctacggacttcgggatgcccggagtgtgcgagaccccgagcgtccgggcacctcggcagcctgcgtggagttcaagtgcagcgggatgctgttcgaccagcggcaggtggacaggacgctggtgaccattatgccccagggcagctgccggcgcgtggccgtcaacggactccttcgggattacctgacccggcaccccccaccggtgcccgcggaggacccagctgccttctccatgctggcccccctagaccctctgggccacaactatggcgtctacactgtcactgaccagagcccacgcttggccaaggagatcgccattggccgctgctttgatggttcctctgacggcttctccagagagatgaaggctgatgccggcacagccgtcaccttccagtgccgggagccaccggccggacgacccagcctcttccagaggctgctggagtccccggcgacagcacttggtgacatccgcagggagatgagcgaggcggcgcaggcacaggcccgggcctcaggtcccctccgcacccgccggggtagggtccggcagtgacctgggcaggggcctcgctttcccacctccctccagactcctttgaccccaggaagttttgcccctccttcttctccagacagccccctccccaggtgtctgggtcccctttcccgcccctttccagaactcagagtcagacaagaacccagagcatccgatggtagaaacaccaggaagacaattgttgctgtgtggtatggaatggagtttgcggtgactctggggccagcacccaggggacgacgttcaaccctagcctgaagggacccgctcccagctcagaagccgtctctgacttctcgtgcgtattttgaccctgatttcaatcttctacccttgggagttctggcgtttggcacaaagtcccctctgcctgtttggagctcagtgctagaccaggtcccctgccccgagctttgtttttggggttatttattgaaacaaagtgtggggagctggttgtgggtgtgagtgggggtgtggggtccaggctgggcccagtgaaaaggaggaaggggttcccatgcgggggaggctctggggctgaggggaacaattctcacgtgtttggtgcttagagacctgcccggggcgttgggcaggccctccgggggctgaattaaaaatgctttatttccaa

SEQ ID NO: 4679 - DNA, 4454 bp, Homo sapiens
actggactgctggagaggcgaaggcttggacccccagctgaggagtcctgctcaagacacggtcactggatctgagaaacttcccaggggaccgcattccagagtcagtgactctgtgaagcacccacatctacctcttgccacgttcccacgggcttgggggaaagatggtggggaccaaggcctgggtgttctccttcctggtcctggaagtcacatctgtgttggggagacagacgatgctcacccagtcagtaagaagagtccagcctgggaagaagaaccccagcatctttgccaagcctgccgacaccctggagagccctggtgagtggacaacatggttcaacatcgactacccaggcgggaagggcgactatgagcggctggacgccattcgcttctactatggggaccgtgtatgtgcccgtcccctgcggctagaggctcggaccactgactggacacctgcgggcagcactggccaggtggtccatggtagtccccgtgagggtttctggtgcctcaacagggagcagcggcctggccagaactgctctaattacaccgtacgcttcctctgcccaccaggatccctgcgccgagacacagagcgcatctggagcccatggtctccctggagcaagtgctcagctgcctgtggtcagactggggtccagactcgcacacgcatttgcttggcagagatggtgtcgctgtgcagtgaggccagcgaagagggtcagcactgcatgggccaggactgtacagcctgtgacctgacctgcccaatgggccaggtgaatgctgactgtgatgcctgcatgtgccaggacttcatgcttcatggggctgtctcccttcccggaggtgccccagcctcaggggctgctatctacctcctgaccaagacgccgaagctgctgacccagacagacagtgatgggagattccgaatccctggcttgtgccctgatggcaaaagcatcctgaagatcacaaaggtcaagtttgcccccattgtactcacaatgcccaagactagcctgaaggcagccaccatcaaggcagagtttgtgagggcagagactccatacatggtgatgaaccctgagacaaaagcacggagagctgggcagagcgtgtctctgtgctgtaaggccacagggaagcccaggccagacaagtatttttggtatcataatgacacattgctggatccttccctctacaagcatgagagcaagctggtgctgaggaaactgcagcagcaccaggctggggagtacttttgcaaggcccagagtgatgctggggctgtgaagtccaaggttgcccagctgattgtcatagcatctgatgagactccttgcaacccagttcctgagagctatcttatccggctgccccatgattgctttcagaatgccaccaactccttctactatgacgtgggacgctgccctgttaagacttgtgcagggcagcaggataatgggatcaggtgccgtgatgctgtgcagaactgctgtggcatctccaagacagaggaaagggagatccagtgcagtggctacacgctacccaccaaggtggccaaggagtgcagctgccagcggtgtacggaaactcggagcatcgtgcggggccgtgtcagtgctgctgacaatggggagcccatgcgctttggccatgtgtacatggggaacagccgtgtaagcatgactggctacaagggcactttcaccctccatgtcccccaggacactgagaggctggtgctcacatttgtggacaggctgcagaagtttgtcaacaccaccaaagtgctacctttcaacaagaaggggagtgccgtgttccatgaaatcaagatgcttcgtcggaaaaagcccatcactttggaagccatggagaccaacatcatccccctgggggaagtggttggtgaagaccccatggctgaactggagattccatccaggagtttctacaggcagaatggggagccctacataggaaaagtgaaggccagtgtgaccttcctggatccccggaatatttccacagccacagctgcccagactgacctgaacttcatcaatgacgaaggagacactttcccccttcggacgtatggcatgttctctgtggacttcagagatgaggtcacctcagagccacttaatgctggcaaagtgaaggtccaccttgactcgacccaggtcaagatgccagagcacatatccacagtgaaactctggtcactcaatccagacacagggctgtgggaggaggaaggtgatttcaaatttgaaaatcaaaggaggaacaaaagagaagacagaaccttcctggtgggcaacctggagattcgtgagaggaggctctttaacctggatgttcctgaaagcaggcggtgctttgttaaggtgagggcctaccggagtgagaggttcttgcctagtgagcagatccagggggttgtgatctccgtgattaacctggagcctagaactggcttcttgtccaaccctagggcctggggccgctttgacagtgtcatcacaggccccaacggggcctgtgtgcctgccttctgtgatgaccagtcccctgatgcctactctgcctatgtcttggcaagcctggctggggaggaactgcaagcagtggagtcttctcctaaattcaacccaaatgcaattggcgtccctcagccctatctcaacaagctcaactaccgtcggacggaccatgaggatccacgggttaaaaagacagctttccagattagcatggccaagccaaggcccaactcagctgaggagagcaatgggcccatctatgcctttgagaacctccgggcatgtgaagaggcaccacccagtgcagcccacttccggttctaccagattgagggggatcgatatgactacaacacagtccccttcaacgaagatgaccctatgagctggactgaagactatctggcatggtggccaaagccgatggaattcagggcctgctatatcaaggtgaagattgtggggccactggaagtgaatgtgcgatcccgcaacatggggggcactcatcggcagacagtggggaagctgtatggaatccgagatgtgaggagcactcgggacagggaccagcccaatgtctcagctgcctgtctggagttcaagtgcagtgggatgctctatgatcaggaccgtgtggaccgcaccctggtgaaggtcatcccccagggcagctgccgtcgagccagtgtgaaccccatgctgcatgagtacctggtcaaccacttgccacttgcagtcaacaacgacaccagtgagtacaccatgctggcacccttggacccactgggccacaactatggcatctacactgtcactgaccaggaccctcgcacggccaaggagatcgcgctcggccggtgctttgatggcacatccgatggctcctccagaatcatgaagagcaatgtgggagtagccctcaccttcaactgtgtagagaggcaagtaggccgccagagtgccttccagtacctccaaagcaccccagcccagtcccctgctgcaggcactgtccaaggaagagtgccctcgaggaggcagcagcgagcgagcaggggtggccagcgccagggtggagtggtggcctctctgagatttcctagagttgctcaacagcccctgatcaactaagttttgtggtacttcaccctcttctgccctcatttcatgtgacagccattgtgagactgatgcacaaactgtcacttggttaatttaagcacttctgttttcgtgaatttgcttgtttgtttcttcatgcctttacttactttgtcccatgctactgattggcacgtggcccccacaatggcacaataaagcccctttgtgaaactgttctttaaatgaaacacaagaaattggccactggtaaaactctgcagcttcaactgtacttcatttaatgccattaatgcaaatatacttcctcttctttttgcatggttttgcccacctctgcaatagtgataatctgatgctgaagatcaaataaccaatataaagcatatttcttggccttgctccacaggacataggcaagccttgatcatagttcatacatataaatggtggtgaaataaagaaataaaacacaatacttttacttgaaatgtaaataacttatttatttctttgctaaatttggaattctagtgcacattcaaagttaagctattaaatatagggtgatcatagttcctctaccaagtctggaaagaacatctcctggtatccacaattacaccaggttgctaactgtatttgtacatttccctttgcattcgcttctgttcttgctagaaacccagtgtagcccagggcagatgtcaataaatgcatactctgtatttcgattctgag

SEQ ID NO: 4680 - DNA, 2461 bp, Homo sapiens
gtgggcggtagaaagcgagcagccacccagctccccgccaccgccatggtccccgacaccgcctgcgttcttctgctcaccctggctgccctcggcgcgtccggacagggccagagcccgttgggctcagacctgggcccgcagatgcttcgggaactgcaggaaaccaacgcggcgctgcaggacgtgcgggagctgctgcggcagcaggtcagggagatcacgttcctgaaaaacacggtgatggagtgtgacgcgtgcgggatgcagcagtcagtacgcaccggcctacccagcgtgcggcccctgctccactgcgcgcccggcttctgcttccccggcgtggcctgcatccagacggagagcggcgcgcgctgcggcccctgccccgcgggcttcacgggcaacggctcgcactgcaccgacgtcaacgagtgcaacgcccacccctgcttcccccgagtccgctgtatcaacaccagcccggggttccgctgcgaggcttgcccgccggggtacagcggccccacccaccagggcgtggggctggctttcgccaaggccaacaagcaggtttgcacggacatcaacgagtgtgagaccgggcaacataactgcgtccccaactccgtgtgcatcaacacccggggctccttccagtgcggcccgtgccagcccggcttcgtgggcgaccaggcgtccggctgccagcggcgcgcacagcgcttctgccccgacggctcgcccagcgagtgccacgagcatgcagactgcgtcctagagcgcgatggctcgcggtcgtgcgtgtgtgccgttggctgggccggcaacgggatcctctgtggtcgcgacactgacctagacggcttcccggacgagaagctgcgctgcccggagcgccagtgccgtaaggacaactgcgtgactgtgcccaactcagggcaggaggatgtggaccgcgatggcatcggagacgcctgcgatccggatgccgacggggacggggtccccaatgaaaaggacaactgcccgctggtgcggaacccagaccagcgcaacacggacgaggacaagtggggcgatgcgtgcgacaactgccggtcccagaagaacgacgaccaaaaggacacagaccaggacggccggggcgatgcgtgcgacgacgacatcgacggcgaccggatccgcaaccaggccgacaactgccctagggtacccaactcagaccagaaggacagtgatggcgatggtataggggatgcctgtgacaactgtccccagaagagcaacccggatcaggcggatgtggaccacgactttgtgggagatgcttgtgacagcgatcaagaccaggatggagacggacatcaggactctcgggacaactgtcccacggtgcctaacagtgcccaggaggactcagaccacgatggccagggtgatgcctgcgacgacgacgacgacaatgacggagtccctgacagtcgggacaactgccgcctggtgcctaaccccggccaggaggacgcggacagggacggcgtgggcgacgtgtgccaggacgactttgatgcagacaaggtggtagacaagatcgacgtgtgtccggagaacgctgaagtcacgctcaccgacttcagggccttccagacagtcgtgctggacccggagggtgacgcgcagattgaccccaactgggtggtgctcaaccagggaagggagatcgtgcagacaatgaacagcgacccaggcctggctgtgggttacactgccttcaatggcgtggacttcgagggcacgttccatgtgaacacggtcacggatgacgactatgcgggcttcatctttggctaccaggacagctccagcttctacgtggtcatgtggaagcagatggagcaaacgtattggcaggcgaaccccttccgtgctgtggccgagcctggcatccaactcaaggctgtgaagtcttccacaggccccggggaacagctgcggaacgctctgtggcatacaggagacacagagtcccaggtgcggctgctgtggaaggacccgcgaaacgtgggttggaaggacaagaagtcctatcgttggttcctgcagcaccggccccaagtgggctacatcagggtgcgattctatgagggccctgagctggtggccgacagcaacgtggtcttggacacaaccatgcggggtggccgcctgggggtcttctgcttctcccaggagaacatcatctgggccaacctgcgttaccgctgcaatgacaccatcccagaggactatgagacccatcagctgcggcaagcctagggaccagggtgaggacccgccggatgacagccaccctcaccgcggctggatgggggctctgcacccagccccaaggggtggccgtcctgagggggaagtgagaagggctcagagaggacaaaataaagtgtgtgtgcaggga

SEQ ID NO: 4681 - DNA, 2292 bp, Homo sapiens
agaaagcgagcagccacccagctccccgccaccgccatggtccccgacaccgcctgcgttcttctgctcaccctggctgccctcggcgcgtccggacagggccagagcccgttgggctcagacctgggcccgcagatgcttcgggaactgcaggaaaccaacgcggcgctgcaggacgtgcgggagctgctgcggcagcaggtcagggagatcacgttcctgaaaaacacggtgatggagtgtgacgcgtgcgggatgcagcagtcagtacgcaccggcctacccagcgtgcggcccctgctccactgcgcgcccggcttctgcttccccggcgtggcctgcatccagacggagagcggcgcgcgctgcggcccctgccccgcgggcttcacgggcaacggctcgcactgcaccgacgtcaacgagtgtgagaccgggcaacataactgcgtccccaactccgtgtgcatcaacacccggggctccttccagtgcggcccgtgccagcccggcttcgtgggcgaccaggcgtccggctgccagcggcgcgcacagcgcttctgccccgacggctcgcccagcgagtgccacgagcatgcagactgcgtcctagagcgcgatggctcgcggtcgtgcgtgtgtgccgttggctgggccggcaacgggatcctctgtggtcgcgacactgacctagacggcttcccggacgagaagctgcgctgcccggagcgccagtgccgtaaggacaactgcgtgactgtgcccaactcagggcaggaggatgtggaccgcgatggcatcggagacgcctgcgatccggatgccgacggggacggggtccccaatgaaaaggacaactgcccgctggtgcggaacccagaccagcgcaacacggacgaggacaagtggggcgatgcgtgcgacaactgccggtcccagaagaacgacgaccaaaaggacacagaccaggacggccggggcgatgcgtgcgacgacgacatcgacggcgaccggatccgcaaccaggccgacaactgccctagggtacccaactcagaccagaaggacagtgatggcgatggtataggggatgcctgtgacaactgtccccagaagagcaacccggatcaggcggatgtggaccacgactttgtgggagatgcttgtgacagcgatcaagaccaggatggagacggacatcaggactctcgggacaactgtcccacggtgcctaacagtgcccaggaggactcagaccacgatggccagggtgatgcctgcgacgacgacgacgacaatgacggagtccctgacagtcgggacaactgccgcctggtgcctaaccccggccaggaggacgcggacagggacggcgtgggcgacgtgtgccaggacgactttgatgcagacaaggtggtagacaagatcgacgtgtgtccggagaacgctgaagtcacgctcaccgacttcagggccttccagacagtcgtgctggacccggagggtgacgcgcagattgaccccaactgggtggtgctcaaccagggaagggagatcgtgcagacaatgaacagcgacccaggcctggctgtgggttacactgccttcaatggcgtggacttcgagggcacgttccatgtgaacacggtcacggatgacgactatgcgggcttcatctttggctaccaggacagctccagcttctacgtggtcatgtggaagcagatggagcaaacgtattggcaggcgaaccccttccgtgctgtggccgagcctggcatccaactcaaggctgtgaagtcttccacaggccccggggaacagctgcggaacgctctgtggcatacaggagacacagagtcccaggtgcggctgctgtggaaggacccgcgaaacgtgggttggaaggacaagaagtcctatcgttggttcctgcagcaccggccccaagtgggctacatcagggtgcgattctatgagggccctgagctggtggccgacagcaacgtggtcttggacacaaccatgcggggtggccgcctgggggtcttctgcttctcccaggagaacatcatctgggccaacctgcgttaccgctgcaatgacaccatcccagaggactatgagacccatcagctgcggcaagcctagggaccagggtgaggacccgccggatgacagccaccctcaccgcggctggatgggggctctgcacccagccccaaggggtggccgtcctgagggggaagtgagaagggctcagagaggacaaaataaagtgtgtgtgcaggg

SEQ ID NO: 4682 - DNA, 2322 bp, Homo sapiens
agaaagcgagcagccacccagctccccgccaccgccatggtccccgacaccgcctgcgttcttctgctcaccctggctgccctcggcgcgtccggacagggccagagcccgttgggctcagacctgggcccgcagatgcttcgggaactgcaggaaaccaacgcggcgctgcaggacgtgcgggagctgctgcggcagcaggtcagggagatcacgttcctgaaaaacacggtgatggagtgtgacgcgtgcgggatgcagcagtcagtacgcaccggcctacccagcgtgcggcccctgctccactgcgcgcccggcttctgcttccccggcccctgccccgcgggcttcacgggcaacggctcgcactgcaccgacgtcaacgagtgcaacgcccacccctgcttcccccgagtccgctgtatcaacaccagcccggggttccgctgcgaggcttgcccgccggggtacagcggccccacccaccagggcgtggggctggctttcgccaaggccaacaagcaggtttgcacggacatcaacgagtgtgagaccgggcaacataactgcgtccccaactccgtgtgcatcaacacccggggctccttccagtgcggcccgtgccagcccggcttcgtgggcgaccaggcgtccggctgccagcggcgcgcacagcgcttctgccccgacggctcgcccagcgagtgccacgagcatgcagactgcgtcctagagcgcgatggctcgcggtcgtgcgtgtgtgccgttggctgggccggcaacgggatcctctgtggtcgcgacactgacctagacggcttcccggacgagaagctgcgctgcccggagcgccagtgccgtaaggacaactgcgtgactgtgcccaactcagggcaggaggatgtggaccgcgatggcatcggagacgcctgcgatccggatgccgacggggacggggtccccaatgaaaaggacaactgcccgctggtgcggaacccagaccagcgcaacacggacgaggacaagtggggcgatgcgtgcgacaactgccggtcccagaagaacgacgaccaaaaggacacagaccaggacggccggggcgatgcgtgcgacgacgacatcgacggcgaccggatccgcaaccaggccgacaactgccctagggtacccaactcagaccagaaggacagtgatggcgatggtataggggatgcctgtgacaactgtccccagaagagcaacccggatcaggcggatgtggaccacgactttgtgggagatgcttgtgacagcgatcaagaccaggatggagacggacatcaggactctcgggacaactgtcccacggtgcctaacagtgcccaggaggactcagaccacgatggccagggtgatgcctgcgacgacgacgacgacaatgacggagtccctgacagtcgggacaactgccgcctggtgcctaaccccggccaggaggacgcggacagggacggcgtgggcgacgtgtgccaggacgactttgatgcagacaaggtggtagacaagatcgacgtgtgtccggagaacgctgaagtcacgctcaccgacttcagggccttccagacagtcgtgctggacccggagggtgacgcgcagattgaccccaactgggtggtgctcaaccagggaagggagatcgtgcagacaatgaacagcgacccaggcctggctgtgggttacactgccttcaatggcgtggacttcgagggcacgttccatgtgaacacggtcacggatgacgactatgcgggcttcatctttggctaccaggacagctccagcttctacgtggtcatgtggaagcagatggagcaaacgtattggcaggcgaaccccttccgtgctgtggccgagcctggcatccaactcaaggctgtgaagtcttccacaggccccggggaacagctgcggaacgctctgtggcatacaggagacacagagtcccaggtgcggctgctgtggaaggacccgcgaaacgtgggttggaaggacaagaagtcctatcgttggttcctgcagcaccggccccaagtgggctacatcagggtgcgattctatgagggccctgagctggtggccgacagcaacgtggtcttggacacaaccatgcggggtggccgcctgggggtcttctgcttctcccaggagaacatcatctgggccaacctgcgttaccgctgcaatgacaccatcccagaggactatgagacccatcagctgcggcaagcctagggaccagggtgaggacccgccggatgacagccaccctcaccgcggctggat

SEQ ID NO: 4683 - DNA, 3942 bp, Homo sapiens
aggaaggggaggagacaggcgtccagggcgcctggggaaccggcacggcggagcagcggcggcggggctggggggaggccgccgagtcggccgcggccgaggaggggcaggcggaggtcgggggcgccgcggccgcggggtcaggttccccggcgggaggcgcaggtggcggcctggggagctggcggccgctcctcgcctggctgcagcggcggcagccccagtgctgcccctgtgcggcgcccctttcccgctccgccgcgcactgttgtcatggaggaaccaagatggcggctctggcctacaacctgggcaagcgggagatcaaccactacttcagcgtgaggagcgccaaggtgctggcgctggtggccgtgctgctgctcgcagcgtgccacctcgcctcccgccgctaccgaggcaatgattcgtgtgaataccttctctcaagtggcagatttcttggagagaaagtttggcaacctcacagttgtatgatgcataaatacaaaatcagtgaagcaaagaactgccttgtagataaacatattgcatttattggagattccagaattcgtcaattgttttattcttttgtaaaaataattaatccccaattcaaagaagaaggaaataagcatgaaaacattccttttgaagacaagactgcatcagttaaagtggattttctgtggcatcctgaagttaatggttctatgaaacagtgtatcaaagtgtggactgaggattccattgcaaagccacatgtgattgtagcaggagctgccacatggtccatcaagattcacaatggtagcagtgaagcgctttctcaatataaaatgaacatcacctccatagcaccacttttagaaaaattggcaaagactagtgatgtttattgggtcttacaagatcctgtttatgaagatctattaagtgaaaataggaagatgatcactaatgagaagatagatgcttacaatgaagctgcagtcagtattttgaatagtagcaccagaaattctaaatcaaatgttaagatgttcagtgtttccaaattaattgctcaagaaaccatcatggaatctttggatggcttacatcttcctgaatcgagcagagaaactactgcaatgattcttatgaatgtgtattgcaataagattttgaagcctgtagatgggtcctgttgtcaacctcggcctcctgttactctcatacagaagctagctgcttgttttttcactttatctattatcggatatttaattttttacataattcatcgtaatgctcatcggaagaataagccgtgtactgatttggaaagtggagaggaaaagaaaaatattatcaatacccctgtgtcttcattagaaatacttttacaatctttctgcaaacttggcctgattatggcatatttctatatgtgtgaccgtgcaaatctgttcatgaaggaaaacaaattttatacacattcatctttctttattccaattatctacattttggttttgggagtattttataatgaaaatactaaagagactaaagtattaaatagagaacaaacagacgaatggaaaggctggatgcaacttgtgattttgatttatcacatttctggagcaagtacatttttgcctgtatacatgcacattcgagttctggttgctgcatatttatttcagacagggtatgggcatttctcatacttttggataaaaggagattttggaatctatagagtatgtcaggttttatttcgtctcaatttcctggtagtggtgttatgtatagtaatggatcgaccttatcaattctattactttgtccccttggtcactgtatggttcatggtcatatatgttactttagcactatggccacaaataatccaaaaaaaagcaaacggaaattgtttctggcattttggcttactgttgaaactaggctttttgctgttattcatatgttttttggcatattctcagggtgcatttgagaagatcttttctctttggccattgtccaagtgttttgaactgaaagggaatgtatatgaatggtggttcagatggaggttagaccgttatgtagttttccacggaatgctgtttgcttttatttatctggctttgcagaagcgtcaaatactttctgaaggaaagggtgaacctcttttttcaaacaaaatttcaaattttctgttgtttatttcagtagtttctttcttgacctattccatctgggctagcagttgtaaaaacaaagcagagtgcaatgaactccatccgtctgtttctgtggtacagattttagccttcatcctaataagaaacatccctggatatgcccgttcagtttacagttcattttttgcttggtttggaaaaatttcattagagctatttatttgccagtatcacatatggctggcagcggacacaaggggtatcttggtactgatacctggaaaccctatgctcaacatcattgtcagcactttcatatttgtttgtgtggcacatgaaatttctcagatcactaatgatcttgcacagattattattcctaaagataactcatctctcttgaaaaggttggcatgtatagctgcatttttttgtggactcctcatcttatcatccattcaagataaatcaaaacattaggttccaaaaattctaaaaaacctaaactcttcaggctacctttgtgtgtctctagaagagaaaagcatctatctggagatataaatgtgtatgtaaatataaacgtttgtggcaagaggacagttctgtgacatctgttgaacatatgtggttgtatatattggaaatgtacatatccaatatgaaatactaaaacaaacaaacaaacaaaaaaccagaatgcattgtataggattgcatgtgaagtcttttctactgaatctatatttccatttgtaagtgattttaagttaacatatgaaggcagggaaatgattacctttccagtaaaaagtatagataatttaattaacttagtgacaccaccaagtgttttgatataactaaatttgtggtaataagactgtctgcacctgtattcattgtggaacttcctctttcattggaaactttcttactcaagaatgacggcagtattgttttcttatatgtgcaatgaagtggaatgataaacagtatgcctttaatttatatgtgttcttgttctgatgttgtttcctgaaatgatttttcttcctaactgtggttttcgggtatgcaagcctaaatctttgtacactttgtctcacagaatagttctgaggctccatgacagggttttgtcattgttgatgttattgttgcttcgttttataaaaaagccaaaattttttttccaatccaaacgttcacctgtttcctttcctcaagctataccagtgtaataccagttaccctgtggatccatttaatatgttatccccactaattaattttcgtatattatttccaatatttggaaagctctttatagccatttggtatttcctattacccacctcctattttaaatatttatcagtctaaacttgtgcagtgtagtaaacatgcaagttgttacgattgagctgtattaccataagtagaattttaagtaaactggtgaatttgggcaataaatgtttttgctttttgtttgatttttttttacaagctaactgttagaggtatacatttatttatctgttgtacagatttgattatgattttaatgtttgaaagattgcacttgtttgcttttactatatgtggggtaaaatatattttctgttcacagtatatgaaaatatggagtaatttaaacagtaaataaacattctgtggatgcttatttttgtattggcaaagtatcaattaaactatatgtgttctttttcaaaaa

SEQ ID NO: 4684 - DNA, 10257 bp, Homo sapiens
acagaaacctggccgcggctttccgggagctgtgggcacgcgagctgctcgaagccggtggcccggggatcgtcgctgcccagtccggccgcggccggccgcttccccgagcttaccagtaagccggtccgcctccgggacgcgccccgcccgccccgggctcgcgcgctctgaaggggcgcgtcccgcgcactcccggcgccgcccactcccctccccacggccgctcctccctccgcccggatagccggcggcggcggcggcggcggcggcggcggcggccgggagaggcccctccttcacgccctgcttctctccctcgctcgcagtcgagccgagccggcggacccgcctgggctccgaccctgcccaggccatggccggcaacgtgaagaagagctctggggccgggggcggcagcggctccgggggctcgggttcgggtggcctgattgggctcatgaaggacgccttccagccgcaccaccaccaccaccaccacctcagcccccacccgccggggacggtggacaagaagatggtggagaagtgctggaagctcatggacaaggtggtgcggttgtgtcagaacccaaagctggcgctaaagaatagcccaccttatatcttagacctgctaccagatacctaccagcatctccgtactatcttgtcaagatatgaggggaagatggagacacttggagaaaatgagtattttagggtgtttatggagaatttgatgaagaaaactaagcaaaccataagcctcttcaaggagggaaaagaaagaatgtatgaggagaattctcagcctaggcgaaacctaaccaaactgtccctcatcttcagccacatgctggcagaactaaaaggaatctttccaagtggactctttcagggagacacatttcggattactaaagcagatgctgcggaattttggagaaaagcttttggggaaaagacaatagtcccttggaagagctttcgacaggctctacatgaagtgcatcccatcagttctgggctggaggccatggctctgaaatccactattgatctgacctgcaatgattatatttcggtttttgaatttgacatctttacccgactctttcagccctggtcctctttgctcaggaattggaacagccttgctgtaactcatcctggctacatggcttttttgacgtatgacgaagtgaaagctcggctccagaaattcattcacaaacctggcagttatatcttccggctgagctgtactcgtctgggtcagtgggctattgggtatgttactgctgatgggaacattctccagacaatccctcacaataaacctctcttccaagcactgattgatggcttcagggaaggcttctatttgtttcctgatggacgaaatcagaatcctgatctgactggcttatgtgaaccaactccccaagaccatatcaaagtgacccaggaacaatatgaattatactgtgagatgggctccacattccaactatgtaaaatatgtgctgaaaatgataaggatgtaaagattgagccctgtggacacctcatgtgcacatcctgtcttacatcctggcaggaatcagaaggtcagggctgtcctttctgccgatgtgaaattaaaggtactgaacccatcgtggtagatccgtttgatcctagagggagtggcagcctgttgaggcaaggagcagagggagctccctccccaaattatgatgatgatgatgatgaacgagctgatgatactctcttcatgatgaaggaattggctggtgccaaggtggaacggccgccttctccattctccatggccccacaagcttcccttcccccggtgccaccacgacttgaccttctgccgcagcgagtatgtgttccctcaagtgcttctgctcttggaactgcttctaaggctgcttctggctcccttcataaagacaaaccattgccagtacctcccacacttcgagatcttccaccaccaccgcctccagaccggccatattctgttggagcagaatcccgacctcaaagacgccccttgccttgtacaccaggcgactgtccctccagagacaaactgccccctgtcccctctagccgccttggagactcatggctgccccggccaatccccaaagtaccagtatctgccccaagttccagtgatccctggacaggaagagaattaaccaaccggcactcacttccattttcattgccctcacaaatggagcccagaccagatgtgcctaggctcggaagcacgttcagtctggatacctccatgagtatgaatagcagcccattagtaggtccagagtgtgaccaccccaaaatcaaaccttcctcatctgccaatgccatttattctctggctgccagacctcttcctgtgccaaaactgccacctggggagcaatgtgagggtgaagaggacacagagtacatgactccctcttccaggcctctacggcctttggatacatcccagagttcacgagcatgtgattgcgaccagcagattgatagctgtacgtatgaagcaatgtataatattcagtcccaggcgccatctatcaccgagagcagcacctttggtgaagggaatttggccgcagcccatgccaacactggtcccgaggagtcagaaaatgaggatgatgggtatgatgtcccaaagccacctgtgccggccgtgctggcccgccgaactctctcagatatctctaatgccagctcctcctttggctggttgtctctggatggtgatcctacaacaaatgtcactgaaggttcccaagttcccgagaggcctccaaaaccattcccgcggagaatcaactctgaacggaaagctggcagctgtcagcaaggtagtggtcctgccgcctctgctgccaccgcctcacctcagctctccagtgagatcgagaacctcatgagtcaggggtactcctaccaggacatccagaaagctttggtcattgcccagaacaacatcgagatggccaaaaacatcctccgggaatttgtttccatttcttctcctgcccatgtagctacctagcacaccatctccctgctgcaggtttagaggaccagtgagttgggagttattactcaagtggcacctagaagggcaggagttcctttggtgacttcacagtgaagtcttgccctctctgtgggatatcacatcagtggttccaagatttcaaagtggtgaaatgaaaatggagcagctagtatgttttattattttatgggtcttgagtgcatttgaaggtgtccttcagttcccacgtagagagagtgtggattatattacatgataacctacctggggaacagtccagaaagctatagaacaagtattttgctggaaatcctaattgaggacttaagacttcctgggttaaggatgtggccgtgtgtgtgtgtgtctgcctgtggttgtatgtgtccttgtgattataagattaacctgctgtgtgtgttaattccaggcagggaattagcacaaaaggtttaggaaggaatctttttttaaagacttccatctactgtggtattatacccaagcctagtgtgtattacaacttcaacactcccctttggcttatattaccatgtgcatagctaaagtcttctatttttagaacaccttctgtctgttctttccccatcaactccttcctcatccttcttggtgttctgtcatgggccatgggcttgctatggccagccttactgaggccaagcagcttatgggatgttctttattgtgtgtgatggtattggtttgtttggtagataagtgggaggaaaagtactgttgctacactattataggcatgtttgatactagcagctaacactggtcactccaaagcactgtttctataggaacattgaagctattaagatgttttgattatcctaattacataatgaccgatttgagatagaggcctttaaatacattccatgccctccccagaaaatagtctgtgggagtcagttgccttggtgccaggtatgtgttctgatgtaggtcatgagtctttctacttaatgggaagggaagaacatttgtttccaggatgactttctggccagaataccggaaagcttttaggaagcttcgttcacatgctatttaaatgcacaaaatagacagtaaggatttatctgttcagtttttcttcccagtgaattaatttcagcttatatgggtgtcttcatttgaacatgaggaatattaggttatattttcagcagtggttttttcctttgccctttaaggagtggggataatgtccacggtggcccagcctcttgctgatggcaccttccctgcattgctgcctcccgatgatgtggttcttttcttgtgcctgtggctttgggaatgtaacatctctttcctcctttccttcccttttcctcttcacctgaggtcctaaatactctctgtaattactgtgttcttcacggtaattagacatcattcagtgaataaattactgtagtcaaagacagtatgggctggcagtttgtgtaattgcaagttcataaagagaattgagggtccagttgggagaactattagtcagttcttttatatgctgataaatgatccctcgagttcagttagtattctgtccagagtgtttagctcactttcttagcagtgtgtaagctttctccatgtcagaagcaagcctgctctttgataaatctgtcttcctgaaaatctaaatcatgcttttgtctttagatctacacagaaatgaccctccttggatcagttttctttccagtctaatcatctttggaactaaaacttgttctaactcgtctcttggcattcagctactcctagatcttttggttttatcccctggcctcagagccatttatattcccagagtaggcagtacaggatctcgtgttgatttgctgtggttacccagtgtcttctctacatggcataaagcggcaaagcccaccattaggtgaggcggtcccgagttgaggtagagtggggcagaggaagatggcagtgaatatcaaacagtagaccgccatcaacttctaacagccagtacacacactgtttcattttgaggtaacgttcagttttgcattttgtttaaatattgaaggcctagacaaagaactagaaaaaaaaaagcagtttccaggcccatccatattgtaatttttctttatctgcagatattgcctgtagtctaaagatctctttggaagacaaagcattggctatatatcttttgccttttccatgcatctaaatcttctctggagattatctccctactgtgtaggttaagggcagtctcgacttttccttttttgagtcctgtgtggctctttgaatcagcgtgaaactgaggctccagctccctgtgttgtgtgtgtgtgccatccatgggcttgggtgtcagtttgtcacaggtatctgccagcattcaaggttttggatcatttcatgaggatctttcctttgactgggtgctgtgaggacacacctgggtctgtgcctgagattgccaggcaagattaaggaaagttttcatgtggcttttgttttgaggttattctcaaaaccttaatttcttatattttctgttgactaaggcaccagtaacccattcttcaccctccatttgtatggcaatttaaaagtctttggctttgctctgaatttaattaaaactgccttttatgaacagacttcgagttttgccattttgggcaagcccttccgcttgtcccttcctagtggctaataaagtaaaaaaacccacactactttgttctctttttctcatattcattgggctgttgtattcagccagtctcatgctttccctgggtcttcacggattgctttccaagctgccttgttgcggggttgctgcagagcagcaactggacctttccagctgtcgccatgttccttccactaaagtagagggttcttaaaatggaaaaacctgtgggctcttcatatacctccctttagttaagtaatagaccaggcagcttctcatctcagcatttacctgttaatatttttgtgaatagtgctctctacctgtgggtggccgttctcttccacttgctcgtctccccccagccccattctgcataatctaccattcttctcctctctttctcttcttatacagaccctcattactggggcccaagatgtgggatactactgttagtattatttaactattttgtagatttaaaagatttctggttaagggaggtgggggtcactgttcatcactcttaaaatatgtgttttctctatagaaaagtaaaatgtgtttatggtcccaaacagtcaactcacaaatttttataacaaaatttccttgtaaaaactagggaccatctatatattccctttaagatctagttctttttgtaggtgttcagcaatggtgataaagcagaatattctcctacctcacgtcattaaagtcagaagattatagaccttctcaaactataagtccctcttcttgccgttggcctttctgactctggaatgaccactgttcattgaaaaatagttttctgactattggtctggctctaacagtttgtttgttcatccagcaaatgtttatgagtgatgaccatgtgccagaaatgtcaggtatgtgtccttcccttggcgccacatagtagtttactaatgtttgggggattgtacttggactgtcatagcctctgcgtttgaccttaaaatagctcttcccagtaagattgtgcaatttttattcacagctcttccatgtagacttacctttcctcatagagctatcctggttaataacaggccaagattctcccattatcccctgttgtctcctgtagctttgataatgcctgggagattccttggtgtaagtgtcatggataccgactgtttttatgttggaatttgttccaacataattagaatctgtttggtgagttgaaaggtaagttggctcagagttgcacagtagggcattaaatgtttaagcaaagcatctgcccacactcccctttccaatctagtgccttccttgaactttttcctgagctgctacgtccctaatcccccttgttgggaggattttcgtatcacccttatgggacctgtcaccatgtcctgtactatttggaattggttttccagtctttcaacaaccgttgtggctaactatgttttagaagggctggaggtgtgggccctgtcttcgggtctcaggacccaaagatcctttagtcagttgttgggtcttccaagagccagacattaatacagattgaactccatcagtcccctaattgtcagcctttacctccctcccagagcaaggagtttagggattctaaagcttagtgtccacacatcattctaccagaccttagagctttagaagctcaatctaaaatactgtaactcagcataaactattactatcactcctttgaactcagtctccatgagcagtgttttgttggaaatacatagaacggcttaatgcctagagggtggtggatagtgaaggacggtcaaggttatatttttgactgcttagggattctttggatccaagaaacagaaatgttcaagcggaataaaggagggagtggagttgtggtaaggatgcagggtatttcgcagaacccaggacgggaagtgcctttggttcttgggtggagctggaactgcagagctttgcacctagtcctttctcccgcttcacagtctgcttatggtatatgtggcccccaaataggcactctagtcctcaagtctacaccaccttccaactctggggatcaccatgaacaaattctcaatttcccatacttaattttttttttttttgagatggagtctcgctgtgtcgcccaggctggagtgcagtggtgcagtctcaactcaccacaacctctgcctcccaggttcaagcagttctctgcctcaacctcccgagtagctgggattacaggcgcctgccaccatgcccagctaatgttcatatttttagtagagacagggtttcaccgtcttggctaggctggtcttgaactcctgaccctcatgatccacccacctcggcctcccaaagtgctaagattacaggcgtgagccaccgcgcccggcccatacttcgtattcttaaaaaaaactacactcagcccagcacattgatcaagtatctatctctgagcagttggccttgccagggagagcagagatgtggcaggctccttcagctggagacagggagcttctcagagaagtgagcagagactccacagacaccctaaaaaggcttctactcaagaagtaaagccactactcctgcctttttgcttagtggacaggaaggcacaggagtttgtctgggacatcatagaaattcttaggtttaacttaattctggtcattgtcttctttatttcctgtttttcttccctttgtcagtcttcgcatccaagatttcttccctccctcttgtgggccagcctgtcctgttccagagctagcctgttcctgggtagccttccttagcctccattcagcctcaggtcttttgccttcttccgtgtttatttagagagcagaatctaataacgggttccactgtagccactatccatggacttctgggtcctcttcaggtttgagtgcttgaaaatgttcattctctgggcttgtggcctgtctcctccactctcctcctcaccctctcgctccttcctgtgtgagggccgctctgcagtaatgttctcaggcaagccttcctaggcacctcagaaactactttgccagagccagtaagaatatataatattggagcagttgccaggatagaaattaaatatagattccagtttaggatagagtttttaccgagagctctttagacagtatacctgtgtcttctctggcaattgctttcattttagtcctatataaaagctttccttttctgtttttttttaaaactatgcttttgcttgcctaaatcttttgatcttatatttctctcatctcagagcctgtcctgagttgtaaggtatttcatactgccttacttaaaagttttttaaactactagagtcatttgatacacacagaagttacctaataatccaaagatgtccatcaagggaggaagggtgggtcatcagactttgcctttgatgttgtagactaggctcctgagttaagcagcagagggacagcagtgccatgtgccttcactgtgtcccaggaaatctgggttggttccagtgggaaataccagtatttcttggttctggaaagtagcaaaagagtaggagatggggaaatagggatggggagagcaagccccgcatgtccatggcgagtcaggtggggagcacgggtggaagggccggctgttgacagacagactaagctgtgtggtgctcttgccgccccttcctgggtacagagcttgagaaaaatgcagccgaccactccctgtgtttgtacagagcaaagcccaaaagccaacctcagatctcctgatttggcagctgaagaaatcagcagagtcctgattgcctgattcagtcccaaaaatgaatgtcaggccccgccccctccccaccaacattgcctctcctacattctccttctgcccctaaatcagacaggaggccagagaggagtattgctcaatgcgtgctatgtgcaactcctcaggccttgtgccacctccatgctgagccctgaagcagggtgtcctgggtgcctgtgtgtcagctccctcctctctacctacctctgaccttcttgtgggtgagggtggccatgcttatggccatcttaaaactggagaggcagagaactacttatgagtctgtagaccacgtgttgtcttccatggcctgtttctcctgctgtctgggtgagtgagcctgcaacgcaatgcccatgagagtaaatgcctcctgacctaccctgctcagcactgttctagtgtcttggccttgaaagaaaagcctgacttcctgctgacacatgtggtaggggcatggcagctatgaggcacctcctacgtctgttttctggctgtggtgacttgggatttttaaccttatatatctttttcctttactcaaaacaaaacaatttttagcacactg

SEQ ID NO: 4685 - DNA, 6780 bp, Homo sapiens
ctgggtcctgtgtgtgccacaggggtggggtgtccagcgagcggtctcctcctcctgctagtgctgctgcggcgtcccgcggcctccccgagtcgggcgggaggggagagcgggtgtggatttgtcttgacggtaattgttgcgtttccacgtctcggaggcctgcgcgctgggttgctccttcttcgggagcgagctgttctcagcgatcccactcccagccggggctccccacacacactgggctgcgtgcgtgtggagtgggacccgcgcacacgcgtgtctctggacagctacggcgccgaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 4686 - DNA, 3430 bp, Homo sapiens
cctttcagccccagatggctttggctcccggtcccgacgctcacgcccacctgccaccccttattgaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttga

SEQ ID NO: 4687 - DNA, 3350 bp, Homo sapiens
ctgggtcctgtgtgtgccacaggggtggggtgtccagcgagcggtctcctcctcctgctagtgctgctgcggcgtcccgcggcctccccgagtcgggcgggaggggagagcgggtgtggatttgtcttgacggtaattgttgcgtttccacgtctcggaggcctgcgcgctgggttgctccttcttcgggagcgagctgttctcagcgatcccactcccagccggggctccccacacacactgggctgcgtgcgtgtggagtgggacccgcgcacacgcgtgtctctggacagctacggcgccgaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggtacgtatagaatataatttcctttgtgatgtacatcttaatggtcagaatttaaaggcaaaatttcatgccattgtactgaaaatacattaaggttttgtgttatcctctaggagatgtttttgattcagcctctgatcccgtgccattaccacctgccaggcctccaactcgggacaatccaaagcatggttcttcactcaacaggacgccctctgattatgatcttctcatccctccattaggttgaaacctttaaaaaagttttgaacaacccacccctccttcttttaatttcagaattttcagaattcagagttcagtataacacagactcactgggttgtgaatttgcctgaaatttgaatgggttctccaggtgccggtgactcccaagttcacgagaccattactccatgtagatgattaaggtagtagtgtagtagttgggcatcagtcaggttttaagcaagttgttttgtccatactaaatgtagtctaaaaacacatgagagctttgtgctctagtagttttgaagtgatgacttgaagtgttgagattttctttaagtataataattcttaataaatatgaacttgcttttcttgcagcatgagcaccagttccacttacgctaattaaattatgcaaaattaaatagttgtatgtagagaactgataataaattctgttttattctaatcattacaactgtaacacattcaaaaaaa

SEQ ID NO: 4688 - DNA, 3237 bp, Homo sapiens
ctgggtcctgtgtgtgccacaggggtggggtgtccagcgagcggtctcctcctcctgctagtgctgctgcggcgtcccgcggcctccccgagtcgggcgggaggggagagcgggtgtggatttgtcttgacggtaattgttgcgtttccacgtctcggaggcctgcgcgctgggttgctccttcttcgggagcgagctgttctcagcgatcccactcccagccggggctccccacacacactgggctgcgtgcgtgtggagtgggacccgcgcacacgcgtgtctctggacagctacggcgccgaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggttgaaacctttaaaaaagttttgaacaacccacccctccttcttttaatttcagaattttcagaattcagagttcagtataacacagactcactgggttgtgaatttgcctgaaatttgaatgggttctccaggtgccggtgactcccaagttcacgagaccattactccatgtagatgattaaggtagtagtgtagtagttgggcatcagtcaggttttaagcaagttgttttgtccatactaaatgtagtctaaaaacacatgagagctttgtgctctagtagttttgaagtgatgacttgaagtgttgagattttctttaagtataataattcttaataaatatgaacttgcttttcttgcagcatgagcaccagttccacttacgctaattaaattatgcaaaattaaatagttgtatgtagagaactgataataaattctgttttattctaatcattacaactgtaacacattcaaaaaaa

SEQ ID NO: 4689 - DNA, 561 bp, Homo sapiens
gctgtcctgggtagaagggtttggcagccctagggagatgaatttctccagcgttggacccgcccagagcggagaagcaacacccttccagccactactctgttgctatgaaacaaaagactaggaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacag

SEQ ID NO: 4690 - DNA, 1632 bp, Homo sapiens
ttcagccccagatggctttggctcccggtcccgacgctcacgcccacctgccaccccttattgaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcaggtttctgataattttacagaatatcttatttatttaacatgatacaaagacattctaaatagtaagagctttgcttcttcaccttgtcaaggaagagagtaaaagtaatcttcctacattaaacctaactgctcattctaggaaccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcagccagaagttattgagtttctgtgggagatactgtgctttgaaaattcttggtatggatccaacctattctcagtgcatttatatacatataatttttccagttataattgctatgtttaaaaaaagatttgtggcaacctcatagctacatgaaatatagcaaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggc

SEQ ID NO: 4691 - DNA, 1579 bp, Homo sapiens
actctgggcgaggccgcccctatcccagccgcaccggtccttcccggcacacgcgaggctcccatggctctggcggtggccccgtgggggcgacagtgggaagaggcccgcgccctgggccgggcagtcaggatgctgcagcgcctagaagagcaatgcgtcgacccccggctgtccgtgagtcccccttcgctgcgggacctgctgccccgcacagcgcagctgcttcgagaggtggcccattctcggcgggcggccggcggaggcggccccgggggtcccggcggctctggggactttctactcatctacctggccaatctggaggccaagagcaggcaggtggccgcgctgctgcctccccggggccgaaggagtgccaacgacgagctcttccgggcgggctccagactcaggcgacagctggccaagctggccatcatcttcagccacatgcacgcagagctgcacgcactcttccccgggggaaagtactgtggacacatgtaccagctcaccaaggcccccgcccacaccttctggagggaaagttgcggagcccggtgtgtgctgccctgggctgagtttgagtccctcctgggcacctgccaccctgtggaaccaggctgcacagccctggccttgcgcaccaccattgacctcacctgcagcgggcacgtgtccatcttcgagttcgacgtcttcaccaggctctttcagccatggccaacactcctcaagaactggcagctcctggcagtcaaccacccaggctacatggccttcctcacctatgatgaggtccaagagcgtctgcaggcctgcagggacaagccaggcagttacatcttccggcccagctgtactcgcctggggcagtgggccatcggctatgtgagctcagatggcagcatcctgcagaccatccctgccaacaaacccctgtcccaggtgctcctggagggacagaaggacggcttctacctctacccagatggaaagacccacaacccagacctgactgagctcggccaggcagaaccccagcagcgcatccacgtgtcagaggagcagctgcagctctactgggccatggactccacatttgagctctgcaagatctgtgctgagagcaacaaggatgtgaagattgagccgtgcgggcacctgctctgcagctgctgcctggctgcctggcagcactcggacagccagacctgccccttctgccgctgcgagatcaagggctgggaggccgtgagtatctaccagttccacggtcaggctactgctgaggactcagggaacagcagtgaccaggaaggcagggagttggagctggggcaggtgcccctttcggctcctccattgcccccacggccagatctgccccccaggaagcccagaaatgcccagccgaaagtgagactcctaaaggggaactcccctccagctgcgctgggaccccaggaccctgccccggcctgaaggccagggcacccagatgtgctgctcaagggagccccaagggctggaagggggttgtgaaaccgaaataaactgccaagcctggtctgtc

SEQ ID NO: 4692 - DNA, 1441 bp, Homo sapiens
actctgggcgaggccgcccctatcccagccgcaccggtccttcccggcacacgcgaggctcccatggctctggcggtggccccgtgggggcgacagtgggaagaggcccgcgccctgggccgggcagtcaggatgctgcagcgcctagaagagcaatgcgtcgacccccggctgtccgtgagtcccccttcgctgcgggacctgctgccccgcacagcgcagctgcttcgagaggtggcccattctcggcgggcggccggcggaggcggccccgggggtcccggcggctctggggactttctactcatctacctggccaatctggaggccaagagcaggcaggtggccgcgctgctgcctccccggggccgaaggagtgccaacgacgagctcttccgggcgggctccagactcaggcgacagctggccaagctggccatcatcttcagccacatgcacgcagagctgcacgcactcttccccgggggaaagtactgtggacacatgtaccagctcaccaaggcccccgcccacaccttctggagggaaagttgcggagcccggtgtgtgctgccctgggctgagtttgagtccctcctgggcacctgccaccctgtggaaccaggctgcacagccctggccttgcgcaccaccattgacctcacctgcagcgggcacgtgtccatcttcgagttcgacgtcttcaccaggctctttcagccatggccaacactcctcaagaactggcagctcctggcagtcaaccacccaggctacatggccttcctcacctatgatgaggtccaagagcgtctgcaggcctgcagggacaagccaggcagctacctctacccagatggaaagacccacaacccagacctgactgagctcggccaggcagaaccccagcagcgcatccacgtgtcagaggagcagctgcagctctactgggccatggactccacatttgagctctgcaagatctgtgctgagagcaacaaggatgtgaagattgagccgtgcgggcacctgctctgcagctgctgcctggctgcctggcagcactcggacagccagacctgccccttctgccgctgcgagatcaagggctgggaggccgtgagtatctaccagttccacggtcaggctactgctgaggactcagggaacagcagtgaccaggaaggcagggagttggagctggggcaggtgcccctttcggctcctccattgcccccacggccagatctgccccccaggaagcccagaaatgcccagccgaaagtgagactcctaaaggggaactcccctccagctgcgctgggaccccaggaccctgccccggcctgaaggccagggcacccagatgtgctgctcaagggagccccaagggctggaagggggttgtgaaaccgaaataaactgccaagcctggtctgtc

SEQ ID NO: 4693 - DNA, 2003 bp, Homo sapiens
actgtgctctgcgagccgaatcatggatcacactgacaatgagttacaaggcactaatagttctggatccttgggtggtcttgatgttcgcagacgaattcctataaagctcatctccaaacaagcaaacaaagcgaaacctgcaccgcgaactcaaagaactataaacaggatgcctgcaaaggctccacctggtgatgaaggatttgattataatgaagaagaacggtatgactgtaaagggggtgagctgtttgcaaatcagcgaagatttcctggacaccttttttgggactttcagataaacatcttaggtgaaaaggatgatacaccagttcatttctgtgacaagtgtggattgcctattaaaatctatgggagaatgattccatgcaagcatgttttttgctatgactgtgctattttacatgaaaaaaagggagataagatgtgtccaggctgtagtgatcctgtgcagcgaattgagcagtgtacacgaggttctctcttcatgtgtagcattgttcaagggtgcaagagaacatatttgtctcagagagacttacaggctcatatcaaccatcgccatatgagagctggaaaacctgttacccgtgcttcacttgaaaatgttcatcctcctattgccccaccaccaactgaaatccctgagcgttttataatgccaccagacaagcaccatatgagccatattccgccaaagcagcacatcatgatgccaccacctcctttgcaacatgtgccacatgagcactataatcagccacatgaggatattcgtgctcctccagcagaattgtccatggctccacctccacctcgatcggtcagtcaggaaacctttcgtatttcaacaagaaaacacagcaatttaataaccgtccctattcaggatgactcaaattcaggtgctagagaaccaccacctcctgccccagcacctgctcaccatcatcctgaatatcagggtcaaccagtggtatcgcaccctcatcatattatgcctccacagcaacattatgcaccacccccacctcctccaccaccaataagccatccaatgccacatcctccccaggctgcaggtactcctcacttggtatatagccaagctccacctccaccaatgacctctgctccaccaccaataacccctccccctggacatattattgcccagatgccaccttatatgaatcatcctcctccaggacctcccccacctcaacatggtggtccacctgtaactgcaccccctcctcaccattataatcctaactcattaccccagttcactgaagatcaaggaactctgagccctccatttacacaaccagggggaatgagtcctggtatatggcctgcaccaagagggccaccaccacctccacgattgcagggtccgccttctcaaaccccacttcctggaccacatcatccagatcagacaagatatagaccgtattaccaatgataatagtattttgaatggaagatatgagggggaaaaaaacttatgtgtagtcaatcttttaagctttgactgttttgggaaggaagagtacctcttatcgaggtagtataaaacacatagggtcttgtttcttaaaatggttttaaatcttgaccttaagattgatttcaagtaccatactgtagtacagataagtggctcagttgagcacagctatattttaacatctctttgttcccctagtttagtaaattgacccagaggtgaccatttgtaaaaaatttgaaaaaatttttcattgttttacttcaaaagtattgttttgttaaacccaacgtttagtttttcttgtgatacattttgttaacctgtgtaaaaggattaaatttcaatatggttgtaaaaatgctatttttatgtgaatttaagtgcagccacatactgttttttaaaccatatgttttaccactaatttcccaaagttataataaaatcctgaaagtaaaaa

SEQ ID NO: 4694 - DNA, 2349 bp, Homo sapiens
gttactccgcccgccggggtggggccagcgcaacggccgagcctgcgcagccagccggctccgggggccccgcgcactacaagtcccagaaggcagctctccgcggggcgggcagtcgccttatctgcttctggctcatttttaccactgctctccccttccccggtccccctggtgtcctttccacagttaaaggctactttctcttgaagcacatgaggagaagccttagcaacctcaataccgaagttcttcgcgcgctcgctctttctgcctccgcccgaactatgcctgagtccctcacaggagttggatagtagaggcgagagaaggaagtctttgcaggccaaaattgggacaacctgcttggacttccgcctcccggcctccggaaggcagtgcgcacgcgctcgctgcgactccggcgcggttgacttccgctcccactgtgctctgcgagccgaatcatggatcacactgacaatgagttacaaggcactaatagttctggatccttgggtggtcttgatgttcgcagacgaattcctataaagctcatctccaaacaagcaaacaaagcgaaacctgcaccgcgaactcaaagaactataaacaggatgcctgcaaaggctccacctggtgatgaagaaggatttgattataatgaagaagaacggtatgactgtaaagggggtgagctgtttgcaaatcagcgaagatttcctggacaccttttttgggactttcagataaacatcttaggtgaaaaggatgatacaccagttcatttctgtgacaagtgtggattgcctattaaaatctatgggagaatgattccatgcaagcatgttttttgctatgactgtgctattttacatgaaaaaaagggagataagatgtgtccaggctgtagtgatcctgtgcagcgaattgagcagtgtacacgaggttctctcttcatgtgtagcattgttcaagggtgcaagagaacatatttgtctcagagagacttacaggctcatatcaaccatcgccatatgagagctggaaaacctgttacccgtgcttcacttgaaaatgttcatcctcctattgccccaccaccaactgaaatccctgagcgttttataatgccaccagacaagcaccatatgagccatattccgccaaagcagcacatcatgatgccaccacctcctttgcaacatgtgccacatgagcactataatcagccacatgaggatattcgtgctcctccagcagaattgtccatggctccacctccacctcgatcggtcagtcaggaaacctttcgtatttcaacaagaaaacacagcaatttaataaccgtccctattcaggatgactcaaattcaggtgctagagaaccaccacctcctgccccagcacctgctcaccatcatcctgaatatcagggtcaaccagtggtatcgcaccctcatcatattatgcctccacagcaacattatgcaccacccccacctcctccaccaccaataagccatccaatgccacatcctccccaggctgcaggtactcctcacttggtatatagccaagctccacctccaccaatgacctctgctccaccaccaataacccctccccctggacatattattgcccagatgccaccttatatgaatcatcctcctccaggacctcccccacctcaacatggtggtccacctgtaactgcaccccctcctcaccattataatcctaactcattaccccagttcactgaagatcaaggaactctgagccctccatttacacaaccagggggaatgagtcctggtatatggcctgcaccaagagggccaccaccacctccacgattgcagggtccgccttctcaaaccccacttcctggaccacatcatccagatcagacaagatatagaccgtattaccaatgataatagtattttgaatggaagatatgagggggaaaaaaacttatgtgtagtcaatcttttaagctttgactgttttgggaaggaagagtacctcttatcgaggtagtataaaacacatagggtcttgtttcttaaaatggttttaaatcttgaccttaagattgatttcaagtaccatactgtagtacagataagtggctcagttgagcacagctatattttaacatctctttgttcccctagtttagtaaattgacccagaggtgaccatttgtaaaaaatttgaaaaaatttttcattgttttacttcaaaagtattgttttgttaaacccaacgtttagtttttcttgtgatacattttgttaacctgtgtaaaaggattaaatttcaatatggttgtaaaaa

SEQ ID NO: 4695 - DNA, 1983 bp, Homo sapiens
accactgctctccccttccccggtccccctggtgtcctttccacagttaaaggctactttctcttgaagcacatgaggagaagccttagcaacctcaataccgaagttcttcgcgcgctcgctctttctgcctccgcccgaactatgcctgagtccctcacaggagttggatagtagaggcgagagaaggaagtctttgcaggccaaaattgggacaacctgcttggacttccgcctcccggcctccggaaggcagtgcgcacgcgctcgctgcgactccggcgcggttgacttccgctcccactgtgctctgcgagccgaatcatggatcacactgacaatgagttacaaggcactaatagttctggatccttgggtggtcttgatgttcgcagacgaattcctataaagctcatctccaaacaagcaaacaaagcgaaacctgcaccgcgaactcaaagaactataaagaaggatttgattataatgaagaagaacggtatgactgtaaagggggtgagctgtttgcaaatcagcgaagatttcctggacaccttttttgggactttcagataaacatcttaggtgaaaaggatgatacaccagttcatttctgtgacaagtgtggattgcctattaaaatctatgggagaatgattccatgcaagcatgttttttgctatgactgtgctattttacatgaaaaaaagggagataagatgtgtccaggctgtagtgatcctgtgcagcgaattgagcagtgtacacgaggttctctcttcatgtgtagcattgttcaagggtgcaagagaacatatttgtctcagagagacttacaggctcatatcaaccatcgccatatgagagctggaaaacctgttacccgtgcttcacttgaaaatgttcatcctcctattgccccaccaccaactgaaatccctgagcgttttataatgccaccagacaagcaccatatgagccatattccgccaaagcagcacatcatgatgccaccacctcctttgcaacatgtgccacatgagcactataatcagccacatgaggatattcgtgctcctccagcagaattgtccatggctccacctccacctcgatcggtcagtcaggaaacctttcgtatttcaacaagaaaacacagcaatttaataaccgtccctattcaggatgactcaaattcaggtgctagagaaccaccacctcctgccccagcacctgctcaccatcatcctgaatatcagggtcaaccagtggtatcgcaccctcatcatattatgcctccacagcaacattatgcaccacccccacctcctccaccaccaataagccatccaatgccacatcctccccaggctgcaggtactcctcacttggtatatagccaagctccacctccaccaatgacctctgctccaccaccaataacccctccccctggacatattattgcccagatgccaccttatatgaatcatcctcctccaggacctcccccacctcaacatggtggtccacctgtaactgcaccccctcctcaccattataatcctaactcattaccccagttcactgaagatcaaggaactctgagccctccatttacacaaccagggggaatgagtcctggtatatggcctgcaccaagagggccaccaccacctccacgattgcagggtccgccttctcaaaccccacttcctggaccacatcatccagatcagacaagatatagaccgtattaccaatgataatagtattttgaatggaagatatgagggggaaaaaaacttatgtgtagtcaatcttttaagctttgactgttttgggaaggaagagtataaatcaacattcttaggatattatttatatcctttgaataaatccctgtgaagtttttcctccccactaaaatggtgcataataaaacatgaaatatgtagtatgcagatatcatttattagatag

SEQ ID NO: 4696 - DNA, 1066 bp, Homo sapiens
gacttagtagccatgaaggtcctcatcctcgcctgcctggtggctcttgctcttgcaagggagaccatagaaagcctttcaagcagtgaggaatctattacagaatacaagcagaaagttgagaaggttaaacatgaggaccagcagcaaggagaggatgaacaccaggataaaatctacccctctttccagccacagcctctgatctatccattcgttgaacctatcccctatggttttcttccacaaaacattctgcctcttgctcagcctgctgtggtgctgcctgtccctcagcctgaaataatggaagtccctaaagctaaagacactgtctacactaagggcagagtgatgcctgtccttaaatctccaacgatacccttttttgaccctcaaatcccaaaactcactgatcttgaaaatctgcatcttcctctgcctctgctccagcccttgatgcagcaggtccctcagcctattcctcagactcttgcacttccccctcagcccctgtggtctgttcctcagcccaaagtcctgcctatcccccagcaagtggtgccctaccctcagagagctgtgcctgttcaagcccttctgctcaaccaagaacttctacttaaccccacccaccagatctaccctgtgactcagccacttgccccagttcataaccccattagtgtctaagaagatttcaaagttaattttccctccttatttttgaattgactgagactggaaatatgatgccttttccgtctttgtatcacgttaccccaaattaagtatgtttgaatgagtttatatggaaaaaatgaactttgtccctttatttattttatatattatgtcattcatttaatttgaaatttgactcatgaactatttacattttccaaatcttaattcaactagtaccacagaagttcaatactcatttggaaatgctacaaacatatcaaacatatgtatacaaattgtttctggaattgtgcttatttttatttctttaagaatctatttcctttccagtcatttcaataaattattcttaagcata

SEQ ID NO: 4697 - DNA, 836 bp, Homo sapiens
atttttcttgggtcttctctacagctgacaggccaactcaacctactgccaaccaagacctgactggcacgaggaaaggtgcaataatgaagagttttcttctagttgtcaatgccctggcattaaccctgccttttttggctgtggaggttcaaaaccagaaacaaccagcatgccatgagaatgatgaaagaccattctatcagaaaacagctccatatgtcccaatgtattatgtgccaaatagctatccttattatggaaccaatttgtaccaacgtagaccagctatagcaattaataatccatatgtgcctcgcacatattatgcaaacccagctgtagttaggccacatgcccaaattcctcagcggcaatacctgccaaatagccacccacccactgtggtacgtcgcccaaacctgcatccatcatttattgccatccccccaaagaaaattcaggataaaataatcatccctaccatcaataccattgctactgttgaacctacaccagctcctgccactgaaccaacggtggacagtgtagtcactccagaagctttttcagagtccatcatcacgagcacccctgagacaaccacagttgcagttactccacctacggcataaaaacaccaaggaaatatcaaagaacacaacgcaggacttgctgaaaccaaattactacttcacactctccttcagccatttgtctgccttcagtcaacagaaaatgtgattttcacagattcagctcttctctccttacattttacattcatgccacattcaatattttgattcttgcacaataaagccaactgattgcaa

SEQ ID NO: 4698 - DNA, 6067 bp, Homo sapiens
gggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctaggttactactctttactttgttcacccattggggggtgcagtttttttaaaatgttgggagatggccattctaactactgttgaatgtctctgttttgggaaggtataacaagaaataaaaaagaatatatatgaagggagagactggttatctcctcccatatggttgtgcttatcctcttatggcttacaaatgaatatttggaggtttgctttcacaatgatttcccatcaacaaatatttttagtaggatttttcctgtttctgttagtccttgcagtactcataaatgttttaagctgagcatactgtaatagtcataagtttaatttcattataataaaaataatcaaacaaaaggactttagaacccaagacaatgagctagttttccctaaagtttgctgaactattaaggaatatgttcttatagcttttgactagaatgagtcatgggaattctaagaagggatggcctagacatttttagctcagttaaattcagcatttaatgcaggtgagttcctgggtcgttttccaactagtctggaacagtctggttctgactcaaactggtataaagcattattttaggttttctctttgccagtttttaagcagttataaccatgtaaatcaagatgtgaggacatctatatgaagtatagtaaagaagtggtgtcagcagatcaatatgtgtgtcctgggtgtgctgctctcttaagtgagactttgtgagactatactttaaatgcattattaccattgcttacattttgggggattttcttcctcctcaaaacttccatttctattgtaatattcttaatgacaatctttttttttttttagcagtgtatgtttgaaacagccaaagatggcgatgaaccaagtgtaaattgatctaagcagcccatgcagtttgtgttgaatcaacaaacagtgtattgttgaagtgaaattattttctgaaatgacttgttagaccagttttgaggacatactcaaaagtagagtaataatggctcctgggatggagaaatatgagatgaacctggaacattctattatggtgccacaaaggaaatctaaaaaaaaaaaaaaaaaaaaaagtggttggctaggagcagtggcacacgcctgtgattccagcactttgggaggccgaagtgggcaggagttcaagaccagcctggccaacatagtgaaaccctgtctctactaaaaatacaaaaattagccgggtgtggtggcgggcgcctgtaatcccagcttttcaagaggctgaggcagaagaatcgcttgaacccgggagatggaggttgcagtgagctgagatcgtgccactgcactccagcctgggcgttgcagtgagactccgtctcaacaacaacaaaaaggtggatacatgtcaaaagggcacaggagccacttgaaggattatacttgctaaatctgtgtcaattatcaaaataaactggtagcaacgttacaactcactgaataagataccatgattccatgttgacttaaaaatggagagaagagaaagctctaacttgaatgtcagctaatttaaggtgaaaggattttatgtgttagaaaaatcaccattttgcaaactagttttcagaatccttaatatatgtcatctcttttattcctcataacagtaataagaaacagttaactgtttcagaaaagagtggggctgcccaaggcaaggcatgttggtaattggtaagctttatagagccaagacctcaacctgattttcttgctttcatgcagttaagccatggtgctcctcttgttatatcacccttttaaacccagagattgatagtattagccatcatttgctgagtgtcatgcactattctaagtgctttacatgtatttgcctaatcagcgccctgtgaagtacatcctgtctccattttgcatataaggataccaaagcacagagttggagggaagatagttatattcccttactttatttatttatttttttgagacagggtctcgcactgtcgcccaggcttgagtgctataagaccttaagtttcccctttcaaagtagtttatagtgtctaaatatcttacataaaagtatatatcaaatagggtggcagtctggaaagatttaaaatccagaatgactggaaggttgggcaactaagatttcttaaattgcagctgttttcaacatagatgtgttgtagagtcttttcggtttcaaaattaaattgactataaatggagtgtgcttaa

SEQ ID NO: 4699 - DNA, 1331 bp, Homo sapiens
attttgtgttggctggagctggagtaacaagatggcgtcgtccgcggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgt

SEQ ID NO: 4700 - DNA, 3065 bp, Homo sapiens
cctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggcaagcaaactgacaaaaccaagagtaacatgaaaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattg

SEQ ID NO: 4701 - DNA, 1098 bp, Homo sapiens
atggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagtgtttagaatctccagtggggaagaggaaaagaagcatgactgttagtacttctcaggacccatctttctcaggattaaaccagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggcaagcaaactgacaaaaccaagagtaacatgaaaggtttctaa

SEQ ID NO: 4702 - DNA, 1520 bp, Homo sapiens
gcgcgatggcggcggctcctttaggcagctgaaaggggatttaggcccggaagatccgagtccatccgcggcggggagagggcaagcgggaccggtaggggccggagcagcggcggcggcgctcggactgtcccatccgccccgtattgaggcgctgggagcggcggggcgacaggaaagcgatggtgaaagcggggccgtgaggggggcggagccgggagccggacccgcagtagcggcagcagcggcgccgcctcccagagttcagacccaggaagcggccgggagggcaggagcgaatcgggccgccgccgccatggagctgagagtcgggaacaggtaccggctgggccggaagatcggcagcggctccttcggagacatctatctcggtacggacattgctgcaggagaagaggttgccatcaagcttgaatgtgtcaaaaccaaacaccctcagctccacattgagagcaaaatctacaagatgatgcagggaggagatcagtcgcatcgaatacattcattcaaagaacttcatccaccgggatgtgaagccagacaacttcctcatgggcctggggaagaagggcaacctggtgtacatcatcgacttcgggctggccaagaagtaccgggatgcacgcacccaccagcacatcccctatcgtgagaacaagaacctcacggggacggcgcggtacgcctccatcaacacgcaccttggaattgaacaatcccgaagagatgacttggagtctctgggctacgtgctaatgtacttcaacctgggctctctcccctggcaggggctgaaggctgccaccaagagacagaaatacgaaaggattagcgagaagaaaatgtccacccccatcgaagtgttgtgtaaaggctacccttccgaatttgccacatacctgaatttctgccgttccttgcgttttgacgacaagcctgactactcgtacctgcggcagcttttccggaatctgttccatcgccagggcttctcctatgactacgtgttcgactggaacatgctcaaatttggtgccagccgggccgccgatgacgccgagcgggagcgcagggaccgagaggagcggctgagacactcgcggaacccggctacccgcggcctcccttccacagcctccggccgcctgcgggggacgcaggaagtggctccccccacacccctcacccctacctcacacacggctaacacctccccccggcccgtctccggcatggagagagagcggaaagtgagtatgcggctgcaccgcggggcccccgtcaacatctcctcgtccgacctcacaggccgacaagatacctctcgcatgtccacctcacaggtaggtgcagagctcccgggcgggcgctgggcctcgggctaccccgtccgagtcaagagcgggctgtggtttctccagggcttcttctttcctttcttccccccatttttgagagtttttaatctcgccagggtgtggcgtcttggttgcagatga

SEQ ID NO: 4703 - DNA, 1975 bp, Homo sapiens
gcgcgatggcggcggctcctttaggcagctgaaaggggatttaggcccggaagatccgagtccatccgcggcggggagagggcaagcgggaccggtaggggccggagcagcggcggcggcgctcggactgtcccatccgccccgtattgaggcgctgggagcggcggggcgacaggaaagcgatggtgaaagcggggccgtgaggggggcggagccgggagccggacccgcagtagcggcagcagcggcgccgcctcccagagttcagacccaggaagcggccgggagggcaggagcgaatcgggccgccgccgccatggagctgagagtcgggaacaggtaccggctgggccggaagatcggcagcggctccttcggagacatctatctcggtacggacattgctgcaggagaagaggttgccatcaagcttgaatgtgtcaaaaccaaacaccctcagctccacattgagagcaaaatctacaagatgatgcagggaggagtgggcatccccaccatcagatggtgcggggcagagggggactacaacgtcatggtgatggagctgctggggccaagcctggaggacctcttcaacttctgctccaggaaattcagcctcaaaaccgtcctgctgcttgctgaccaaatgatcagtcgcatcgaatacattcattcaaagaacttcatccaccgggatgtgaagccagacaacttcctcatgggcctggggaagaagggcaacctggtgtacatcatcgacttcgggctggccaagaagtaccgggatgcacgcacccaccagcacatcccctatcgtgagaacaagaacctcacggggacggcgcggtacgcctccatcaacacgcaccttggaattgaacaatcccgaagagatgacttggagtctctgggctacgtgctaatgtacttcaacctgggctctctcccctggcaggggctgaaggctgccaccaagagacagaaatacgaaaggattagcgagaagaaaatgtccacccccatcgaagtgttgtgtaaaggctacccttccgaatttgccacatacctgaatttctgccgttccttgcgttttgacgacaagcctgactactcgtacctgcggcagcttttccggaatctgttccatcgccagggcttctcctatgactacgtgttcgactggaacatgctcaaatttggtgccagccgggccgccgatgacgccgagcgggagcgcagggaccgagaggagcggctgagacactcgcggaacccggctacccgcggcctcccttccacagcctccggccgcctgcgggggacgcaggaagtggctccccccacacccctcacccctacctcacacacggctaacacctccccccggcccgtctccggcatggagagagagcggaaagtgagtatgcggctgcaccgcggggcccccgtcaacatctcctcgtccgacctcacaggccgacaagatacctctcgcatgtccacctcacagattcctggtcgggtggcttccagtggtcttcagtctgtcgtgcaccgatgagaactctccttattgctgtgaagggcagacaatgcatggctgatctactctgttaccaatggctttactagtgacacgtcccccggtctaggatcgaaatgttaacaccgggagctctccaggccactcacccagcgacgctcgtgggggaaacatactaaacggacagactccaagagctgccaccgctggggctgcactgcggccccccacgtgaactcggttgtaacggggctgggaagaaaagcagagagagaattgcagagaatcagactccttttccagggcctcagctccctccagtggtggccgccctgtactccctgacgattccactgtaactaccaatcttctacttggttaagacagttttgtatcattttgctaaaaattattggcttaaatctgtgt

SEQ ID NO: 4704 - DNA, 2039 bp, Homo sapiens
gcgcgatggcggcggctcctttaggcagctgaaaggggatttaggcccggaagatccgagtccatccgcggcggggagagggcaagcgggaccggtaggggccggagcagcggcggcggcgctcggactgtcccatccgccccgtattgaggcgctgggagcggcggggcgacaggaaagcgatggtgaaagcggggccgtgaggggggcggagccgggagccggacccgcagtagcggcagcagcggcgccgcctcccagagttcagacccaggaagcggccgggagggcaggagcgaatcgggccgccgccgccatggagctgagagtcgggaacaggtaccggctgggccggaagatcggcagcggctccttcggagacatctatctcggtacggacattgctgcaggagaagaggttgccatcaagcttgaatgtgtcaaaaccaaacaccctcagctccacattgagagcaaaatctacaagatgatgcagggaggagtgggcatccccaccatcagatggtgcggggcagagggggactacaacgtcatggtgatggagctgctggggccaagcctggaggacctcttcaacttctgctccaggaaattcagcctcaaaaccgtcctgctgcttgctgaccaaatgatcagtcgcatcgaatacattcattcaaagaacttcatccaccgggatgtgaagccagacaacttcctcatgggcctggggaagaagggcaacctggtgtacatcatcgacttcgggctggccaagaagtaccgggatgcacgcacccaccagcacatcccctatcgtgagaacaagaacctcacggggacggcgcggtacgcctccatcaacacgcaccttggaattgaacaatcccgaagagatgacttggagtctctgggctacgtgctaatgtacttcaacctgggctctctcccctggcaggggctgaaggctgccaccaagagacagaaatacgaaaggattagcgagaagaaaatgtccacccccatcgaagtgttgtgtaaaggctacccttccgaatttgccacatacctgaatttctgccgttccttgcgttttgacgacaagcctgactactcgtacctgcggcagcttttccggaatctgttccatcgccagggcttctcctatgactacgtgttcgactggaacatgctcaaatttggtgccagccgggccgccgatgacgccgagcgggagcgcagggaccgagaggagcggctgagacactcgcggaacccggctacccgcggcctcccttccacagcctccggccgcctgcgggggacgcaggaagtggctccccccacacccctcacccctacctcacacacggctaacacctccccccggcccgtctccggcatggagagagagcggaaagtgagtatgcggctgcaccgcggggcccccgtcaacatctcctcgtccgacctcacaggccgacaagatacctctcgcatgtccacctcacagaatagcattcctttcgaacaccacggcaagtagctgctcgtctcccatcggaaggcagcactggattcctggtcgggtggcttccagtggtcttcagtctgtcgtgcaccgatgagaactctccttattgctgtgaagggcagacaatgcatggctgatctactctgttaccaatggctttactagtgacacgtcccccggtctaggatcgaaatgttaacaccgggagctctccaggccactcacccagcgacgctcgtgggggaaacatactaaacggacagactccaagagctgccaccgctggggctgcactgcggccccccacgtgaactcggttgtaacggggctgggaagaaaagcagagagagaattgcagagaatcagactccttttccagggcctcagctccctccagtggtggccgccctgtactccctgacgattccactgtaactaccaatcttctacttggttaagacagttttgtatcattttgctaaaaattattggcttaaatctgtgt

SEQ ID NO: 4705 - DNA, 1492 bp, Homo sapiens
acagcgcgatggcggcggctcctttaggcagctgaaaggggatttaggcccggaagatccgagtccatccgcggcggggagagtcgggaacaggtaccggctgggccggaagatcggcagcggctccttcggagacatctatctcggtacggacattgctgcaggagaagaggttgccatcaagcttgaatgtgtcaaaaccaaacaccctcagctccacattgagagcaaaatctacaagatgatgcagggaggagtgggcatccccaccatcagatggtgcggggcagagggggactacaacgtcatggtgatggagctgctggggccaagcctggaggacctcttcaacttctgctccaggaaattcagcctcaaaaccgtcctgctgcttgctgaccaaatgatcagtcgcatcgaatacattcattcaaagaacttcatccaccgggatgtgaagccagacaacttcctcatgggcctggggaagaagggcaacctggtgtacatcatcgacttcgggctggccaagaagtaccgggatgcacgcacccaccagcacatcccctatcgtgagaacaagaacctcacggggacggcgcggtacgcctccatcaacacgcaccttggaattgaacaatcccgaagagatgacttggagtctctgggctacgtgctaatgtacttcaacctgggctctctcccctggcaggggctgaaggctgccaccaagagacagaaatacgaaaggattagcgagaagaaaatgtccacccccatcgaagtgttgtgtaaaggctacccttccgaatttgccacatacctgaatttctgccgttccttgcgttttgacgacaagcctgactactcgtacctgcggcagcttttccggaatctgttccatcgccagggcttctcctatgactacgtgttcgactggaacatgctcaaatttggtgccagccgggccgccgatgacgccgagcgggagcgcagggaccgagaggagcggctgagacactcgcggaacccggctacccgcggcctcccttccacagcctccggccgcctgcgggggacgcaggaagtggctccccccacacccctcacccctacctcacacacggctaacacctccccccggcccgtctccggcatggagagagagcggaaagtgagtatgcggctgcaccgcggggcccccgtcaacatctcctcgtccgacctcacaggccgacaagatacctctcgcatgtccacctcacagattcctggtcgggtggcttccagtggtcttcagtctgtcgtgcaccgatgagaactctccttattgctgtgaagggcagacaatgcatggctgatctactctgttaccaatggctttactagtgacacgtcccccggtctaggatcgaaatgttaacaccgggagctctccaggccactcacccagcgacgctcgtgggggaaacatactaaacggacagactcc

SEQ ID NO: 4706 - DNA, 1040 bp, Homo sapiens
agacccaggaagcggccgggagggcaggagcgaatcgggccgccgccgccatggagctgagagtcgggaacaggtaccggctgggccggaagatcggcagcggctccttcggagacatctatctcggtacggacattgctgcaggagaagaggttgccatcaagcttgaatgtgtcaaaaccaaacaccctcagctccacattgagagcaaaatctacaagatgatgcagggaggagtgggcatccccaccatcagatggtgcggggcagagggggactacaacgtcatggtgatggagctgctggggccaagcctggaggacctcttcaacttctgctccaggaaattcagcctcaaaaccgtcctgctgcttgctgaccaaatgaacaatcccgaagagatgacttggagtctctgggctacgtgctaatgtacttcaacctgggctctctcccctggcaggggctgaaggctgccaccaagagacagaaatacgaaaggattagcgagaagaaaatgtccacccccatcgaagtgttgtgtaaaggctacccttccgaatttgccacatacctgaatttctgccgttccttgcgttttgacgacaagcctgactactcgtacctgcggcagcttttccggaatctgttccatcgccagggcttctcctatgactacgtgttcgactggaacatgctcaaatttggtgccagccgggccgccgatgacgccgagcgggagcgcagggaccgagaggagcggctgagacactcgcggaacccggctacccgcggcctcccttccacagcctccggccgcctgcgggggacgcaggaagtggctccccccacacccctcacccctacctcacacacggctaacacctccccccggcccgtctccggcatggagagagagcggaaagtgagtatgcggctgcaccgcggggcccccgtcaacatctcctcgtccgacctcacaggccgacaagatacctctcgcatgtccacctcacagaatagcattcctttcgaacacc

SEQ ID NO: 4707 - DNA, 2642 bp, Homo sapiens
ggttgggatctgaggggtcctctctgtgcccatcacagtttgagcttcagggaaaagaagaagaggtctttgcccttcgtttttccacgggaggagaatcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggtgcagcccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacagacaagtgtgccatttgaccatctcgggaagtgaggagagcccccattggaccagtgtttgcttagtgtcttcactgtattttctttaaaaaaaaaaaaaaaaaaaaaaaggcaaaaataaaccactcaaaagaacaacaaaaaaacccagcacaaaaccgacgatggagtttgtttctttgatttctttgccaatggcaagaagatgagatgccctcagcactgaggattcttgcccccttgtggtgcccgctgcccccaaccttcaggctgccagatgctcccctgacaacaccaggctacaggagccagacgccagggcctgcccggcctcctgttcctgcccccacccaccacctgcctggagaggaacgggtcgggtccgtgtcggagaagtgacaggtcccagagccaaagccggccctcaagcatcatcagggagtggtgtagtcagttgaaggcagttcccaccgagttttccgagcctcagaatccaggagatacgcacagccccacccactctgagatgacagtggctgacttcccgtgctgggcttttccattgtccccctggcctccaggctcctcctctgcctctccatggagtgggtggggaggtggtgggggccggcgtcccctgcgtgtgtgtgtgtgtgtgtgtgtgtggatgtattgacctgtgtttcccaagacagcaggtgccacggcccgccccgcctgccagcccgaattcccgttctcctgtgtctactaacaaggacatgggggtgggcggtgacctccgcatccctcagagctcagagggtcctcgctgccaccggtccccccctagcccgtcatcagccggtggcagctccatcttccattcctggttttagggcagaatccatggagactgcttccagaaggcatctggctctgagttataaattacttccctggtcctgacagtcacctggggtcccccctctccctggttccacctttctgaggaggagcctggagtcagggctgggttttggattaacccatccttcctagttaacacctttttgtttttattttattttatttttgtttgttttctccgtgtgtgtgttttcctaatttatttacctctgtttcccctttttcctttttttttttaattaaagagcaaagctttttattactttgtaatttaaaaaactgaaaaaaaaaaaactgaagaactttggggggaattttgtacttttttcctgtgtaaatattggacttttttgagctttatcgtggttgttaatttgaagtaataaagtagaaaagataaagtga

SEQ ID NO: 4708 - DNA, 1005 bp, Homo sapiens
cccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacagacaagtgtgccatttgaccatctcgggaagtgaggagagcccccattggaccagtgtttgcttagaaattcatccacacaagagagtggaggcatgaacagggctggccttcctcggatctcaggcccaggaaccaagctgtccatggcgggctgggcagatatttgggggtggggtggggagatgctcaccaggagggcagagaagggagagaatccgtttctgtcacatgaagatggatctcctagcgtgctgggccttgagccaggctctggggcccagagggagatagaccaagggacgagaagacaggagtttggggggccaagtgcagtggctcgcacctgtaatcccagcacttcgggaggcccagacaggtgggtcacttgaggtcaggagttcgagaccagcctggccaacatggtgaaaacccatctctactaaaaacacaaaaattagccgggtgtggtggcacacacctgtaatctcagctactcgggacgctgagacaggagaattgcttgaatctgggaggtggaggttgcagtgagccgagatcgtgccactgcactccagcctgggggacagagcgagactccatctcaaaaaaaaaaaaaagtagccagagacagctgtgtacctcacctgtcttttcccttctcccttctagtgtcttcac

SEQ ID NO: 4709 - DNA, 2791 bp, Homo sapiens
gcgggcgggcgggcaggaggccgggaggagggaggcggcggcggcggcggcggcggcggcgagagcccagagccagagcccggccggggccgagcggagcgcggcggcggcggcggcggcggcggctgggccgggagaggctggcgcgccgggcggctccgcgaatcctccggcatccgccccggcgggccgcccccgcccgcggcagccccccgagcagtggcccggcatcggcgccttcccggcgggcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggtgcagcccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacagacaagtgtgccatttgaccatctcgggaagtgaggagagcccccattggaccagtgtttgcttagtgtcttcactgtattttctttaaaaaaaaaaaaaaaaaaaaaaaggcaaaaataaaccactcaaaagaacaacaaaaaaacccagcacaaaaccgacgatggagtttgtttctttgatttctttgccaatggcaagaagatgagatgccctcagcactgaggattcttgcccccttgtggtgcccgctgcccccaaccttcaggctgccagatgctcccctgacaacaccaggctacaggagccagacgccagggcctgcccggcctcctgttcctgcccccacccaccacctgcctggagaggaacgggtcgggtccgtgtcggagaagtgacaggtcccagagccaaagccggccctcaagcatcatcagggagtggtgtagtcagttgaaggcagttcccaccgagttttccgagcctcagaatccaggagatacgcacagccccacccactctgagatgacagtggctgacttcccgtgctgggcttttccattgtccccctggcctccaggctcctcctctgcctctccatggagtgggtggggaggtggtgggggccggcgtcccctgcgtgtgtgtgtgtgtgtgtgtgtgtggatgtattgacctgtgtttcccaagacagcaggtgccacggcccgccccgcctgccagcccgaattcccgttctcctgtgtctactaacaaggacatgggggtgggcggtgacctccgcatccctcagagctcagagggtcctcgctgccaccggtccccccctagcccgtcatcagccggtggcagctccatcttccattcctggttttagggcagaatccatggagactgcttccagaaggcatctggctctgagttataaattacttccctggtcctgacagtcacctggggtcccccctctccctggttccacctttctgaggaggagcctggagtcagggctgggttttggattaacccatccttcctagttaacacctttttgtttttattttattttatttttgtttgttttctccgtgtgtgtgttttcctaatttatttacctctgtttcccctttttcctttttttttttaattaaagagcaaagctttttattactttgtaatttaaaaaactgaaaaaaaaaaaactgaagaactttggggggaattttgtacttttttcctgtgtaaatattggacttttttgagctttatcgtggttgttaatttgaagtaataaagtagaaaagataaagtg

SEQ ID NO: 4710 - DNA, 2321 bp, Homo sapiens
ctttcaaacccggccggcccgagtggagtcagctcagtcccggcagccgccgcgcgaggaaatggccgaggggccggagccacagtccacagacaaacgaatttaaaggagcaaccgaggaggcacctgcgaaagaaagcccacacacaggtgaatttaaaggagcagccctggtgtcacctatcagtaaaagactatttggagttttcctcgtcttactggatgtcactctcgtccttgccgacctaattttcactgacagcaaactttatattcctttggagtatcgttctatttctctagctattgccttattttttctcatggatgttcttcttcgagtatttgtagaagggtgttggagcgggccggagagaagtagagtgggctgcgaggagaaggaaacaggcctttcggaggctcctcatccctcggaggtcatcccttactccagcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggtgcagcccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacagacaagtgtgccatttgaccatctcgggaagtgaggagagcccccattggaccagtgtttgcttagtgtcttcactgtattttctttaaaaaaaaaaaaaaaaaaaaaaaggcaaaaataaaccactcaaaagaacaacaaaaaaacccagcacaaaaccgacgatggagtttgtttctttgatttctttgccaatggcaagaagatgagatgccctcagcactgaggattcttgcccccttgtggtgcccgctgcccccaaccttcaggctgccagatgctcccctgacaacaccaggctacaggagccagacgccagggcctgcccggcctcctgttcctgcccccacccaccacctgcctggagaggaacgggtcgggtccgtgtcggagaagtgacaggtcccagagccaaagccggccctcaagcatcatcagggagtggtgtagtcagttgaaggcagttcccaccgagttttccgagcctcagaatccaggagatacgcacagccccacccactctgagatgacagtggctgacttcccgtgctgggcttttccattgtccccctggcctccaggctcctcctctgcctctccatggagtgggtggggaggtggtgggggccggcgtcccc

SEQ ID NO: 4711 - DNA, 2048 bp, Homo sapiens
tccggcatccgccccggcgggccgcccccgcccgcggcagccccccgagcagtggcccggcatcggcgccttcccggcgggcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggtgcagcccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacagacaagtgtgccatttgaccatctcgggaagtgaggagagcccccattggaccagtgtttgcttagtgtcttcactgtattttctttaaaaaaaaaaaaaaaaaaaaaaaggcaaaaataaaccactcaaaagaacaacaaaaaaacccagcacaaaaccgacgatggagtttgtttctttgatttctttgccaatggcaagaagatgagatgccctcagcactgaggattcttgcccccttgtggtgcccgctgcccccaaccttcaggctgccagatgctcccctgacaacaccaggctacaggagccagacgccagggcctgcccggcctcctgttcctgcccccacccaccacctgcctggagaggaacgggtcgggtccgtgtcggagaagtgacaggtcccagagccaaagccggccctcaagcatcatcagggagtggtgtagtcagttgaaggcagttcccaccgagttttccgagcctcagaatccaggagatacgcacagccccacccactctgagatgacagtggctgacttcccgtgctgggcttttccattgaggagcctggagtcagggctgggttttggattaacccatccttcctagttaacacctttttgtttttattttattttatttttgtttgttttctccgtgtgtgtgttttcctaatttatttacctctgtttcccctttttcctttttttttttaattaaagagcaaagctttt

SEQ ID NO: 4712 - DNA, 1580 bp, Homo sapiens
cggtgcgagagcgcgcgagccggcggcgggggcgggcgggcgggcaggaggccgggaggagggaggcggcggcggcggcggcggcggcggcgagagcccagagccagagcccggccggggccgagcggagcgcggcggcggcggcggcggcggcggctgggccgggagaggctggcgcgccgggcggctccgcgaatcctccggcatccgccccggcgggccgcccccgcccgcggcagccccccgagcagtggcccggcatcggcgccttcccggcgggcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggtgcagcccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacagacaagtgtgccatttgaccatctcgggaagtgaggagagcccccattggaccagtgtttgcttaggtgag

SEQ ID NO: 4713 - DNA, 996 bp, Homo sapiens
ggggacgaggaggagggggcctgttattttgcaggctcgcgggggaggccccccggccggcctgcctccgcttccccccgctgggccctccgaggccccggccggccaggcggccaccccggctgtgatttggggacgctgagggagggggcttggggtgctgggcgccggatactgttgattcgggcccgcgtagcgtttcatcggacaatcaccggcgccccctgctctcccggccccggcgcccggacctgggggttcgcaaggctgcgcccgctcgttggatgacgggcgtttgggggtcctaagcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtat

SEQ ID NO: 4714 - DNA, 763 bp, Homo sapiens
ccgcaacctcttccaccggcagggcttctcctatgactacgtctttgactggaacatgctgaaattcggtgcagcccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacagacaagtgtgccatttgaccatctcgggaagtgaggagagcccccattggaccagtgtttgcttaggcagtagtccgacacgtcgggggactcaactttacactgggacaatctgtgtgtggtctgttttgtagaaattcatccacacaagagagtggaggcatgaacagggctggccttcctcggatctcaggcccaggaaccaagctgtccatggcgggctgggcagatatttgggggtggggtggggagatgctcaccaggagggcagagaagggagagaatccgtttctgtcacatgaagatggatctcctagcgtgctgggccttgagccaggctctggggcccagagggagatagacc

SEQ ID NO: 4715 - DNA, 1662 bp, Homo sapiens
ctgcccaaagtttgtcctattaggcccgccagggtactctgcgactccgggacgagggcggggccgcgctagtggttccggttcggctccagccgcccctcggctcctcgccttccccctcccgtccgccttctcccctccctcccgctcctgggaaagagagaaaccaccgctgcgggtgggtagagaagcacttggcgcctcggggaggggaccgcgcccgcctcatttgcgccttgcagcactgctggaccaggttacaagatgttcacctaagattgagacctagtgactacatttcctacgggaacaaataaatggtttttcatctcccggagatacattacaaacaaatatggtgctaaaagaactccttacctttctctgactacaatttatttggacatacttttgtattgaagagaggtatacatactgaagctacttgctgtactataggagactctgtcctgtaggatcatggaccatcctagtagggaaaaggatgaaagacaacggacaactaaacccatggcacaaaggagtgcacactgctctcgaccatctggctcctcatcgtcctctggggttcttatggtgggacccaacttcagggttggcaagaagataggatgtgggaacttcggagagctcagattaggtaaaaatctctacaccaatgaatatgtagcaatcaaactggaaccaataaaatcacgtgctccacagcttcatttagagtacagattttataaacagcttggcagtgcaggtgaaggtctcccacaggtgtattactttggaccatgtgggaaatataatgccatggtgctggagctccttggccctagcttggaggacttgtttgacctctgtgaccgaacatttactttgaagacggtgttaatgatagccatccagctgctttctcgaatggaatacgtgcactcaaagaacctcatttaccgagatgtcaagccagagaacttcctgattggtcgacaaggcaataagaaagagcatgttatacacattatagactttggactggccaaggaatacattgaccccgaaaccaaaaaacacataccttatagggaacacaaaagtttaactggaactgcaagatatatgtctatcaacacgcatcttggcaaagagcaaagccggagagatgatttggaagccctaggccatatgttcatgtatttccttcgaggcagcctcccctggcaaggactcaaggctgacacattaaaagagagatatcaaaaaattggtgacaccaaaaggaatactcccattgaagctctctgtgagaactttccagaggagatggcaacctaccttcgatatgtcaggcgactggacttctttgaaaaacctgattatgagtatttacggaccctcttcacagacctctttgaaaagaaaggctacacctttgactatgcctatgattgggttgggagacctattcctactccagtagggtcagttcacgtagattctggtgcatctgcaataactcgagaaagccacacacatagggatcggccatcacaacagcagcctcttcgaaatcagagccttaggactgttacagctgagcattatgatgttaacaactcagccatctggcacaggggaagaggcacctaa

SEQ ID NO: 4716 - DNA, 8107 bp, Homo sapiens
ggcggggccgcgctagtggttccggttcggctccagccgcccctcggctcctcgccttccccctcccgtccgccttctcccctccctcccgctcctgggaaagagagaaaccaccgctgcgggtgggtagagaagcacttggcgcctcggggaggggaccgcgcccgcctcatttgcgccttgcagcactgctggaccaggttacaagatgttcacctaagattgagacctagtgactacatttcctacgggaacaaataaatggtttttcatctcccggagatacattacaaacaaatatggtgctaaaagaactccttacctttctctgactacaatttatttggacatacttttgtattgaagagaggtatacatactgaagctacttgctgtactataggagactctgtcctgtaggatcatggaccatcctagtagggaaaaggatgaaagacaacggacaactaaacccatggcacaaaggagtgcacactgctctcgaccatctggctcctcatcgtcctctggggttcttatggtgggacccaacttcagggttggcaagaagataggatgtgggaacttcggagagctcagattaggtaaaaatctctacaccaatgaatatgtagcaatcaaactggaaccaataaaatcacgtgctccacagcttcatttagagtacagattttataaacagcttggcagtgcaggtgaaggtctcccacaggtgtattactttggaccatgtgggaaatataatgccatggtgctggagctccttggccctagcttggaggacttgtttgacctctgtgaccgaacatttactttgaagacggtgttaatgatagccatccagctgctttctcgaatggaatacgtgcactcaaagaacctcatttaccgagatgtcaagccagagaacttcctgattggtcgacaaggcaataagaaagagcatgttatacacattatagactttggactggccaaggaatacattgaccccgaaaccaaaaaacacataccttatagggaacacaaaagtttaactggaactgcaagatatatgtctatcaacacgcatcttggcaaagagcaaagccggagagatgatttggaagccctaggccatatgttcatgtatttccttcgaggcagcctcccctggcaaggactcaaggctgacacattaaaagagagatatcaaaaaattggtgacaccaaaaggaatactcccattgaagctctctgtgagaactttccagaggagatggcaacctaccttcgatatgtcaggcgactggacttctttgaaaaacctgattatgagtatttacggaccctcttcacagacctctttgaaaagaaaggctacacctttgactatgcctatgattgggttgggagacctattcctactccagtagggtcagttcacgtagattctggtgcatctgcaataactcgagaaagccacacacatagggatcggccatcacaacagcagcctcttcgaaatcaggtggttagctcaaccaatggagagctgaatgttgatgatcccacgggagcccactccaatgcaccaatcacagctcatgccgaggtggaggtagtggaggaagctaagtgctgctgtttctttaagaggaaaaggaagaagactgctcagcgccacaagtgaccagtgcctcccaggagtcctcaggccctggggactctgactcaattgtacctgcagctcctgccatttctcattggaagggactcctctttgggggagggtggatatccaaaccaaaaagaagaaaacagatgcccccagaaggggccagtgcgggcagccagggcctagtgggtcattggccatctccgcctgcctaaggctctgagcaggtcccagagctgctgttcctccactgcttgcccatagggctgcctggttgactctccttcccattgtttacagtgaaggtgtcattcacaaaaactcaaggactgctattctccttcttccccttagtttactcctggtttttaccccaccctcaaccctctccagcataaaacctagtgagctaaaggctttgtctgcagaaggagatcaagaggctgggggtaaggccaagaaggtaggaggaaaatggcagacctgggctggagaagaaccttctccgtatcccaggtgtgcctggcagtatggtttcctcttcctctgtgcctgtgcagcattcatcccagctggccttggggttcaggttccttcttccctccctcctgtgaagttacactgtaggacacaagctgtgagcaatctgcagtctactgtccctgtgtgttggcgttcttagcttttttgacaaactcttttctccaggtagtaggacaatgaaaattgttctaagcaaaggaaagaaaactgactttgttgcacttttagtttttttaaaaaaaacaaaaacaaaaacatggcagatgcatattgtgtctggttatattgggggttttacttttacctgttttgagggggatggggccggccaagccattcagagagaacatgggtccagaggacattctcagtggaaagagtttgatctgcagcacccagaagagaagccaaactcggtgtcattctgagtgaacactcaggttggcaagaaaacatacttgaattttcattcatcttctcagcagctgaagaatgtccctaccagagcatcttgacctaatcagcttacagtttgaaaacctagctctccagaacatgagatgagccagccgagccagactgtgaccaggaaacagctcatcccagagaaggagatgcttaacaaaaaaaaattgaaattgtttcccatgctgccagggacttccaactagatagccatgtgacgtcctggtgacttgggggaaaaattagtgatgaaacagccaccaccatattgccattagtggaaaaaaagaggacagtgaacctgccttccacctgccagagggacctcagggtgtggcattatagggccaggaaaagaaaatcggtgtatcctatctgccccaatagctgagctgtagcatttgggctggcctgccttatcagaaaccaagcttatgaagatcttctcccagcaggtccatagcagtaggcttaggatgcagtatatggggccgcatttaaaaggagggaaagattgtttggtgctggaacattccagggaaaaggagactggaatgaaaggtctgaaattatcttctcaattggactccttccagaaaggtggccgtgcctctaagcatgtttttcccagtatgccctaggcctccccccatggtgttttcatatgaggtactactgtgaaggatctggttcctcattcactgtttgacaagtctttcatgtgtggagttactcttctcatgcccaattttcatttgagtttagtggcttaaccaaacaatgactcctcattccagcggtgacagaagagaaagggtcatttacatcaggaaagaggtcttgtatctgggagtagagagctaaccatggagcacagtggctggtgggtgacttagtctgatggtttgtggaccatagaagtcttcacctctggtttgaggtgcagggctgtcttttgtactggagggtgtggggatattttctgatagttgccatttcttgaaaaattcccttgatgtaccttacacagagcagaaataacattaacatggatcagaggtactgggcttcatctgttccattggaccttggctagggaatatcatttcactggcatcaaacctgcttagcttatgaaaagatggtaatatgtcatttctataaatgtttctatatatgaaacataaagtggcagggagatacaatatcacaccccttccccacaaggactgtgaatattgggatttatgtccttgccattacctagtggttacagccctatcactaaaatttacatcgtttctcagttgggatttgggcattgctaacttactgtatagaaagtttaacttttcctcacccctgtatagaaaatgccttgcctctcaagagagggcagagggggggccaggtgcagtggctcacgcctgtaatcccagcagtttgggaggccaaggcaagtggatcatgtgaggtcaagagttcgagaccagcctggccaacatggtgaaaccccgtctctacaaaaaatacaaaaattagctgggcatggtggcatgctcccgtagtcccagctactcgggaggctgaggcaggagaatcacttgagcctgggaggcagaagttgcagtgagccgagatcgcaccactgcactccagcctgggcaacagagtgagactctgtctaaaaagaaaaaaaaaaaagggcagagggaaatggtgggaatgcctggagcatcctggcactctatactctactgagtgcctctcttcagcccctcaccctgcttccacacacacacacacaaaagcaaaggcactgaccagcttggctgcagggcaagctgccttgcagctggatttgcgactttttttttgtcttaaaatttttactggatcagttgtaggggactgtacttcctaagacactgttctcaccttccaacctcacaaatctcttactagatatttggtttttataacaagggtaaagaatcccaggtccctttagcatgcagagtaatggtgatccctccagagccattggcacttcaaagtggtcccagacctgggagattctggtgggatcttccttaaaaataagcaaaaaacctgagtaccctagatgcaattggccatttgtttcaggcccatcagcgaatcagggctccctcctcaaccctactgctacagttccttagctgtatgcctcagccagatccttggggttagggcatgcactcgctgactgtccccacccatccacttgctctgtagtttctgagctttctccatttcacaagtatggtgcctaacgatctttttctttaggattgatgcagttgtttttcctgaaagctaactcagcatctattcataaaaacccttaatagtatacattaggagttttcccaagctctacagtccctcagacattgcatcctaaacagatttgaggcacacaggccaagactccaccaaggcataaatggtcccccctactcccttttgaccagggtatcacttgtgtctctgcagtaagagttggtcaagttgctctacgcaccttggtgctttccagagatctcactccagactgcccccaagggtggatagagtatcctgacagccagtgtgcactcatgactgccttaattaacattcttctgctattatggagcctgtccagcaataaacagggtctaggaaggtacaagattagcttccagttaaaatcccattttatattggaatgcatgagctacagatgacagcagagatcctgaggtttctagacatgttgattgtctcttttttctaaatgaactccaagtacttagaaaacagtccctgtccatcagccagaaaaggtgaccatcacccctaaagtaatttccaaacttagttcagtgggaagatatgctggtagtgcatattcagtgttgattttcagtgctagtaaccacttttaatgccagaaatatgtaacaatgataatgtaacgtcaaagtggttactaaagattatagccttaacttttttatgtaaaagataaaatccattcctcctcccagtgagcaagcatggcttgcatttctcaaaaatgagaacttccatggcagccaagaaaacgtcttctcagaggaactttcgtttgatgcatctcccaagcccacatgcctcctgtgttccagccacctcttccatttcacatttaaaccagctctccattcccattgagttgccctaacaacattgtctccagtgtcagaaccatattaaggttcgtttctcagattgggagcctgcaacaccatacagccaacattgcctttgccacgccactgccaccatccccaccattgccctatggtgggcagatgaattccagaaaccctcagggagccaggataattaggcaacccatctgaattggccacgtaagtgacaggcacttatctctcgggttcttgcttttgcagactccagggaagtcctgtctagaggtcgatggcagagactcctagtctttcccatgaggggttgataggaatcaaattgggattcctttggctttgggttttgtttttttgttgttgtttttggttttcagtttgttttttggtgtatggggggtgattttgtttctgaataagaaaaagaagaggcaaccatggcccttatgtgggtttatcctttttgagcaatgttttagccacaagtaaggaatcttgaaagtcttttgtccagcaagcagtcttaaaaatgtttttcctaactccttttgcaggtgactaagtacaaaaaaatagttttctcattgtattcaaaatagtgagtaggttccctggataatacacagtggtagttgacatattttctcaaaacacaaccagaaaacccacttccggtatttgtaaatcacctttcaagggaaaaagtgaacacgtattccttgtatttctagtttgattaccaaacctgatgttacaaagaaacctccgttctgtagacagaatttcttttatttttcttcttttactcctcacaatcactttcccagtgccatcaccatctataaggtctcagagcagaggattattcatggtaataagtgggggtgtggtgcagccattccagtaacacccacaagaggacagctgttctgaatgtccccacccacccctctttcagtacaggtgagacattttcagttcatgagctccagaccaaatcccaggccagcccttgcaccaaaagccttttttagaaggcttatcagtctattaggaatgtctcaggaaagatgagccatttctttggggagaaatatatttacagatggaagtgtgtgactgcgtgtctgtgtgtgtgtgtggtgtgtgtgcgcacgtgagtgcgtgtgttcatctatgtgcatttcacttccataaagacccagcccaagctgctgggaaccatgtgttcctgagtattctcagaggttaaacaagtgacaagtgagcttctgaaattagtgtctcagcaagctggctttaggaatgagccccattttatcaagcagagaaaaaaaataacagcagaaaagataaagataaaccaaaaatatataccccccaatggaaaataatgttgattcagcaattcccataggatgtattacatgctctaatttattatattattatttatctgtctttgatctttgcccattgtactcttaaaaagatgttgggatgttgattgcgatttttaaacaactagataatgtataaatcagcagtggaaatcagttttaatgtgtggatgtgtctgattattgttaaatgcctctttttttactttttttttttttagatgtataatgtttcataaaccctggcactggtcacaaagctcagctgtgaaaatgaaatttgtagtatttttaaacatgaatgtcaatttcaagtgtatttgaaatggttcctccaggagagatatttgtgcaccattaggaaaatcttctctgcagaggaagtagccttctttggagaaaatggaaaatgggttctgatatgtgatctcagagtagcccatttcctagggcaccatggaaaacacaaatgtgatctttaagtatacctcttccccagtttggggaggaaaggactcagtttgcaccctttttgtatgtaaaataaaatgtcttacctttcttggctacttctgcttgtttggttggttgattggtttgtctgtttttaatctccctcggctcatttgtaattaacaatctagctaggactaactttgatgcgattcaagactcctgtgaacaaaaataatttggcattcttgtttcattccttggattaaatattgtcttctcctgtgagtcacttcaaaaataaatactgctgtctctcttcgagtgctgaa

SEQ ID NO: 4717 - DNA, 1824 bp, Homo sapiens
accagccaggagccacccatcctccagcacactgagcagcaagctggacacacggcacactgatccaaatgggtaaggggatggtggcgatgctcattctgggtctgctacttctggcgctgctcctacccgtgcaggtttcttcatttgttcctttaaccagtatgccggaagctactgcagccgaaaccacaaagccctccaacagtgccctacagcctacagccggtctccttgtggtcttgcttgcccttctacatctctaccattaagagagcatgtcctttgcaacctgatcacacaaatgatgaaaaagaatagaactttctcattcatctttgaataacgtctccttgtttaccctggtattctagaatgttacaagatgttcacctaagattgagacctagtgactacatttcctacgggaacaaataaatggtttttcatctcccggagatacattacaaacaaatatggtgctaaaagaactccttacctttctctgactacaatttatttggacatacttttgtattgaagagaggtatacatactgaagctacttgctgtactataggagactctgtcctgtaggatcatggaccatcctagtagggaaaaggatgaaagacaacggacaactaaacccatggcacaaaggagtgcacactgctctcgaccatctggctcctcatcgtcctctggggttcttatggtgggacccaacttcagggttggcaagaagataggatgtgggaacttcggagagctcagattaggtaaaaatctctacaccaatgaatatgtagcaatcaaactggagctccttggccctagcttggaggacttgtttgacctctgtgaccgaacatttactttgaagacggtgttaatgatagccatccagctgctttctcgaatggaatacgtgcactcaaagaacctcatttaccgagatgtcaagccagagaacttcctgattggtcgacaaggcaataagaaagagcatgttatacacattatagactttggactggccaaggaatacattgaccccgaaaccaaaaaacacataccttatagggaacacaaaagtttaactggaactgcaagatatatgtctatcaacacgcatcttggcaaagagcaaagccggagagatgatttggaagccctaggccatatgttcatgtatttccttcgaggcagcctcccctggcaaggactcaaggctgacacattaaaagagagatatcaaaaaattggtgacaccaaaaggaatactcccattgaagctctctgtgagaactttccagaggagatggcaacctaccttcgatatgtcaggcgactggacttctttgaaaaacctgattatgagtatttacggaccctcttcacagacctctttgaaaagaaaggctacacctttgactatgcctatgattgggttgggagacctattcctactccagtagggtcagttcacgtagattctggtgcatctgcaataactcgagaaagccacacacatagggatcggccatcacaacagcagcctcttcgaaatcaggtggttagctcaaccaatggagagctgaatgttgatgatcccacgggagcccactccaatgcaccaatcacagctcatgccgaggtggaggtagtggaggaagctaagtgctgctgtttctttaagaggaaaaggaagaagactgctcagcgccacaagtgaccagtgcctcccaggagtcctcaggccctggggactctgactcaattgtacctgcagctcctgccatttctcattggaagggactc

SEQ ID NO: 4718 - DNA, 2877 bp, Homo sapiens
ccccgctggcagacgctggcggcgtaaggcgcgcgggccccggagcgggcgcggcggagcgcggcgagcccggcgcctcccgtcccgaacatgcggaggccggcccaggcggcgcgggagccggagcgggggcccaagcggcaccggagccggagcgcgagggggcgcggggcccggagcgggggtccgcgctgcgctgctgaggccgggccggccgcccagacgctgcccgcgggcccggccacggcggagccaagctgtgagccgtgagctttgaggcggtgggatgtgtcagcagaatgtctcctgcccccgagagcgaccccgaggccactgagaagagcagcgcggcctggccggcccgaacgcctgcgtctcagtagctgggagccacgggcccacgcccgcccaccggccgcagtgatgttctagccacagaggagccaagacctcaggtttccagagacttgggatttgcacggcagcagagtcaccgtggagaggccagggtatcacaaacttatggattttgacaagaaaggagggaaaggggagacggaggagggccggagaatgtccaaggccggcgggggccggagcagccacggcatccggagctcggggaccagctcgggggtcctgatggtgggccccaacttccgcgtcggcaagaagatcggctgcggcaacttcggggagctccgcctaggaaagaatctctatacaaatgaatacgtggctatcaaattggagccgatcaagtcccgggccccgcagctgcacctggagtaccggttctacaagcagctcagcgccacagagggcgtccctcaggtctactacttcggtccgtgcgggaagtacaacgccatggtgctggagctgctggggcccagcctggaggacctgttcgacctgtgcgaccggaccttcacgctcaagacggtgctgatgatcgccatccagctgatcacgcgcatggagtatgtgcacaccaagagcctaatctaccgggacgtgaagcccgagaacttcctggtgggccgcccggggaccaagcggcagcatgccatccacatcatcgacttcgggctggccaaggagtacatcgaccccgagaccaagaagcacatcccgtaccgcgagcacaagagcctgacgggcacggcgcgctacatgagcatcaacacgcacctgggcaaggagcagagccgccgcgacgacctggaggcgctgggccacatgttcatgtacttcctgcgcggcagcctcccctggcaggggctcaaggccgacacgctcaaggagcggtaccagaagatcggggacaccaaacgcgccacgcccatcgaggtgctctgcgagaacttcccagaggagatggccacgtacctgcgctatgtgcggcgcctggacttcttcgagaagcccgactatgactacctgcggaagctcttcaccgacctcttcgaccgcagtggcttcgtgttcgactatgagtacgactgggccgggaagcccctgccgacccccatcggcaccgtccacaccgacctgccctcccagcctcagctccgggacaaaacccagccgcacagcaaaaaccaggcgttgaactccaccaacggggagctgaatgcggacgaccccacggccggccactccaacgccccgatcacagcgcctgcagaggtggaggtggccgatgaaaccaaatgctgctgtttcttcaagaggagaaagagaaaatcgctgcagcgacacaagtgaccctgggcgcgtgcagccccctgaatcttctccgtgcagccccttggggcgcgaccttgtgcgaggccctcggggcccacccacagcggcccagggccagaccctggctggaagccagaacgcagactgcaggggccgcgcctggctcaggcggccccacccccgggacgtggggtcacttccttcatgtaagactttggccgaaatttctacacctgtgtctagtcctcccctccaagagcattaactatttaaaacaaggaaaagaggaaaaaaaaaacagaggcccgccctaccccactcctgcccctccgtttctttgctgaagtgagtagtgtgatcctggaggccccccggcctggccccgccccgccagccgcccccgttagcgtcataaagtccagcttgtctccctcgatccaaaggccgttttctcgaggggagggcaggcccggcctggaggggtgctgtggagctgtcttgcccaggccctcctgggagggggacaggcattgttgccaggggtgaggccgtgccccaggcctccccgaaaccaaaggggaaggcaggggtggggccgtggctgaagccggctccccaaccaaaatgctgcaccaaagctcgggcgccgcgggcacggctgctgcagtctcttcccagcctggccctggcaaggggcgggtgggcgctgccaggcgggtgcttctcgacgcacttgctcccggaggctgcgccccggcgcctggaacccgaggtgggaggaccggttggtgtcaccctgctcggccctcagccctgccgcgtggggcgcgtgggcacggagcttcctgcctctctgctccgacacccggcaagcagccggagacaaaacgccttaaagcccccggcccagccctgcaggtatattgcaggggcctgggggcggccctggactggcgggcggttccccagtggggtgccctggaggctgccgggcagagtggagcagcttggggccgtgcccagggcggtggctgtgagtctagtttttgctttaccaagtgtacagaaatggcatttacgtttctctgatgctcccttgaagccatagaatttaggggctttttt

SEQ ID NO: 4719 - DNA, 1579 bp, Homo sapiens
agtacatcgaccccgagaccaagaagcacatcccgtaccgcgagcacaagagcctgacgggcacggcgcgctacatgagcatcaacacgcacctgggcaaggagcagagccgccgcgacgacctggaggcgctgggccacatgttcatgtacttcctgcgcggcagcctcccctggcaggggctcaaggccgacacgctcaaggagcggtaccagaagatcggggacaccaaacgcgccacgcccatcgaggtgctctgcgagaacttcccagaggagatggccacgtacctgcgctatgtgcggcgcctggacttcttcgagaagcccgactatgactacctgcggaagctcttcaccgacctcttcgaccgcagtggcttcgtgttcgactatgagtacgactgggccgggaagcccctgccgacccccatcggcaccgtccacaccgacctgccctcccagcctcagctccgggacaaaacccagccccctgaatcttctccgtgcagccccttggggcgcgaccttgtgcgaggccctcggggcccacccacagcggcccagggccagaccctggctggaagccagaacgcagactgcaggggccgcgcctggctcaggcggccccacccccgggacgtggggtcacttccttcatgtaagactttggccgaaatttctacacctgtgtctagtcctcccctccaagagcattaactatttaaaacaaggaaaagaggaaaaaaaaaacagaggcccgccctaccccactcctgcccctccgtttctttgctgaagtgagtagtgtgatcctggaggccccccggcctggccccgccccgccagccgcccccgttagcgtcataaagtccagcttgtctccctcgatccaaaggccgttttctcgaggggagggcaggcccggcctggaggggtgctgtggagctgtcttgcccaggccctcctgggagggggacaggcattgttgccaggggtgaggccgtgccccaggcctccccgaaaccaaaggggaaggcaggggtggggccgtggctgaagccggctccccaaccaaaatgctgcaccaaagctcgggcgccgcgggcacggctgctgcagtctcttcccagcctggccctggcaaggggcgggtgggcgctgccaggcgggtgcttctcgacgcacttgctcccggaggctgcgccccggcgcctggaacccgaggtgggaggaccggttggtgtcaccctgctcggccctcagccctgccgcgtggggcgcgtgggcacggagcttcctgcctctctgctccgacacccggcaagcagccggagacaaaacgccttaaagcccccggcccagccctgcaggtatattgcaggggcctgggggcggccctggactggcgggcggttccccagtggggtgccctggaggctgccgggcagagtggagcagcttggggccgtgcccagggcggtggctgtgagtctagtttttgctttaccaagtgtacagaaatggcatttacgtttctctgatgctcccttgaagccatagaatttaggggctttttt

SEQ ID NO: 4720 - DNA, 4366 bp, Homo sapiens
actcggctgttttcgctgatgcgggcagcttgggggccgccgccgctaaacagacgctttcctttttaattttttttccatgtgttcacttccgggtccggcgtcgatccggatgcccgaggcagaaggatgtttgacctccggataagcgaggcgctgctgtgcattcattccgggctgcatcggtggcgacagcagaggctcgggcggcgactctccggccagcggcggcggtaggaggcaccagcggcagtgcagggaccgaatccgagcagcgctgcgttacctctctctctcgctccttcccccctacctcgctcgctcgctcgctcgctccctgcgtggctcgctttcctcctccggccgccggcgggtgtgatgtgccgccgccgctgcccccgccggcgctgacggactgggggcgccgcccgcgcccgggaccgacccctctgctcgcggccgcgcctttgagctctctatcaatatcagctcacatcattgaaaagataattttgaagacatgttttgctgaaaagacactaagaaaaattttacgaatgggatgaacatgctccagttaattgactacctactgcaatttgaatgttaacattacccatctggtacagttacctagtgatgtacctattttcacaataccctgtttcagtgtgcttgtcttgattaaagaattcaaagtggagtaccgcaaacttgatatggaaaataaaaagaaagacaaggacaaatcagatgatagaatggcacgacctagtggtcgatcgggacacaacactcgaggaactgggtcttcatcgtctggagttttaatggttggacctaactttagagttggaaaaaaaattggatgtggcaattttggagaattacgattagggaaaaatttatacacaaatgaatatgtggcaattaagttggagcccatgaaatcaagagcaccacagctacatttggaatacagattctataagcagttaggatctggagatggtatacctcaagtttactatttcggcccttgtggtaaatacaatgctatggtgctggaactgctgggacctagtttggaagacttgtttgacttgtgtgacagaacattttctcttaaaacagttctcatgatagctatacaactgatttctcgcatggaatatgtccattcaaagaacttgatatacagagatgtaaaacctgagaacttcttaataggacgaccaggaaacaaaacccagcaagttattcacattatagattttggtttggcaaaggaatatattgatccggagacaaagaaacacataccatacagagaacacaagagccttacaggaacagctagatatatgagcataaacacacatttaggaaaagaacaaagtagaagagacgatttagaagctttaggtcatatgttcatgtattttctgagaggcagtcttccttggcaaggcttaaaggctgacacattaaaggagaggtatcagaaaattggagatacaaaacgggctacaccaatagaagtgttatgtgaaaattttccagaaatggcaacatatcttcgttatgtaagaaggctagatttttttgaaaaaccagactatgactacttaagaaagctttttactgacttgtttgatcgaaaaggatatatgtttgattatgaatatgactggattggtaaacagttgcctactccagtgggtgcagttcagcaagatcctgctctgtcatcaaacagagaagcacatcaacacagagataagatgcaacaatccaaaaaccaggttgtaagttctacaaatggagagttaaacacagatgaccccaccgcaggacgttcaaatgcacccatcacagcccctactgaagtagaagtgatggatgaaaccaactgccagaaagtgttgaacatgtggtgctgctgttttttcaaacgaaggaaaaggaaaaccatacagcgccacaaatgactctggacacagacagatcctggggagttacttacatgttcatctgctgtcttgtgattaaaatcatctctgtagtgaccacgtatattttcaaggactcactcttagaaacaaaaatgtcatactttcatacttcattttgtggttgtcttacattctttttctttttttttttttctctaatttaacctttatggaagctttaaagttttgtcaaaacatgagtgctttgcccatcagtgaatggaatggaccaatgaggtggtatcaatgaatatagttccatagaacattttccagaagttcttctgttgtagaaagcagtacagtatcttaagtgtcaaccagttatatacctaatctggttttttataacttctgtaagagcataatcaaacaggaattttcttttctcagtggataatacaacagagaaaacagagttgcccaaatatttaaaagaagttattccttgagaagttcatattttgtgacatctgcattgatttcagtattactgatggtactgttattcataagtcatattaacattctctccgtgaaatcatggtacagtcactgcccagaggtactgaggaaaaagcaatatgggttcggcagatggtggtggtaaaatgaatcttaaggagtgtggtaaatatgtgctccgcttttgttgcatcactatgtgaagtactgtgttgcagaagtggcaaaagcgcttatttttaaaaatgcaaaatatttgtacaatgtaactttatgcttccaaataataatgtatgttagacagcaagaaatgaatactttaaaaagtgatgtatgttggagttataaagaaatacactaaggagaggtagtaaatgtgaaccttgttgcagtgtataaggtggaagcctaaagaaatctcaccgaaacttactgctgaatgattacattctcccttaagcagaaaactttggatgtgccatgcaatggtgtctgtgtaattattttgctctttgattaaaaaaaagacccccagcaataaaaagtgggtcactctatgccctctgtgcacattagtctcttgtattcaactttgctgattctctggaattttcctactctttagcataattttgatgattgaaaaatattttggaaaggatgggtcaggtgctttgcctccatagtcttttgaagtgcctgcatatgaacaacaacaacaacaacaaaaaattctgtaaaaaaggaagcccattccacttttcaagtatgctttgttttaagccataaagacacacatgtagttttgtcacattctactagccaaaattttcaagaagggttaaaacaaagactggctagaaagataattattttgaataaatctcatattcatctttcatttatataattgttacttattcctcccatgcagtctcttcgttgtctttaagtgtgtgcctccaggcatgcttatttatttttattgtctcaaggtaacatttaagatgtatattaaagtaaagctacatttttttacttcattattgcatttacagggatttaattgtactttgtaatttatttttcttattagccaaaagtttaatgcatttttttttgatgaattaggcacccacatgaacaccacaaatcaggacattgtttatcattgttgctatgaatcctatgaatgatcttttttttattttaaagacctacacttaacctacaaaacatttgctgtataatttggtcaacagtttctatctatctgtatactgtcatgatgtcttaaactgcaggagttacatactgagtttatatttttatttgctttgagcaaggtagataaacattttggccattataatgtgaaaccacttcttctttctttacagtatttgaccaaacttgtgtgtctatgatatttgtaaatacatgcgaatatctgtatttcttatcataagcctatttagttttattctcagtagggttttttggattgtacagtgtttatatgatctgaactccttatacataagaaggtgtgtatattaatccaattatggacttaaaatattttaaaagtataaatacccttatttgctgcaaagaccagtgtgtaggcatttgctttttagcaatatttttaagtgctccattttaatgccgaggaataagtcttttggcaacacaaactggtcaataataggtaatgcaggtatgttcaggttaagccaacaatgttttgcatttttatgcttattttctgtcaacactaatgaagtcaacattgcctgaatgtctgaataatgaaacacatccctgtttaaaagtatgtaactgaaaaagaaataaaaaaaaataaaagtagtttttttaaa

SEQ ID NO: 4721 - DNA, 4047 bp, Homo sapiens
gaattcaaagtggagtaccgcaaacttgatatggaaaataaaaagaaagacaaggacaaatcagatgatagaatggcacgacctagtggtcgatcgggacacaacactcgaggaactgggtcttcatcgtctggagttttaatggttggacctaactttagagttggaaaaaaaattggatgtggcaattttggagaattacgattagggaaaaatttatacacaaatgaatatgtggcaattaagttggagcccatgaaatcaagagcaccacagctacatttggaatacagattctataagcagttaggatctggagatggtatacctcaagtttactatttcggcccttgtggtaaatacaatgctatggtgctggaactgctgggacctagtttggaagacttgtttgacttgtgtgacagaacattttctcttaaaacagttctcatgatagctatacaactgatttctcgcatggaatatgtccattcaaagaacttgatatacagagatgtaaaacctgagaacttcttaataggacgaccaggaaacaaaacccagcaagttattcacattatagattttggtttggcaaaggaatatattgatccggagacaaagaaacacataccatacagagaacacaagagccttacaggaacagctagatatatgagcataaacacacatttaggaaaagaacaaagtagaagagacgatttagaagctttaggtcatatgttcatgtattttctgagaggcagtcttccttggcaaggcttaaaggctgacacattaaaggagaggtatcagaaaattggagatacaaaacgggctacaccaatagaagtgttatgtgaaaattttccagaaatggcaacatatcttcgttatgtaagaaggctagatttttttgaaaaaccagactatgactacttaagaaagctttttactgacttgtttgatcgaaaaggatatatgtttgattatgaatatgactggattggtaaacagttgcctactccagtgggtgcagttcagcaagatcctgctctgtcatcaaacagagaagcacatcaacacagagataagatgcaacaatccaaaaaccagtcggcagaccacagggcagcttgggactcccagcaggcaaatccccaccatttgagagctcaccttgcagcagacagacatggtggctcggtacaggttgtaagttctacaaatggagagttaaacacagatgaccccaccgcaggacgttcaaatgcacccatcacagcccctactgaagtagaagtgatggatgaaaccaactgccagaaagtgttgaacatgtggtgctgctgttttttcaaacgaaggaaaaggaaaaccatacagcgccacaaatgactctggacacagacagatcctggggagttacttacatgttcatctgctgtcttgtgattaaaatcatctctgtagtgaccacgtatattttcaaggactcactcttagaaacaaaaatgtcatactttcatacttcattttgtggttgtcttacattctttttctttttttttttttctctaatttaacctttatggaagctttaaagttttgtcaaaacatgagtgctttgcccatcagtgaatggaatggaccaatgaggtggtatcaatgaatatagttccatagaacattttccagaagttcttctgttgtagaaagcagtacagtatcttaagtgtcaaccagttatatacctaatctggttttttataacttctgtaagagcataatcaaacaggaattttcttttctcagtggataatacaacagagaaaacagagttgcccaaatatttaaaagaagttattccttgagaagttcatattttgtgacatctgcattgatttcagtattactgatggtactgttattcataagtcatattaacattctctccgtgaaatcatggtacagtcactgcccagaggtactgaggaaaaagcaatatgggttcggcagatggtggtggtaaaatgaatcttaaggagtgtggtaaatatgtgctccgcttttgttgcatcactatgtgaagtactgtgttgcagaagtggcaaaagcgcttatttttaaaaatgcaaaatatttgtacaatgtaactttatgcttccaaataataatgtatgttagacagcaagaaatgaatactttaaaaagtgatgtatgttggagttataaagaaatacactaaggagaggtagtaaatgtgaaccttgttgcagtgtataaggtggaagcctaaagaaatctcaccgaaacttactgctgaatgattacattctcccttaagcagaaaactttggatgtgccatgcaatggtgtctgtgtaattattttgctctttgattaaaaaaaagacccccagcaataaaaagtgggtcactctatgccctctgtgcacattagtctcttgtattcaactttgctgattctctggaattttcctactctttagcataattttgatgattgaaaaatattttggaaaggatgggtcaggtgctttgcctccatagtcttttgaagtgcctgcatatgaacaacaacaacaacaacaaaaaattctgtaaaaaaggaagcccattccacttttcaagtatgctttgttttaagccataaagacacacatgtagttttgtcacattctactagccaaaattttcaagaagggttaaaacaaagactggctagaaagataattattttgaataaatctcatattcatctttcatttatataattgttacttattcctcccatgcagtctcttcgttgtctttaagtgtgtgcctccaggcatgcttatttatttttattgtctcaaggtaacatttaagatgtatattaaagtaaagctacatttttttacttcattattgcatttacagggatttaattgtactttgtaatttatttttcttattagccaaaagtttaatgcatttttttttgatgaattaggcacccacatgaacaccacaaatcaggacattgtttatcattgttgctatgaatcctatgaatgatcttttttttattttaaagacctacacttaacctacaaaacatttgctgtataatttggtcaacagtttctatctatctgtatactgtcatgatgtcttaaactgcaggagttacatactgagtttatatttttatttgctttgagcaaggtagataaacattttggccattataatgtgaaaccacttcttctttctttacagtatttgaccaaacttgtgtgtctatgatatttgtaaatacatgcgaatatctgtatttcttatcataagcctatttagttttattctcagtagggttttttggattgtacagtgtttatatgatctgaactccttatacataagaaggtgtgtatattaatccaattatggacttaaaatattttaaaagtataaatacccttatttgctgcaaagaccagtgtgtaggcatttgctttttagcaatatttttaagtgctccattttaatgccgaggaataagtcttttggcaacacaaactggtcaataataggtaatgcaggtatgttcaggttaagccaacaatgttttgcatttttatgcttattttctgtcaacactaatgaagtcaacattgcctgaatgtctgaataatgaaacacatccctgtttaaaagtatgtaactgaaaaagaaataaaaaaaaataaaagtagtttttttaaacttgctctttcccatttcctctaaagatgggtaaaataatgtcactccctaatttaagataggaattataaaaatttggtttatttagtctgttatatatgagaagcagagctaaaggaatatgcttttgttattttatgttttgttttgctttcttgaaatccagtggtaaaaagcacacactaggaaggatctaagctttctttaatataaaaaaaattatacttctctgaactgtttaatagagcaataattaaatacatcttctgataaa

SEQ ID NO: 4722 - DNA, 2424 bp, Homo sapiens
gaattcaaagtggagtaccgcaaacttgatatggaaaataaaaagaaagacaaggacaaatcagatgatagaatggcacgacctagtggtcgatcgggacacaacactcgaggaactgggtcttcatcgtctggagttttaatggttggacctaactttagagttggaaaaaaaattggatgtggcaattttggagaattacgattagggaaaaatttatacacaaatgaatatgtggcaattaagttggagcccatgaaatcaagagcaccacagctacatttggaatacagattctataagcagttaggatctggagatggtatacctcaagtttactatttcggcccttgtggtaaatacaatgctatggtgctggaactgctgggacctagtttggaagacttgtttgacttgtgtgacagaacattttctcttaaaacagttctcatgatagctatacaactgatttctcgcatggaatatgtccattcaaagaacttgatatacagagatgtaaaacctgagaacttcttaataggacgaccaggaaacaaaacccagcaagttattcacattatagattttggtttggcaaaggaatatattgatccggagacaaagaaacacataccatacagagaacacaagagccttacaggaacagctagatatatgagcataaacacacatttaggaaaagaacaaagtagaagagacgatttagaagctttaggtcatatgttcatgtattttctgagaggcagtcttccttggcaaggcttaaaggctgacacattaaaggagaggtatcagaaaattggagatacaaaacgggctacaccaatagaagtgttatgtgaaaattttccagaaatggcaacatatcttcgttatgtaagaaggctagatttttttgaaaaaccagactatgactacttaagaaagctttttactgacttgtttgatcgaaaaggatatatgtttgattatgaatatgactggattggtaaacagttgcctactccagtgggtgcagttcagcaagatcctgctctgtcatcaaacagagaagcacatcaacacagagataagatgcaacaatccaaaaaccagtcggcagaccacagggcagcttgggactcccagcaggcaaatccccaccatttgagagctcaccttgcagcagacagacatggtggctcggtacaggttgtaagttctacaaatggagagttaaacacagatgaccccaccgcaggacgttcaaatgcacccatcacagcccctactgaagtagaagtgatggatgaaaccaagtgctgctgttttttcaaacgaaggaaaaggaaaaccatacagcgccacaaatgactctggacacagacagatcctggggagttacttacatgttcatctgctgtcttgtgattaaaatcatctctgtagtgaccacgtatattttcaaggactcactcttagaaacaaaaatgtcatactttcatacttcattttgtggttgtcttacattctttttctttttttttttttctctaatttaacctttatggaagctttaaagttttgtcaaaacatgagtgctttgcccatcagtgaatggaatggaccaatgaggtggtatcaatgaatatagttccatagaacattttccagaagttcttctgttgtagaaagcagtacagtatcttaagtgtcaaccagttatatacctaatctggttttttataacttctgtaagagcataatcaaacaggaattttcttttctcagtggataatacaacagagaaaacagagttgcccaaatatttaaaagaagttattccttgagaagttcatattttgtgacatctgcattgatttcagtattactgatggtactgttattcataagtcatattaacattctctccgtgaaatcatggtacagtcactgcccagaggtactgaggaaaaagcaatatgggttcggcagatggtggtggtaaaatgaatcttaaggagtgtggtaaatatgtgctccgcttttgttgcatcactatgtgaagtactgtgttgcagaagtggcaaaagcgcttatttttaaaaatgcaaaatatttgtacaatgtaactttatgcttccaaataataatgtatgttagacagcaagaaatgaatactttaaaaagtgatgtatgttggagttataaagaaatacactaaggagaggtagtaaatgtgaaccttgttgcagtgtataaggtggaagcctaaagaaatctcaccgaaacttactgctgaatgattacattctcccttaagcagaaaactttggatgtgccatgcaatggtgtctgtgtaattattttgctctttgattaaaaaaaagacccccagcaataaaaagtgggtcactctatgcc

SEQ ID NO: 4723 - DNA, 4438 bp, Homo sapiens
actcggctgttttcgctgatgcgggcagcttgggggccgccgccgctaaacagacgctttcctttttaattttttttccatgtgttcacttccgggtccggcgtcgatccggatgcccgaggcagaaggatgtttgacctccggataagcgaggcgctgctgtgcattcattccgggctgcatcggtggcgacagcagaggctcgggcggcgactctccggccagcggcggcggtaggaggcaccagcggcagtgcagggaccgaatccgagcagcgctgcgttacctctctctctcgctccttcccccctacctcgctcgctcgctcgctcgctccctgcgtggctcgctttcctcctccggccgccggcgggtgtgatgtgccgccgccgctgcccccgccggcgctgacggactgggggcgccgcccgcgcccgggaccgacccctctgctcgcggccgcgcctttgagctctctatcaatatcagctcacatcattgaaaagataattttgaagacatgttttgctgaaaagacactaagaaaaattttacgaatgggatgaacatgctccagttaattgactacctactgcaatttgaatgttaacattacccatctggtacagttacctagtgatgtacctattttcacaataccctgtttcagtgtgcttgtcttgattaaagaattcaaagtggagtaccgcaaacttgatatggaaaataaaaagaaagacaaggacaaatcagatgatagaatggcacgacctagtggtcgatcgggacacaacactcgaggaactgggtcttcatcgtctggagttttaatggttggacctaactttagagttggaaaaaaaattggatgtggcaattttggagaattacgattagggaaaaatttatacacaaatgaatatgtggcaattaagttggagcccatgaaatcaagagcaccacagctacatttggaatacagattctataagcagttaggatctggagatggtatacctcaagtttactatttcggcccttgtggtaaatacaatgctatggtgctggaactgctgggacctagtttggaagacttgtttgacttgtgtgacagaacattttctcttaaaacagttctcatgatagctatacaactgatttctcgcatggaatatgtccattcaaagaacttgatatacagagatgtaaaacctgagaacttcttaataggacgaccaggaaacaaaacccagcaagttattcacattatagattttggtttggcaaaggaatatattgatccggagacaaagaaacacataccatacagagaacacaagagccttacaggaacagctagatatatgagcataaacacacatttaggaaaagaacaaagtagaagagacgatttagaagctttaggtcatatgttcatgtattttctgagaggcagtcttccttggcaaggcttaaaggctgacacattaaaggagaggtatcagaaaattggagatacaaaacgggctacaccaatagaagtgttatgtgaaaattttccagaaatggcaacatatcttcgttatgtaagaaggctagatttttttgaaaaaccagactatgactacttaagaaagctttttactgacttgtttgatcgaaaaggatatatgtttgattatgaatatgactggattggtaaacagttgcctactccagtgggtgcagttcagcaagatcctgctctgtcatcaaacagagaagcacatcaacacagagataagatgcaacaatccaaaaaccagtcggcagaccacagggcagcttgggactcccagcaggcaaatccccaccatttgagagctcaccttgcagcagacagacatggtggctcggtacaggttgtaagttctacaaatggagagttaaacacagatgaccccaccgcaggacgttcaaatgcacccatcacagcccctactgaagtagaagtgatggatgaaaccaagtgctgctgttttttcaaacgaaggaaaaggaaaaccatacagcgccacaaatgactctggacacagacagatcctggggagttacttacatgttcatctgctgtcttgtgattaaaatcatctctgtagtgaccacgtatattttcaaggactcactcttagaaacaaaaatgtcatactttcatacttcattttgtggttgtcttacattctttttctttttttttttttctctaatttaacctttatggaagctttaaagttttgtcaaaacatgagtgctttgcccatcagtgaatggaatggaccaatgaggtggtatcaatgaatatagttccatagaacattttccagaagttcttctgttgtagaaagcagtacagtatcttaagtgtcaaccagttatatacctaatctggttttttataacttctgtaagagcataatcaaacaggaattttcttttctcagtggataatacaacagagaaaacagagttgcccaaatatttaaaagaagttattccttgagaagttcatattttgtgacatctgcattgatttcagtattactgatggtactgttattcataagtcatattaacattctctccgtgaaatcatggtacagtcactgcccagaggtactgaggaaaaagcaatatgggttcggcagatggtggtggtaaaatgaatcttaaggagtgtggtaaatatgtgctccgcttttgttgcatcactatgtgaagtactgtgttgcagaagtggcaaaagcgcttatttttaaaaatgcaaaatatttgtacaatgtaactttatgcttccaaataataatgtatgttagacagcaagaaatgaatactttaaaaagtgatgtatgttggagttataaagaaatacactaaggagaggtagtaaatgtgaaccttgttgcagtgtataaggtggaagcctaaagaaatctcaccgaaacttactgctgaatgattacattctcccttaagcagaaaactttggatgtgccatgcaatggtgtctgtgtaattattttgctctttgattaaaaaaaagacccccagcaataaaaagtgggtcactctatgccctctgtgcacattagtctcttgtattcaactttgctgattctctggaattttcctactctttagcataattttgatgattgaaaaatattttggaaaggatgggtcaggtgctttgcctccatagtcttttgaagtgcctgcatatgaacaacaacaacaacaacaaaaaattctgtaaaaaaggaagcccattccacttttcaagtatgctttgttttaagccataaagacacacatgtagttttgtcacattctactagccaaaattttcaagaagggttaaaacaaagactggctagaaagataattattttgaataaatctcatattcatctttcatttatataattgttacttattcctcccatgcagtctcttcgttgtctttaagtgtgtgcctccaggcatgcttatttatttttattgtctcaaggtaacatttaagatgtatattaaagtaaagctacatttttttacttcattattgcatttacagggatttaattgtactttgtaatttatttttcttattagccaaaagtttaatgcatttttttttgatgaattaggcacccacatgaacaccacaaatcaggacattgtttatcattgttgctatgaatcctatgaatgatcttttttttattttaaagacctacacttaacctacaaaacatttgctgtataatttggtcaacagtttctatctatctgtatactgtcatgatgtcttaaactgcaggagttacatactgagtttatatttttatttgctttgagcaaggtagataaacattttggccattataatgtgaaaccacttcttctttctttacagtatttgaccaaacttgtgtgtctatgatatttgtaaatacatgcgaatatctgtatttcttatcataagcctatttagttttattctcagtagggttttttggattgtacagtgtttatatgatctgaactccttatacataagaaggtgtgtatattaatccaattatggacttaaaatattttaaaagtataaatacccttatttgctgcaaagaccagtgtgtaggcatttgctttttagcaatatttttaagtgctccattttaatgccgaggaataagtcttttggcaacacaaactggtcaataataggtaatgcaggtatgttcaggttaagccaacaatgttttgcatttttatgcttattttctgtcaacactaatgaagtcaacattgcctgaatgtctgaataatgaaacacatccctgtttaaaagtatgtaactgaaaaagaaataaaaaaaaataaaagtagtttttttaaa

SEQ ID NO: 4724 - DNA, 4462 bp, Homo sapiens
actcggctgttttcgctgatgcgggcagcttgggggccgccgccgctaaacagacgctttcctttttaattttttttccatgtgttcacttccgggtccggcgtcgatccggatgcccgaggcagaaggatgtttgacctccggataagcgaggcgctgctgtgcattcattccgggctgcatcggtggcgacagcagaggctcgggcggcgactctccggccagcggcggcggtaggaggcaccagcggcagtgcagggaccgaatccgagcagcgctgcgttacctctctctctcgctccttcccccctacctcgctcgctcgctcgctcgctccctgcgtggctcgctttcctcctccggccgccggcgggtgtgatgtgccgccgccgctgcccccgccggcgctgacggactgggggcgccgcccgcgcccgggaccgacccctctgctcgcggccgcgcctttgagctctctatcaatatcagctcacatcattgaaaagataattttgaagacatgttttgctgaaaagacactaagaaaaattttacgaatgggatgaacatgctccagttaattgactacctactgcaatttgaatgttaacattacccatctggtacagttacctagtgatgtacctattttcacaataccctgtttcagtgtgcttgtcttgattaaagaattcaaagtggagtaccgcaaacttgatatggaaaataaaaagaaagacaaggacaaatcagatgatagaatggcacgacctagtggtcgatcgggacacaacactcgaggaactgggtcttcatcgtctggagttttaatggttggacctaactttagagttggaaaaaaaattggatgtggcaattttggagaattacgattagggaaaaatttatacacaaatgaatatgtggcaattaagttggagcccatgaaatcaagagcaccacagctacatttggaatacagattctataagcagttaggatctggagatggtatacctcaagtttactatttcggcccttgtggtaaatacaatgctatggtgctggaactgctgggacctagtttggaagacttgtttgacttgtgtgacagaacattttctcttaaaacagttctcatgatagctatacaactgatttctcgcatggaatatgtccattcaaagaacttgatatacagagatgtaaaacctgagaacttcttaataggacgaccaggaaacaaaacccagcaagttattcacattatagattttggtttggcaaaggaatatattgatccggagacaaagaaacacataccatacagagaacacaagagccttacaggaacagctagatatatgagcataaacacacatttaggaaaagaacaaagtagaagagacgatttagaagctttaggtcatatgttcatgtattttctgagaggcagtcttccttggcaaggcttaaaggctgacacattaaaggagaggtatcagaaaattggagatacaaaacgggctacaccaatagaagtgttatgtgaaaattttccagaaatggcaacatatcttcgttatgtaagaaggctagatttttttgaaaaaccagactatgactacttaagaaagctttttactgacttgtttgatcgaaaaggatatatgtttgattatgaatatgactggattggtaaacagttgcctactccagtgggtgcagttcagcaagatcctgctctgtcatcaaacagagaagcacatcaacacagagataagatgcaacaatccaaaaaccagtcggcagaccacagggcagcttgggactcccagcaggcaaatccccaccatttgagagctcaccttgcagcagacagacatggtggctcggtacaggttgtaagttctacaaatggagagttaaacacagatgaccccaccgcaggacgttcaaatgcacccatcacagcccctactgaagtagaagtgatggatgaaaccaactgccagaaagtgttgaacatgtggtgctgctgttttttcaaacgaaggaaaaggaaaaccatacagcgccacaaatgactctggacacagacagatcctggggagttacttacatgttcatctgctgtcttgtgattaaaatcatctctgtagtgaccacgtatattttcaaggactcactcttagaaacaaaaatgtcatactttcatacttcattttgtggttgtcttacattctttttctttttttttttttctctaatttaacctttatggaagctttaaagttttgtcaaaacatgagtgctttgcccatcagtgaatggaatggaccaatgaggtggtatcaatgaatatagttccatagaacattttccagaagttcttctgttgtagaaagcagtacagtatcttaagtgtcaaccagttatatacctaatctggttttttataacttctgtaagagcataatcaaacaggaattttcttttctcagtggataatacaacagagaaaacagagttgcccaaatatttaaaagaagttattccttgagaagttcatattttgtgacatctgcattgatttcagtattactgatggtactgttattcataagtcatattaacattctctccgtgaaatcatggtacagtcactgcccagaggtactgaggaaaaagcaatatgggttcggcagatggtggtggtaaaatgaatcttaaggagtgtggtaaatatgtgctccgcttttgttgcatcactatgtgaagtactgtgttgcagaagtggcaaaagcgcttatttttaaaaatgcaaaatatttgtacaatgtaactttatgcttccaaataataatgtatgttagacagcaagaaatgaatactttaaaaagtgatgtatgttggagttataaagaaatacactaaggagaggtagtaaatgtgaaccttgttgcagtgtataaggtggaagcctaaagaaatctcaccgaaacttactgctgaatgattacattctcccttaagcagaaaactttggatgtgccatgcaatggtgtctgtgtaattattttgctctttgattaaaaaaaagacccccagcaataaaaagtgggtcactctatgccctctgtgcacattagtctcttgtattcaactttgctgattctctggaattttcctactctttagcataattttgatgattgaaaaatattttggaaaggatgggtcaggtgctttgcctccatagtcttttgaagtgcctgcatatgaacaacaacaacaacaacaaaaaattctgtaaaaaaggaagcccattccacttttcaagtatgctttgttttaagccataaagacacacatgtagttttgtcacattctactagccaaaattttcaagaagggttaaaacaaagactggctagaaagataattattttgaataaatctcatattcatctttcatttatataattgttacttattcctcccatgcagtctcttcgttgtctttaagtgtgtgcctccaggcatgcttatttatttttattgtctcaaggtaacatttaagatgtatattaaagtaaagctacatttttttacttcattattgcatttacagggatttaattgtactttgtaatttatttttcttattagccaaaagtttaatgcatttttttttgatgaattaggcacccacatgaacaccacaaatcaggacattgtttatcattgttgctatgaatcctatgaatgatcttttttttattttaaagacctacacttaacctacaaaacatttgctgtataatttggtcaacagtttctatctatctgtatactgtcatgatgtcttaaactgcaggagttacatactgagtttatatttttatttgctttgagcaaggtagataaacattttggccattataatgtgaaaccacttcttctttctttacagtatttgaccaaacttgtgtgtctatgatatttgtaaatacatgcgaatatctgtatttcttatcataagcctatttagttttattctcagtagggttttttggattgtacagtgtttatatgatctgaactccttatacataagaaggtgtgtatattaatccaattatggacttaaaatattttaaaagtataaatacccttatttgctgcaaagaccagtgtgtaggcatttgctttttagcaatatttttaagtgctccattttaatgccgaggaataagtcttttggcaacacaaactggtcaataataggtaatgcaggtatgttcaggttaagccaacaatgttttgcatttttatgcttattttctgtcaacactaatgaagtcaacattgcctgaatgtctgaataatgaaacacatccctgtttaaaagtatgtaactgaaaaagaaataaaaaaaaataaaagtagtttttttaaa

SEQ ID NO: 4725 - DNA, 1979 bp, Homo sapiens
ctctctatcaatatcagctcacatcattgaaaagataattttgaagacatgttttgctgaaaagacactaagaaaaattttacgaatgggatgaacatgctccagttaattgactacctactgcaatttgaatgttaacattacccatctggtacagttacctagtgatgtacctattttcacaataccctgtttcagtgtgcttgtcttgattaaagaattcaaagtggagtaccgcaaacttgatatggaaaataaaaagaaagacaaggacaaatcagatgatagaatggcacgacctagtggtcgatcgggacacaacactcgaggaactgggtcttcatcgtctggagttttaatggttggacctaactttagagttggaaaaaaaattggatgtggcaattttggagaattacgattagggaaaaatttatacacaaatgaatatgtggcaattaagttggagcccatgaaatcaagagcaccacagctacatttggaatacagattctataagcagttaggatctggagatggtatacctcaagtttactatttcggcccttgtggtaaatacaatgctatggtgctggaactgctgggacctagtttggaagacttgtttgacttgtgtgacagaacattttctcttaaaacagttctcatgatagctatacaactgatttctcgcatggaatatgtccattcaaagaacttgatatacagagatgtaaaacctgagaacttcttaataggacgaccaggaaacaaaacccagcaagttattcacattatagattttggtttggcaaaggaatatattgatccggagacaaagaaacacataccatacagagaacacaagagccttacaggaacagctagatatatgagcataaacacacatttaggaaaagaacaaagtagaagagacgatttagaagctttaggtcatatgttcatgtattttctgagaggcagtcttccttggcaaggcttaaaggctgacacattaaaggagaggtatcagaaaattggagatacaaaacgggctacaccaatagaagtgttatgtgaaaattttccagaagaaatggcaacatatcttcgttatgtaagaaggctagatttttttgaaaaaccagactatgactacttaagaaagctttttactgacttgtttgatcgaaaaggatatatgtttgattatgaatatgactggattggtaaacagttgcctactccagtgggtgcagttcagcaagatcctgctctgtcatcaaacagagaagcacatcaacacagagataagatgcaacaatccaaaaaccaggttgtaagttctacaaatggagagttaaacacagatgaccccaccgcaggacgttcaaatgcacccatcacagcccctactgaagtagaagtgatggatgaaaccaactgccagaaagtgttgaacatgtggtgctgctgttttttcaaacgaaggaaaaggaaaaccatacagcgccacaaatgactctggacacagacagatcctggggagttacttacatgttcatctgctgtcttgtgattaaaatcatctctgtagtgaccacgtatattttcaaggactcactcttagaaacaaaaatgtcatactttcatacttcattttgtggttgtcttacattctttttctttttttttttttctctaatttaacctttatggaagctttaaagttttgtcaaaacatgagtgctttgcccatcagtgaatggaatggaccaatgaggtggtatcaatgaatatagttccatagaacattttccagaagttcttctgttgtagaaagcagtacagtatcttaagtgtcaaccagttatatacctaatctggttttttataacttctgtaagagcataatcaaacaggaattttcttttctcagtggataatacaacagagaaaacagagttgcccaaatattt

SEQ ID NO: 4726 - DNA, 2580 bp, Homo sapiens
agctctctatcaatatcagctcacatcattgaaaagataattttgaagacatgttttgctgaaaagacactaagaaaaattttacgaatgggatgaacatgctccagttaattgactacctactgcaatttgaatgttaacattacccatctggtacagttacctagtgatgtacctattttcacaataccctgtttcagtgtgcttgtcttgattaaagaattcaaagtggagtaccgcaaacttgatatggaaaataaaaagaaagacaaggacaaatcagatgatagaatggcacgacctagtggtcgatcgggacacaacactcgaggaactgggtcttcatcgtctggagttttaatggttggacctaactttagagttggaaaaaaaattggatgtggcaattttggagaattacgattagggaaaaatttatacacaaatgaatatgtggcaattaagttggagcccatgaaatcaagagcaccacagctacatttggaatacagattctataagcagttaggatctggagatggtatacctcaagtttactatttcggcccttgtggtaaatacaatgctatggtgctggaactgctgggacctagtttggaagacttgtttgacttgtgtgacagaacattttctcttaaaacagttctcatgatagctatacaactgatttctcgcatggaatatgtccattcaaagaacttgatatacagagatgtaaaacctgagaacttcttaataggacgaccaggaaacaaaacccagcaagttattcacattatagattttggtttggcaaaggaatatattgatccggagacaaagaaacacataccatacagagaacacaagagccttacaggaacagctagatatatgagcataaacacacatttaggaaaagaacaaagtagaagagacgatttagaagctttaggtcatatgttcatgtattttctgagaggcagtcttccttggcaaggcttaaaggctgacacattaaaggagaggtatcagaaaattggagatacaaaacgggctacaccaatagaagtgttatgtgaaaattttccagaaatggcaacatatcttcgttatgtaagaaggctagatttttttgaaaaaccagactatgactacttaagaaagctttttactgacttgtttgatcgaaaaggatatatgtttgattatgaatatgactggattggtaaacagttgcctactccagtgggtgcagttcagcaagatcctgctctgtcatcaaacagagaagcacatcaacacagagataagatgcaacaatccaaaaaccaggttgtaagttctacaaatggagagttaaacacagatgaccccaccgcaggacgttcaaatgcacccatcacagcccctactgaagtagaagtgatggatgaaaccaactgccagaaagtgttgaacatgtggtgctgctgttttttcaaacgaaggaaaaggaaaaccatacagcgccacaaatgactctggacacagacagatcctggggagttacttacatgttcatctgctgtcttgtgattaaaatcatctctgtagtgaccacgtatattttcaaggactcactcttagaaacaaaaatgtcatactttcatacttcattttgtggttgtcttacattctttttctttttttttttttctctaatttaacctttatggaagctttaaagttttgtcaaaacatgagtgctttgcccatcagtgaatggaatggaccaatgaggtggtatcaatgaatatagttccatagaacattttccagaagttcttctgttgtagaaagcagtacagtatcttaagtgtcaaccagttatatacctaatctggttttttataacttctgtaagagcataatcaaacaggaattttcttttctcagtggataatacaacagagaaaacagagttgcccaaatatttaaaagaagttattccttgagaagttcatattttgtgacatctgcattgatttcagtattactgatggtactgttattcataagtcatattaacattctctccgtgaaatcatggtacagtcactgcccagaggtactgaggaaaaagcaatatgggttcggcagatggtggtggtaaaatgaatcttaaggagtgtggtaaatatgtgctccgcttttgttgcatcactatgtgaagtactgtgttgcagaagtggcaaaagcgcttatttttaaaaatgcaaaatatttgtacaatgtaactttatgcttccaaataataatgtatgttagacagcaagaaatgaatactttaaaaagtgatgtatgttggagttataaagaaatacactaaggagaggtagtaaatgtgaaccttgttgcagtgtataaggtggaagcctaaagaaatctcaccgaaacttactgctgaatgattacattctcccttaagcagaaaactttggatgtgccatgcaatggtgtctgtgtaattattttgctctttgattaaaaaaaagacccccagcaataaaaagtgggtcactctatgccctctgtgca

SEQ ID NO: 4727 - DNA, 908 bp, Homo sapiens
ggaggaagcgaccaggtccggcacgaaggagggagaggtggcctgaggagcggaggggggatgtgtggattccggtgaaagggacctgacaatcgcccccaacccctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttatcgtggtgggaatatgaaataaagtagaagaaaaggccatga

SEQ ID NO: 4728 - DNA, 936 bp, Homo sapiens
tgtggattccggtgaaagggacctgacaatcgcccccaacccgtgagaaaaggaggagcccagttcttgcttgagaatgataaacttggaaacccttgggaaaggcgtgggggtcatgcagagacttgtattgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttatcgtggtgggaatatgaaataaagtagaagaaaaggccatga

SEQ ID NO: 4729 - DNA, 948 bp, Homo sapiens
cttccccaccctccctaatttccactccccccaccccacttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttatcgtggtgggaatatgaaataaagtagaagaaaaggccatga

SEQ ID NO: 4730 - DNA, 908 bp, Homo sapiens
ggaggaagcgaccaggtccggcacgaaggagggagaggtggcctgaggagcggaggggggatgtgtggattccggtgaaagggacctgacaatcgcccccaacccctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttattgtggtgggaatatgaaataaagtagaagaaaaggccatga

SEQ ID NO: 4731 - DNA, 2487 bp, Homo sapiens
cttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccagttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgtgccgcatgtacttgttcctcaatagttcaggacttttggttcttccccaggctggactcttgacacctcacccttcctgaattccacagtgcaaatatctttctgtaacaccctcagcatcctgcactgccctctctgaaaacacccacattctttggtcactgtgatttcttaggcctccgtctgttgtaccactagcatctatatgacttttgtgtaattttctctcttgaactctggtgctgtttttttgtttgtttgagacaaagtctcgctctgtcacccagggtggagtgcagtggcatgatctctgctcactacaacctccacctcccgggttccagcgattctcctgcctcagcctcccgagtagctgggactacaggcgtgcaccaccacgcctggctaattttttgtatttttagtagagacggggtttcaccatgttggtcaggctggtctcgaactcctgacctcgtaatctgccctcctcgacctcccaaagtgccgggattacaggtgtgagccactgtgcctggctgagctctggtgctgttcttccccctagaaaagaatctctagtgtggattctgcccagacaggctgacctgagaaaggcacagtggttcctccattccttccccatcatctgagtgttccagtatcccccatccctctcaatccagtcacctgcctattgacatctagctctgtttcccctgtcttgtccatgtctctaagacccagtaccagactgaactagcagcaagaaggacgaggaggccgggcatggtggctcacgccggtaatcccagcactttgggaggccgaggtgggcggatcacttgagattgggagtttgagaccagcctggccaacatggtaaaacccgctctctattaaaaatagaaaaatcagctgggtgtggtggcacacctctgtaatcccagctactcaggaggctgagacaggagaatcacttgaacccgggaggcagaggttgcagtgagccgagatcgcgccactgcactccagcctgggtgacacagtgagactccgtctccaaaaaaaaggatgaggaatagaattctgtgcagatgtcctgacttggcaattttgtgtccctgcctcactgtctccaccaacccccgcctgtcctagtgttgttctgcctcctgtcctctcttgctctcttgtcagtctctggcttcctcggccccatttcacttcactgagtcctgacacccatctccctaggggcctgtgagaggagagggaagggtctgttctgctcagctccatgtcccccattttcctccacaataaactgggactgggctaaaa

SEQ ID NO: 4732 - DNA, 948 bp, Homo sapiens
cttccccaccctccctaatttccactccccccaccccacttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttattgtggtgggaatatgaaataaagtagaagaaaaggccatga

SEQ ID NO: 4733 - DNA, 936 bp, Homo sapiens
tgtggattccggtgaaagggacctgacaatcgcccccaacccgtgagaaaaggaggagcccggttcttgcttgagaatgataaacttggaaacccttgggaaaggcgtgggggtcatgcagagacttgtattgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttattgtggtgggaatatgaaataaagtagaagaaaaggccatga

SEQ ID NO: 4734 - DNA, 1061 bp, Homo sapiens
ccccacaatgcccttcgccttcctcaacgtggcccccgctccaagcccattttctggagccaggaatccactctgtgggttaggaaaggccctcaggaggcggagggaaacctgtggaatgccgagaagccgtgtaatgaaataacgtcacgcctgcccctcaccattactctgaccagggttcgaaggtcacacttagagcctaaggggaaatggagaagtgcaaagggacgagcagaatggctggcaccacctcagctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttattgtggtgggaatatgaaataaagtagaagaaaaggccatga

SEQ ID NO: 4735 - DNA, 908 bp, Homo sapiens; identical to SEQ ID NO: 4730

SEQ ID NO: 4736 - DNA, 2487 bp, Homo sapiens
cttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccagttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctgaattccacagtgcaaatatctttctgtaacaccctcagcatcctgcactgccctctctgaaaacacccacattctttggtcactgtgatttcttaggcctccgtctgttgtaccactagcatctatatgacttttgtgtaattttctctcttgaactctggtgctgtttttttgtttgtttgagacaaagtctcgctctgtcacccagggtggagtgcagtggcatgatctctgctcactacaacctccacctcccgggttccagcgattctcctgcctcagcctcccgagtagctgggactacaggcgtgcaccaccacgcctggctaattttttgtatttttagtagagacggggtttcaccatgttggtcaggctggtctcgaactcctgacctcgtaatctgccctcctcgacctcccaaagtgccgggattacaggtgtgagccactgtgcctggctgagctctggtgctgttcttccccctagaaaagaatctctagtgtggattctgcccagacaggctgacctgagaaaggcacagtggttcctccattccttccccatcatctgagtgttccagtatcccccatccctctcaatccagtcacctgcctattgacatctagctctgtttcccctgtcttgtccatgtctctaagacccagtaccagactgaactagcagcaagaaggacgaggaggccgggcatggtggctcacgccggtaatcccagcactttgggaggccgaggtgggcggatcacttgagattgggagtttgagaccagcctggccaacatggtaaaacccgctctctattaaaaatagaaaaatcagctgggtgtggtggcacacctctgtaatcccagctactcaggaggctgagacaggagaatcacttgaacccgggaggcagaggttgcagtgagccgagatcgcgccactgcactccagcctgggtgacacagtgagactccgtctccaaaaaaaaggatgaggaatagaattctgtgcagatgtcctgacttggcaattttgtgtccctgcctcactgtctccaccaacccccgcctgtcctagtgttgttctgcctcctgtcctctcttgctctcttgtcagtctctggcttcctcggccccatttcacttcactgagtcctgacacccatctccctaggggcctgtgagaggagagggaagggtctgttctgctcagctccatgtcccccattttcctccacaataaactgggactgggctaaaa

SEQ ID NO: 4737 - DNA, 2487 bp, Homo sapiens
cttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccagttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctgaattccacagtgcaaatatctttctgtaacaccctcagcatcctgcactgccctctctgaaaacacccacattctttggtcactgtgatttcttaggcctccgtctgttgtaccactagcatctatatgacttttgtgtaattttctctcttgaactctggtgctgtttttttgtttgtttgagacaaagtctcgctctgtcacccagggtggagtgcagtggcatgatctctgctcactacaacctccacctcccgggttccagcgattctcctgcctcagcctcccgagtagctgggactacaggcgtgcaccaccacgcctggctaattttttgtatttttagtagagacggggtttcaccatgttggtcaggctggtctcgaactcctgacctcgtaatctgccctcctcgacctcccaaagtgccgggattacaggtgtgagccactgtgcctgtctgagctctggtgctgttcttccccctagaaaagaatctctagtgtggattctgcccagacaggctgacctgagaaaggcacagtggttcctccattccttccccatcatctgagtgttccagtatcccccatccctctcaatccagtcacctgcctattgacatctagctctgtttcccctgtcttgtccatgtctctaagacccagtaccagactgaactagcagcaagaaggacgaggaggccgggcatggtggctcacgccggtaatcccagcactttgggaggccgaggtgggcggatcacttgagattgggagtttgagaccagcctggccaacatggtaaaacccgctctctattaaaaatagaaaaatcagctgggtgtggtggcacacctctgtaatcccagctactcaggaggctgagacaggagaatcacttgaacccgggaggcagaggttgcagtgagccgagatcgcgccactgcactccagcctgggtgacacagtgagactccgtctccaaaaaaaaggatgaggaatagaattctgtgcagatgtcctgacttggcaattttgtgtccctgcctcactgtctccaccaacccccgcctgtcctggtgttgttctgcctcctgtcctctcttgctctcttgtcagtctctggcttcctcggccccatttcacttcactgagtcctgacacccatctccctaggggcctgtgagaggagagggaagggtctgttctgctcagctccatgtcccccattttcctccacaataaactgggactgggctaaaa

SEQ ID NO: 4738 - DNA, 908 bp, Homo sapiens; identical to SEQ ID NO: 4727

SEQ ID NO: 4739 - DNA, 1061 bp, Homo sapiens
ccccacaatgcccttcgccttcctcaacgtggcccccgctccaagcccattttctggagccaggaatccactctgtgggttaggaaaggccctcaggaggcggagggaaacctgtggaatgccgagaagccgtgtaatgaaataacgtcacgcctgcccctcaccattactctgaccagggttcgaaggtcacacttagagcctaaggggaaatggagaagtgcaaagggacgagcagaatggctggcaccacctcagctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgtcttttcctttcttttttgccaccctttcaggaaccctgtatggtttttagtttaaattaaaggagtcgttatcgtggtgggaatatgaaataaagtagaagaaaaggccatga

SEQ ID NO: 4740 - DNA, 948 bp, Homo sapiens
cttccccaccctccctaatttccactccccccaccccacttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgtcttttcctttcttttttgccaccctttcaggaaccctgtatggtttttagtttaaattaaaggagtcgttatcgtggtgggaatatgaaataaagtagaagaaaaggccatga

SEQ ID NO: 4741 - DNA, 1061 bp, Homo sapiens
ccccacaatgcccttcgccttcctcaacgtggcccccgctccaagcccattttctggagccaggaatccactctgtgggttaggaaaggccctcaggaggcggagggaaacctgtggaatgccgagaagccgtgtaatgaaataacgtcacgcctgcccctcaccattactctgaccagggttcgaaggtcacacttagagcctaaggggaaatggagaagtgcaaagggacgagcagaatggctggcaccacctcagctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttatcgtggtgggaatatgaaataaagtagaagaaaaggccatga

SEQ ID NO: 4742 - DNA, 1061 bp, Homo sapiens; identical to SEQ ID NO: 4741

SEQ ID NO: 4743 - DNA, 908 bp, Homo sapiens; identical to SEQ ID NO: 4727

SEQ ID NO: 4744 - DNA, 908 bp, Homo sapiens
ggaggaagcgaccaggtccggcacgaaggagggagaggtggcctgaggagcggaggggggatgtgtggattccggtgaaagggacctgacaatcgcccccaacccctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgtcttttcctttcttttttgccaccctttcaggaaccctgtatggtttttagtttaaattaaaggagtcgttatcgtggtgggaatatgaaataaagtagaagaaaaggccatga

SEQ ID NO: 4745 - DNA, 1061 bp, Homo sapiens; identical to SEQ ID NO: 4734

SEQ ID NO: 4746 - DNA, 936 bp, Homo sapiens
tgtggattccggtgaaagggacctgacaatcgcccccaacccgtgagaaaaggaggagcccagttcttgcttgagaatgataaacttggaaacccttgggaaaggcgtgggggtcatgcagagacttgtattgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgtcttttcctttcttttttgccaccctttcaggaaccctgtatggtttttagtttaaattaaaggagtcgttatcgtggtgggaatatgaaataaagtagaagaaaaggccatga

SEQ ID NO: 4747 - DNA, 2487 bp, Homo sapiens; identical to SEQ ID NO: 4731

SEQ ID NO: 4748 - DNA, 1061 bp, Homo sapiens; identical to SEQ ID NO: 4741

SEQ ID NO: 4749 - DNA, 948 bp, Homo sapiens; identical to SEQ ID NO: 4729

SEQ ID NO: 4750 - DNA, 936 bp, Homo sapiens; identical to SEQ ID NO: 4728

SEQ ID NO: 4751 - DNA, 948 bp, Homo sapiens; identical to SEQ ID NO: 4732

SEQ ID NO: 4752 - DNA, 948 bp, Homo sapiens; identical to SEQ ID NO: 4729

SEQ ID NO: 4753 - DNA, 936 bp, Homo sapiens; identical to SEQ ID NO: 4733

SEQ ID NO: 4754 - DNA, 948 bp, Homo sapiens; identical to SEQ ID NO: 4729

SEQ ID NO: 4755 - DNA, 908 bp, Homo sapiens; identical to SEQ ID NO: 4727

SEQ ID NO: 4756 - DNA, 936 bp, Homo sapiens; identical to SEQ ID NO: 4728

SEQ ID NO: 4757 - DNA, 936 bp, Homo sapiens
tgtggattccggtgaaagggacctgacaatcgcccccaacccgtgagaaaaggaggagcccggttcttgcttgagaatgataaacttggaaacccttgggaaaggcgtgggggtcatgcagagacttgtattgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttatcgtggtgggaatatgaaataaagtagaagaaaaggccatga

SEQ ID NO: 4758 - DNA, 5755 bp, Homo sapiens
gggggaggcggccggtgccgcggggccgccgccgcctctgagccgcgccgagctcacgagcgcagccgcgtcgctgcggccccggccgcgccatggggaaggagcaggagctggtgcaggcggtgaaggcggaggacgtagggaccgcgcagaggctgctgcagaggccgcggcccgggaaggccaagctcctgggttccaccaagaagatcaatgtcaacttccaggacccggatggcttctcggctctgcaccatgcggccctgaacggcaacacggaattgatcagcctgctgctggaggcccaggccgctgtggacatcaaggacaacaaaggcatgcggccgctgcactatgcggcctggcagggccggaaggagcccatgaagctggtgctgaaggcgggctcggccgtgaacatcccgtctgatgagggccacatccccctgcacctggcggcccagcatggtcactatgatgtgtctgagatgctgctacagcaccagtctaacccgtgcatggtggacaactcggggaagacgcccctggacctggcctgcgagttcggccgcgttggggtggtccagctgctcctcagcagcaatatgtgtgcggcgctgctggagccccggccgggagacgccaccgaccccaacggcaccagccctttgcacctcgcagctaaaaacggccacatcgacatcatcaggctcctcctccaagccggcatcgacattaaccgccagaccaagtccggcacggccctgcacgaggctgcgctctgcggaaagacagaggtggtgcggctgctgctggatagcgggatcaatgcccacgtgaggaacacctacagccagacagccctggacatcgtgcaccagttcaccacgtcccaggccagcagggagatcaagcagctgttgcgagaggcctcagcggccctgcaggtccgggcgaccaaggattattgcaacaattacgacctgaccagcctcaacgtgaaggcaggggacatcatcacagtcctcgagcagcatccggatggccggtggaagggctgcatccatgacaaccggacgggcaatgaccgggtgggctacttcccgtcctccctgggcgaggccattgtcaagcgagcaggttcccgagcaggcactgaaccaagcctgccccagggaagcagctcatcgggaccctctgcacccccagaggagatctgggtgctgaggaagccttttgcaggtggggaccgaagcggcagcattagcggcatggctggcggccggggcagcgggggtcacgccctacacgcgggctctgaaggcgtcaagctcctggcaacggtgctttcccagaagtccgtctctgagtccggcccgggggacagccccgccaagcctccggaaggctctgcaggtgtggcccggtcccagcctccagtggcccacgccgggcaggtctatggggagcagccgcccaagaagctggagccagcatcggagggcaagagctctgaggccgtgagccagtggctcaccgcgttccagctgcagctctacgcccccaacttcatcagcgccggctacgacctgcccaccatcagccgcatgactcccgaggacctcacggccattggtgtcaccaagccgggccaccggaagaagatcgcggcagagatcagcggcctaagcatccctgactggctgcctgagcacaaacccgctaacctggccgtgtggctgtccatgatcggcctggcccagtactacaaggtgttggtggacaatggctacgagaacattgatttcatcaccgacatcacctgggaggacctgcaggagatcggcatcaccaagctggggcaccagaagaagctgatgctcgctgtgaggaagctggcagagctgcagaaggctgaatacgccaagtatgaggggggccccctgcgccggaaggcgccccagtctcttgaagtgatggccatcgagtcgccgcccccgcctgagcccacaccggccgactgccagtcccctaaaatgaccaccttccaggacagcgagctcagtgacgagctgcaggctgccatgactggcccggctgaggtggggcccaccactgagaagccctccagccacctgccacccaccccgagggccaccacgcggcaggactccagcctgggtggtcgggcacggcacatgagcagctcgcaggagctgctgggagatgggccccctgggcccagcagccccatgtctcgaagccaggagtacctcctggatgagggccccgcccccggcaccccgcccagggaggcccggcccggccgccacggccacagcatcaagagggccagcgtgccccccgtgcctggcaagccacggcaggtcctcccaccaggcactagccacttcacgcccccccagacgcccaccaaaacccgaccaggctctccccaggcccttgggggacctcatggtccagccccagctacggccaaggtgaagcccaccccgcagctgctgccgccgacagagcgccccatgtcaccccgctccctgcctcagtcaccgacgcaccgcggctttgcctacgtgctgccccagcccgtggagggcgaggtggggccggctgccccggggcctgcgcccccacccgtgccgacggctgtgcccacactgtgcctgccccctgaggccgacgcggagccggggcggcccaagaagcgggcccacagcctgaatcgctatgcggcgtccgacagcgagccggagcgggacgagctgctggtgcctgcggctgccggcccctatgccacggtccagcggcgcgtgggccgcagccactcagtgagggcgcccgcaggtgccgacaagaacgtcaaccgcagccagtcctttgccgtgcggccccgaaagaaggggcccccgccgcccccacccaagcgctccagctcggccctggctagtgccaacctggcggatgagccggtgcctgacgccgagcctgaggatggcctgctgggggtccgggcacagtgccggcgggccagtgacctggccggcagcgtggacacgggtagtgccggcagtgtgaagagcatcgcggccatgctggagctgtcctccattgggggtgggggccgggctgcccgcaggcctcctgagggccaccccactccccgccctgccagcccagagccgggccgggtggccaccgtgctggcctcagtgaaacacaaagaggccatcgggcctggcggggaggtggtgaaccggcgccgcacgctcagcgggccagtcaccggacttctggccactgcccgccgggggcctggggagtcggcagacccaggcccctttgtggaggatggcactggccggcagcggcctcggggtccctccaagggcgaggcgggtgtcgaaggcccgcccttggccaaggtggaagccagcgccacactcaagaggcgcatccgggccaagcagaaccagcaggagaacgtcaagttcatcctgaccgagtctgacacggtcaagcgcaggcccaaggccaaggagcgggaggccgggcctgagccaccaccgccactgtccgtgtaccataatggcactggcaccgtgcgccgccgaccggcctcggagcaggctgggcctccggagctgcctccaccgcccccgcctgccgaacccccgcccaccgacctggcgcacctacccccattgcccccgcccgagggcgaagcccggaagccggccaagccgcctgtctctcccaagcccgtcctgacgcagcctgtgcccaagctccagggctcgcccacacccacctccaagaaggtgccgctgccaggccctggcagcccagaggtgaagcgcgcccacggcacgccaccgcccgtgtctcccaagccgccgccgccgcccacagcgcccaagcccgtcaaggcggtcgcggggctgccttcgggcagcgccggcccttcacccgcaccctcgcccgcgcgacagccgcccgccgccctcgccaagccgcccggtacgccgccctcgctgggcgccagccccgccaagcccccgtcccccggcgcgcccgcgctgcacgtgcccgccaagcccccgcgagccgccgccgccgccgccgccgccgccgccgcgccccccgccccgcccgaaggcgcctcgccaggggacagcgcccggcagaaactggaggagacaagcgcgtgcctggccgcggcgctgcaggcggtggaggagaagatccggcaggaggacgcgcagggcccgcgcgactcggcggcggaaaagagcactggcagcatcctggacgacatcggcagcatgttcgacgacctggccgaccagctggatgccatgctggagtgaacgccgcctggccgggccctcccgcgccgcccgggccctccccgcacactgacctatacctcaggatgggcgcgtctgggcgcggcgcgagcggccgggcagggccctgcagaagcacaactccggcccctggacccgggccggggcgcccaccggggaccgcctggccgggggctccaagggctctaggcagaccctgcgcccgcgggtcctccccacctgctgctccccgtgcaatacctgctgggcctcctgcccgcgcgggaggggagggcgccccgggaccagggatggggcagcgcacaggcccgggcccagcacagaactgcccatcgggacgcccggccagccgctcgggcgcagcacaagggacaggggaccaaggtcagggcccccctgccccaccgcacccccagaatataagctatcaagagtattaatttattgggaatgagctgaggcggatttccccagagaaacaaaaaggtataactttaacaaatatatatttaaagaaagaaatattattgattctatagaaaaccatttaccaactgaaaggacacgaagtctagctccggacaaaagctgttagaggcccaggctgtctgcctgcggtccttcctccggccagagtggaggccccaggctgctagcacaggtggaaggctggggcccgggggcgggtgctctgccgggggctcctccgtgcttctctcctaagttctctgcgccccaagaactcgaggttgtgccttgctctcggcggccgtgtcctcctcctggcgtggctgcgtcccagggcgcgggtgggtttggtgaatgtgggtgtgtcagcgtggcagccacgtggaagcagggcatgtagcaggccaggccacgggcttgcagctcctctgagggtgtgcctggccccctctccaggggctgtgcaggcagcccatccaccccagtggagttcccacggacgcttctgctcatggtccaaggctgtgttgtgtggtcattctcgccctcccttttcctctctcctcctgccccctccaagaagtactgactggtctcctctatcgtgtttgctgatccacagtgttgggcacaactttgacgtttcttaaaaaaaaaatttaaaaaatgccgaaaaccagcgattgtggtgtggggcgggtggaggcggctggcggaggtggcgtcccggcgtgcagggccccttcctgctgtctcaccccgtgtttccctgcgagtggacgtgcccagctgtccccccaggcctctcctcagagggcggcacaggctgggctccagcaggtgggcaggggaggtctgggcaaggcgctgccgtcggctgtcaataaacagcaggaaac

SEQ ID NO: 4759 - DNA, 2660 bp, Homo sapiens
cgcagccgcgtcgctgcggccccggccgcgccatggggaaggagcaggagctggtgcaggcggtgaaggcggaggacgtagggaccgcgcagaggctgctgcagaggccgcggcccgggaaggccaagctcctgggttccaccaagaagatcaatgtcaacttccaggacccggatggcttctcggctctgcaccatgcggccctgaacggcaacacggaattgatcagcctgctgctggaggcccaggccgctgtggacatcaaggacaacaaaggcatgcggccgctgcactatgcggcctggcagggccggaaggagcccatgaagctggtgctgaaggcgggctcggccgtgaacatcccgtctgatgagggccacatccccctgcacctggcggcccagcatggtcactatgatgtgtctgagatgctgctacagcaccagtctaacccgtgcatggtggacaactcggggaagacgcccctggacctggcctgcgagttcggccgcgttggggtggtccagctgctcctcagcagcaatatgtgtgcggcgctgctggagccccggccgggagacgccaccgaccccaacggcaccagccctttgcacctcgcagctaaaaacggccacatcgacatcatcaggctcctcctccaagccggcatcgacattaaccgccagaccaagtccggcacggccctgcacgaggctgcgctctgcggaaagacagaggtggtgcggctgctgctggatagcgggatcaatgcccacgtgaggaacacctacagccagacagccctggacatcgtgcaccagttcaccacgtcccaggccagcagggagatcaagcagctgttgcgagaggcctcagcggccctgcaggtccgggcgaccaaggattattgcaacaattacgacctgaccagcctcaacgtgaaggcaggggacatcatcacagtcctcgagcagcatccggatggccggtggaagggctgcatccatgacaaccggacgggcaatgaccgggtgggctacttcccgtcctccctgggcgaggccattgtcaagcgagcaggttcccgagcaggcactgaaccaagcctgccccagggaagcagctcatcgggaccctctgcacccccagaggagatctgggtgctgaggaagccttttgcaggtggggaccgaagcggcagcattagcggcatggctggcggccggggcagcgggggtcacgccctacacgcgggctctgaaggcgtcaagctcctggcaacggtgctttcccagaagtccgtctctgagtccggcccgggggacagccccgccaagcctccggaaggctctgcaggtgtggcccggtcccagcctccagtggcccacgccgggcaggtctatggggagcagccgcccaagaagctggagccagcatcggagggcaagagctctgaggccgtgagccagtggctcaccgcgttccagctgcagctctacgcccccaacttcatcagcgccggctacgacctgcccaccatcagccgcatgactcccgaggacctcacggccattggtgtcaccaagccgggccaccggaagaagatcgcggcagagatcagcggcctaagcatccctgactggctgcctgagcacaaacccgctaacctggccgtgtggctgtccatgatcggcctggcccagtactacaaggtgttggtggacaatggctacgagaacattgatttcatcaccgacatcacctgggaggacctgcaggagatcggcatcaccaagctggggcaccagaagaagctgatgctcgctgtgaggaagctggcagagctgcagaaggctgaatacgccaagtatgaggggggccccctgcgccggaaggcgccccagtctcttgaagtgatggccatcgagtcgccgcccccgcctgagcccacaccggccgactgccagtcccctaaaatgaccaccttccaggacagcgagctcagtgacgagctgcaggctgccatgactggcccggctgaggtggggcccaccactgagaagccctccagccacctgccacccaccccgagggccaccacgcggcaggactccagcctgggtggtcgggcacggcacatgagcagctcgcaggagctgctgggagatgggccccctgggcccagcagccccatgtctcgaagccaggagtacctcctggatgagggccccgcccccggcaccccgcccagggaggcccggcccggccgccacggccacagcatcaagagggccagcgtgccccccgtgcctggcaagccacggcaggtcctcccaccaggcactagccacttcacgcccccccagacgcccaccaaaacccgaccaggctctccccaggcccttgggggacctcatggtccagccccagctacggccaaggtgaagcccaccccgcagctgctgccgccgacagagcgccccatgtcaccccgctccctgcctcagtcaccgacgcagcgcacaggcccgggcccagcacagaactgcccatcgggacgcccggccagccgctcgggcgcagcacaagggacaggggaccaaggtcagggcccccctgccccaccgcacccccagaatataagctatcaagagtattaa

SEQ ID NO: 4760 - DNA, 4977 bp, Homo sapiens
gggaggggcgggatttcctgcgggaggcgccgagccggccttggaaaaggagaaggagaaaggggggcaggggggagtgggagccaccgtcctgagtgccagggaccgagcagggccagccggaccccggcgggcggccgggagagagccctgagaccagtgcaccgctgctgcctgaggcccaagggaatgctggctgctctctgggtgggcactggtgttccacagccaagccgggaagattggtgtgcccagtcccagcccatcctggagctgtcggaagccacaagctgatatccatccagatttccatgtagccttcaccccctcaaagattagctttccttcgtgtggtggcagttcacggagcacctttgggagtatccctcagtacctgacgaggagcccactgcctgggacacctgacttgctcccccggaaccgggagccctccaaggggctgtggcatggcgccctgacgccccagcttggacccgttgcctgcctttgccctggactcctgagtgtagagctcagcccaggagccagtatgggtcgtgaacaggacctgatcctcgccgtcaagaatggagatgtgaccggtgtgcagaaactggtggcgaaggtcaaggccacaaagacaaagctcctgggctccacaaagaggctcaacgtgaactaccaggatgctgatggattctctgccctccaccacgctgctttggggggcagcctggagctcatagccttgctgctagaggctcaggccactgttgacatcaaggacagcaatggcatgcgcccgctgcactacgcagcctggcagggccggctggagcctgtgaggctgctgctgcgcgcctctgcggctgtcaatgccgcctcgctggacggacagatccccctgcacctggctgcacagtatggacattatgaggtgtcagaaatgctcctccagcatcagtccaacccatgcctggtcaacaaggccaagaagacgcccctggacctggcctgtgaatttggccgactcaaggtggcccagctgcttctgaacagccacttatgtgtggcactgctggagggtgaggccaaagacccgtgtgaccccaactacaccacgcccctgcacttggctgccaagaatggccacagagaagtcatcaggcagctcctgagagctgggatcgagatcaaccgccagaccaagacgggtacggcgctccacgaggccgcactgtatggcaagaccgaggtggtgcggctgcttctggagggaggtgtggacgtgaacatccggaatacgtataaccagacggcgctggacatagtgaatcagttcaccacctcccaggccagccgggaaatcaagcagctactgcgggaggcctcagggatcctgaaggtccgagcgctcaaggatttctggaacctccacgatcccactgctctcaatgtccgggcaggggatgtcatcacggtgctagaacagcatcccgacggccgctggaagggccacatccacgagagccagaggggcacagaccgcataggctacttccccccgggcattgtcgaggtggtcagcaagcgggtgggcatccctgcagcccgcctcccctccgcacccacccccctgcgcccaggcttctcccggacaccgcagcctcctgccgaagaacccccgcaccctcttacctacagccagcttcctcgggtgggcctcagcccagacagcccagcaggtgacaggaatagtgtgggcagtgagggcagcgtgggcagcatccgcagtgccggcagcgggcagagctctgagggcactaatggccatggccctggcctcctgattgagaacgcccagccactgccctctgctggagaggaccaggtgctgccaggactccacccgccgtccctggcagacaacctgagccaccgccctctggccaactgccgctctggggagcagatcttcacccaggacgtgcggccagaacagctgctggaggggaaggacgcgcaggccattcataactggctaagcgagttccagctggagggctacactgcccactttctgcaggccggctatgatgtgcctaccatcagccgcatgacacctgaggacctgacggccatcggggtgaccaagcctgggcacaggaagaagatcgcctcagagatcgctcagctcagcatcgccgagtggctgcccagctacatcccaacggacctgctggagtggctgtgtgcactggggctgccacagtaccacaagcagctggtgagcagcggctacgactccatggggctggtggccgacctcacctgggaggagctgcaggagattggggtcaacaagctcgggcatcagaagaagctcatgctgggggtgaagcggctggcggagcttcggcggggcctgctgcagggggaggccctcagcgaaggcgggcgccggctggccaagggtccggagctgatggccatcgagggactggagaacggagaaggcccagctacagctggcccacggctcctcaccttccagggcagcgaactaagcccagagctacaggcggccatggcagggggtggccctgaaccactccccctcccacctgcccgctctcccagccaggagagcatcggggcacgctcacgggggtctggccactcacaggaacagcctgccccacagcccagcggtggagatcccagccccccccaggagaggaacctcccagagggcacagagcggccccctaagctttgttcttcacttcctggccaaggacccccaccctatgtttttatgtacccccagggctcaccctctagcccggccccagggccacctcctggcgcaccctgggccttctcctacttggccgggccccctgccactcccccagacccgcctcgacctaagcgccggtcccacagcctaagccgccctggccccacagagggggatgctgagggggaggccgaagggccagtgggcagcaccctaggcagttatgctacccttacccggcggccaggacgcagtgcccttgtccggaccagtcctagtgtgaccccaaccccagctcgggggactcctcgcagccagtcctttgccctgcgggcccggcgcaaaggccccccgcccccgccccccaagcgcctcagctccgtctctggccccagcccggagccacctccactagatgagagcccagggcccaaggaaggggccacagggccccgaaggcgaacactgagtgaacctgctggcccctcagagccccctggcccacctgccccggctgggcccgcgtcagacacggaggaggaggagccaggccctgaggggacgcccccatctcggggcagctctggggaagggctgccgtttgcagaggaagggaacctgaccatcaaacagcgcccgaagcccgctggccccccgccccgagagacacccgtgccccccggcctcgatttcaacctcacggaatcagacactgttaagcggaggcccaagtgccgggagagagagccactgcagaccgcactgctggccttcggagtggccagtgccacgcctggccccgctgccccactgccttccccaactcctggcgagtctcctccagcttctagccttccccagcccgagcccagcagccttccagcccaaggagttccaaccccccttgctcccagccccgccatgcagcctccagtgccgccctgcccagggccaggtctggaaagctcagcagctagtcggtggaatggggagacagaacccccggccgcccctgctgccctcctcaaggtgcccggagcaggaacagcccccaagcctgtgtcggtggcctgcacccagctggcattttctggccctaagctagcgccccggctcggcccccgcccagtgcctcctccacggcctgagagcactgggactgtgggcccaggccaggcccagcagagactggagcagaccagctcgtccctggcagctgcactgagagccgcagagaagagcattggcaccaaggagcaagagggcacccccagcgcctccaccaagcacattctggatgacatcagcaccatgttcgacgccctggctgaccagctggacgccatgctggactgagccctccagcagtgcccactgtgacctgccgaagtccactgcctttgccccagcacagaagaggcccctgccaccctagggacgggccaagggctggtcaggctgaagtgcccctcctagcagggccccttcccactcagcccgcggctgtgggcaccacagctcttgtggggcagcccaccttagaacctgactagcgagggacctccgctgcatctcagcaaagcccctcccagggtttgatcgattgagcaggacagccctgctcctggacagggaccctggtaagagctctctcctcagggaggaagtaggggtggggctttgggggtgctttctctgtaccccccagcccatgtcccaagttgtgccaagggaatgcctcttgccacccaccatcctgcccaggccctgagaggctggaggaggcgtgtgtctggccgggccccctctccgtaggtgtacagaggacatgtaaatacacagcggtggtgcccaggcagctcctgcccccgccttccctcactgaggcagggctagcaggggtgggaggcagtggggttaacagatcccacaagtcctaacttttcaattgtaaatgttattttctaagcagagagaaatgcatatattttaaatggaatttattctatcaactgcctgagaggacacaatgggggaggggcttcggaccacagcaggagccccgactgcccacctgagggcagggagagcctgaccccattggcccaggccctggctctgtaaccattaacctcttcccccaactaacaccaatgaaaacaccattccacgtg

SEQ ID NO: 4761 - DNA, 4486 bp, Homo sapiens
ctctcgggagggactgcatcccgccacccagctgcctcatcccaaactgtccaggctgttggaagaggagggctaatggaagagtgggcagcttgaagggtgctctgtgtctcttccctgctgaccgcattgtctccactggggctcagagagagctcctgggctccacaaagaggctcaacgtgaactaccaggatgctgatggattctctgccctccaccacgctgctttggggggcagcctggagctcatagccttgctgctagaggctcaggccactgttgacatcaaggacagcaatggcatgcgcccgctgcactacgcagcctggcagggccggctggagcctgtgaggctgctgctgcgcgcctctgcggctgtcaatgccgcctcgctggacggacagatccccctgcacctggctgcacagtatggacattatgaggtgtcagaaatgctcctccagcatcagtccaacccatgcctggtcaacaaggccaagaagacgcccctggacctggcctgtgaatttggccgactcaaggtggcccagctgcttctgaacagccacttatgtgtggcactgctggagggtgaggccaaagacccgtgtgaccccaactacaccacgcccctgcacttggctgccaagaatggccacagagaagtcatcaggcagctcctgagagctgggatcgagatcaaccgccagaccaagacgggtacggcgctccacgaggccgcactgtatggcaagaccgaggtggtgcggctgcttctggagggaggtgtggacgtgaacatccggaatacgtataaccagacggcgctggacatagtgaatcagttcaccacctcccaggccagccgggaaatcaagcagctactgcgggaggcctcagggatcctgaaggtccgagcgctcaaggatttctggaacctccacgatcccactgctctcaatgtccgggcaggggatgtcatcacggtgctagaacagcatcccgacggccgctggaagggccacatccacgagagccagaggggcacagaccgcataggctacttccccccgggcattgtcgaggtggtcagcaagcgggtgggcatccctgcagcccgcctcccctccgcacccacccccctgcgcccaggcttctcccggacaccgcagcctcctgccgaagaacccccgcaccctcttacctacagccagcttcctcgggtgggcctcagcccagacagcccagcaggtgacaggaatagtgtgggcagtgagggcagcgtgggcagcatccgcagtgccggcagcgggcagagctctgagggcactaatggccatggccctggcctcctgattgagaacgcccagccactgccctctgctggagaggaccaggtgctgccaggactccacccgccgtccctggcagacaacctgagccaccgccctctggccaactgccgctctggggagcagatcttcacccaggacgtgcggccagaacagctgctggaggggaaggacgcgcaggccattcataactggctaagcgagttccagctggagggctacactgcccactttctgcaggccggctatgatgtgcctaccatcagccgcatgacacctgaggacctgacggccatcggggtgaccaagcctgggcacaggaagaagatcgcctcagagatcgctcagctcagcatcgccgagtggctgcccagctacatcccaacggacctgctggagtggctgtgtgcactggggctgccacagtaccacaagcagctggtgagcagcggctacgactccatggggctggtggccgacctcacctgggaggagctgcaggagattggggtcaacaagctcgggcatcagaagaagctcatgctgggggtgaagcggctggcggagcttcggcggggcctgctgcagggggaggccctcagcgaaggcgggcgccggctggccaagggtccggagctgatggccatcgagggactggagaacggagaaggcccagctacagctggcccacggctcctcaccttccagggcagcgaactaagcccagagctacaggcggccatggcagggggtggccctgaaccactccccctcccacctgcccgctctcccagccaggagagcatcggggcacgctcacgggggtctggccactcacaggaacagcctgccccacagcccagcggtggagatcccagccccccccaggagaggaacctcccagagggcacagagcggccccctaagctttgttcttcacttcctggccaaggacccccaccctatgtttttatgtacccccagggctcaccctctagcccggccccagggccacctcctggcgcaccctgggccttctcctacttggccgggccccctgccactcccccagacccgcctcgacctaagcgccggtcccacagcctaagccgccctggccccacagagggggatgctgagggggaggccgaagggccagtgggcagcaccctaggcagttatgctacccttacccggcggccaggacgcagtgcccttgtccggaccagtcctagtgtgaccccaaccccagctcgggggactcctcgcagccagtcctttgccctgcgggcccggcgcaaaggccccccgcccccgccccccaagcgcctcagctccgtctctggccccagcccggagccacctccactagatgagagcccagggcccaaggaaggggccacagggccccgaaggcgaacactgagtgaacctgctggcccctcagagccccctggcccacctgccccggctgggcccgcgtcagacacggaggaggaggagccaggccctgaggggacgcccccatctcggggcagctctggggaagggctgccgtttgcagaggaagggaacctgaccatcaaacagcgcccgaagcccgctggccccccgccccgagagacacccgtgccccccggcctcgatttcaacctcacggaatcagacactgttaagcggaggcccaagtgccgggagagagagccactgcagaccgcactgctggccttcggagtggccagtgccacgcctggccccgctgccccactgccttccccaactcctggcgagtctcctccagcttctagccttccccagcccgagcccagcagccttccagcccaaggagttccaaccccccttgctcccagccccgccatgcagcctccagtgccgccctgcccagggccaggtctggaaagctcagcagctagtcggtggaatggggagacagaacccccggccgcccctgctgccctcctcaaggtgcccggagcaggaacagcccccaagcctgtgtcggtggcctgcacccagctggcattttctggccctaagctagcgccccggctcggcccccgcccagtgcctcctccacggcctgagagcactgggactgtgggcccaggccaggcccagcagagactggagcagaccagctcgtccctggcagctgcactgagagccgcagagaagagcattggcaccaaggagcaagagggcacccccagcgcctccaccaagcacattctggatgacatcagcaccatgttcgacgccctggctgaccagctggacgccatgctggactgagccctccagcagtgcccactgtgacctgccgaagtccactgcctttgccccagcacagaagaggcccctgccaccctagggacgggccaagggctggtcaggctgaagtgcccctcctagcagggccccttcccactcagcccgcggctgtgggcaccacagctcttgtggggcagcccaccttagaacctgactagcgagggacctccgctgcatctcagcaaagcccctcccagggtttgatcgattgagcaggacagccctgctcctggacagggaccctggtaagagctctctcctcagggaggaagtaggggtggggctttgggggtgctttctctgtaccccccagcccatgtcccaagttgtgccaagggaatgcctcttgccacccaccatcctgcccaggccctgagaggctggaggaggcgtgtgtctggccgggccccctctccgtaggtgtacagaggacatgtaaatacacagcggtggtgcccaggcagctcctgcccccgccttccctcactgaggcagggctagcaggggtgggaggcagtggggttaacagatcccacaagtcctaacttttcaattgtaaatgttattttctaagcagagagaaatgcatatattttaaatggaatttattctatcaactgcctgagaggacacaatgggggaggggcttcggaccacagcaggagccccgactgcccacctgagggcagggagagcctgaccccattggcccaggccctggctctgtaaccattaacctcttcccccaactaacaccaatgaaaacaccattccacgtg

SEQ ID NO: 4762 - DNA, 1306 bp, Homo sapiens
gtgtacatgatttcattctgttcactttgttatgtcaaaaagaagaaaacaccttctgcttcctattttccaaaggaaagcagttatacacgagatcagagtctaattttatcttggcaaagaaaaagagaatttgaggactgggaattttccattcagggtaatatcaacaagctggtccactgagaggagagcaagcctgttgaaattgtttttgctttcacagctttttcctgtccggggagcaggagaagccatggctgatgagaaaccatccaacggtgttctggtccacatggtgaagttgctgatcaagacctttctagatggcatttttgatgatttgatggaaaataatgtattaaatacagatgagatacaccttataggaaaatgtctaaagtttgtggtgagcaatgctgaaaacctggttgatgatatcactgagacagctcaaactgcaggcaaaatatttagggaacacctgtggaattccaaaaaacagctgagttcagatatatccagtgatggagaaagagaggcgaacatgcctggcctcaacatccgcaacaaagaattcaactatcttcataatcgaaatggttctgaacttgaccttttggggatgcgagatctacttgaaaaccttggatactcagtggttataaaagagaatctcacagctcaggaaatggaaacagcactaaggcagtttgctgctcacccagagcaccagtcctcagacagcacattcctggtgtttatgtcacatagcatcctgaatggaatctgtgggaccaagcactgggatcaagagccagatgttcttcacgatgacaccatctttgaaattttcaacaaccgtaactgccagagtctgaaagacaaacccaaggtcatcatcatgcaagcctgccgaggcaatggtgctgggattgtttggttcaccactgacagtggaaaagccggtgcagatactcatggtcggctcttgcaaggtaacatctgtaatgatgctgttacaaaggctcatgtggaaaaggacttcattgctttcaaatcttccacaccacataatgtttcttggagacatgaaacaaatggctctgtcttcatttcccaaattatctactacttcagagagtattcttggagtcatcatctagaggaaatttttcaaaaggttcaacattcatttgagaccccaaatatactgacccagctgcccaccattgaaagactatccatgacacgatatttctatctctttcctgggaattaaaactcataagaagcaactcaggta

SEQ ID NO: 4763 - DNA, 1451 bp, Homo sapiens
ccggggagcaggagaagccatggctgatgagaaaccatccaacggtgttctggtccacatggtgaagttgctgatcaagacctttctagatggcatttttgatgatttgatggaaaataatgtattaaatacagatgagatacaccttataggaaaatgtctaaagtttgtggtgagcaatgctgaaaacctggttgatgatatcactgagacagctcaaactgcaggcaaaatatttagggaacacctgtggaattccaaaaaacagctgagttcagatatatccagtgatggagaaagagaggcgaacatgcctggcctcaacatccgcaacaaagaattcaactatcttcataatcgaaatggttctgaacttgaccttttggggatgcgagatctacttgaaaaccttggatactcagtggttataaaagagaatctcacagctcaggaaatggaaacagcactaaggcagtttgctgctcacccagagcaccagtcctcagacagcacattcctggtgtttatgtcacatagcatcctgaatggaatctgtgggaccaagcactgggatcaagagccagatgttcttcacgatgacaccatctttgaaattttcaacaaccgtaactgccagagtctgaaagacaaacccaaggtcatcatcatgcaagcctgccgaggcaatggtgctgggattgtttggttcaccactgacagtggaaaagccggtgcagatactcatggtcggctcttgcaaggtaacatctgtaatgatgctgttacaaaggctcatgtggaaaaggacttcattgctttcaaatcttccacaccacataatgtttcttggagacatgaaacaaatggctctgtcttcatttcccaaattatctactacttcagagagtattcttggagtcatcatctagaggaaatttttcaaaaggttcaacattcatttgagaccccaaatatactgacccagctgcccaccattgaaagactatccatgacacgatatttctatctctttcctgggaattaaaactcataagaagcaactcaggaaaatgaaggcattatggtgtctatgaatctgctattagaaaaggtcaatttttgattaagaatatttttataccaaactgctcagctgtccaccttttcaaataccaggctaaaatcaatctcatatttttgctaaattaatgcttaataaatttttattataaaattgtgcttgttttctaattttgtcataaattaagtcatgcttataggagaaaaaattaagtattaaaaatcataaaaaatgaagaaataatcatcatcaacctttttaaaactattcataaaaactcaagttttttatatagcttatttattttgtatatccaattttgtgtgcttttattatattgttataacattactactagtaataaaactat

SEQ ID NO: 4764 - DNA, 2673 bp, Homo sapiens
acatctcccggcggcgggccgcggaagcagtgcagacgcggctcctagcggatgggtgctattgtgaggcggttgtagaagagtttcgtgagtgctcgcagctcatacctgtggctgtgtatccgtggccacagctggttggcgtcgccttgaaatcccaggccgtgaggagttagcgagccctgctcacactcggcgctctggttttcggtgggtgtgccctgcacctgcctcttcccccattctcattaataaaggtatccatggagaacactgaaaactcagtggattcaaaatccattaaaaatttggaaccaaagatcatacatggaagcgaatcaatggactctggaatatccctggacaacagttataaaatggattatcctgagatgggtttatgtataataattaataataagaattttcataaaagcactggaatgacatctcggtctggtacagatgtcgatgcagcaaacctcagggaaacattcagaaacttgaaatatgaagtcaggaataaaaatgatcttacacgtgaagaaattgtggaattgatgcgtgatgtttctaaagaagatcacagcaaaaggagcagttttgtttgtgtgcttctgagccatggtgaagaaggaataatttttggaacaaatggacctgttgacctgaaaaaaataacaaactttttcagaggggatcgttgtagaagtctaactggaaaacccaaacttttcattattcaggcctgccgtggtacagaactggactgtggcattgagacagacagtggtgttgatgatgacatggcgtgtcataaaataccagtggaggccgacttcttgtatgcatactccacagcacctggttattattcttggcgaaattcaaaggatggctcctggttcatccagtcgctttgtgccatgctgaaacagtatgccgacaagcttgaatttatgcacattcttacccgggttaaccgaaaggtggcaacagaatttgagtccttttcctttgacgctacttttcatgcaaagaaacagattccatgtattgtttccatgctcacaaaagaactctatttttatcactaaagaaatggttggttggtggttttttttagtttgtatgccaagtgagaagatggtatatttggtactgtatttccctctcattttgacctactctcatgctgcagagggtactttaagacatactccttccatcaaatagaaccactatgaagctacctcaaacttccagtcaggtagttgcaattgaattaaattaggaataaataaaaatggatactggtgcagtcattatgagaggcaatgattgttaatttacagctttcatgattagcaagttacagtgatgctgtgctatgaattttcaagtaattgtgaaaaagttaaacattgaagtaatgaatttttatgatattccccccacttaagactgtgtattctagttttgtcaaactgtagaaatgatgatgtggaagaacttaggcatctgtgggcatggtcaaaggctcaaacctttattttagaattgatatacacggatgacttaactgcatttttagaccatttatctgggattatggttttgtgatgtttgtcctgaacacttttgttgtaaaaaaataataataatgtttaatattgagaaagaaactaatattttatgtgagagaaagtgtgagcaaactaacttgacttttaaggctaaaacttaacattcatagaggggtggagttttaactgtaaggtgctacaatgcccctggatctaccagcataaatatcttctgatttgtccctatgcatatcagttgagcttcatataccagcaatatatctgaagagctattatataaaaaccccaaactgttgattattagccaggtaatgtgaataaattctataggaacatatgaaaatacaacttaaataataaacagtggaatataaggaaagcaataaatgaatgggctgagctgcctgtaacttgagagtagatggtttgagcctgagcagagacatgactcagcctgttccatgaaggcagagccatggaccacgcaggaagggcctacagcccatttctccatacgcactggtatgtgtggatgatgctgccagggcgccatcgccaagtaagaaagtgaagcaaatcagaaacttgtgaagtggaaatgttctaaaggtggtgaggcaataaaaatcatagtactctttgtagcaaaattcttaagtatgttattttctgttgaagtttacaatcaaaggaaaatagtaatgttttatactgtttactgaaagaaaaagacctatgagcacataggactctagacggcatccagccggaggccagagctgagccctcagcccgggaggcaggctccaggcctcagcaggtgcggagccgtcactgcaccaagtctcactggctgtcagtatgacatttcacgggagatttcttgttgctcaaaaaatgagctcgcatttgtcaatgacagtttcttttttcttactagacctgtaacttttgtaaatacacatagcatgtaatggtatcttaaagtgtgtttctatgtgacaattttgtacaaatttgttattttccatttttatttcaaaatatacattcaaacttaaaatta

SEQ ID NO: 4765 - DNA, 2621 bp, Homo sapiens
atccgtggccacagctggttggcgtcgccttgaaatcccaggccgtgaggagttagcgagccctgctcacactcggcgctctggttttcggtgggtgtgccctgcacctgcctcttcccccattctcaatgagatcaccatcctcagaataatttgtaccccgctgggcactagctaatggaggtgatgtcatgctaagcagcacttcagtgagttttgcgggaaccaaagctctgctcccaggagtgtggatttggtgctttcatgtggaaaaagcggatgatgacaagtagagagcaaatgtgcgcatgtctgatgctttaataaaggtatccatggagaacactgaaaactcagtggattcaaaatccattaaaaatttggaaccaaagatcatacatggaagcgaatcaatggactctggaatatccctggacaacagttataaaatggattatcctgagatgggtttatgtataataattaataataagaattttcataaaagcactggaatgacatctcggtctggtacagatgtcgatgcagcaaacctcagggaaacattcagaaacttgaaatatgaagtcaggaataaaaatgatcttacacgtgaagaaattgtggaattgatgcgtgatgtttctaaagaagatcacagcaaaaggagcagttttgtttgtgtgcttctgagccatggtgaagaaggaataatttttggaacaaatggacctgttgacctgaaaaataacaaactttttcagaggggatcgttgtagaagtctaactggaaaacccaaacttttcattattcaggttattattcttggcgaaattcaaaggatggctcctggttcatccagtcgctttgtgccatgctgaaacagtatgccgacaagcttgaatttatgcacattcttacccgggttaaccgaaaggtggcaacagaatttgagtccttttcctttgacgctacttttcatgcaaagaaacagattccatgtattgtttccatgctcacaaaagaactctatttttatcactaaagaaatggttggttggtggttttttttagtttgtatgccaagtgagaagatggtatatttggtactgtatttccctctcattttgacctactctcatgctgcagagggtactttaagacatactccttccatcaaatagaaccactatgaagctacctcaaacttccagtcaggtagttgcaattgaattaaattaggaataaataaaaatggatactggtgcagtcattatgagaggcaatgattgttaatttacagctttcatgattagcaagttacagtgatgctgtgctatgaattttcaagtaattgtgaaaaagttaaacattgaagtaatgaatttttatgatattccccccacttaagactgtgtattctagttttgtcaaactgtagaaatgatgatgtggaagaacttaggcatctgtgggcatggtcaaaggctcaaacctttattttagaattgatatacacggatgacttaactgcatttttagaccatttatctgggattatggttttgtgatgtttgtcctgaacacttttgttgtaaaaaaataataataatgtttaatattgagaaagaaactaatattttatgtgagagaaagtgtgagcaaactaacttgacttttaaggctaaaacttaacattcatagaggggtggagttttaactgtaaggtgctacaatgcccctggatctaccagcataaatatcttctgatttgtccctatgcatatcagttgagcttcatataccagcaatatatctgaagagctattatataaaaaccccaaactgttgattattagccaggtaatgtgaataaattctataggaacatatgaaaatacaacttaaataataaacagtggaatataaggaaagcaataaatgaatgggctgagctgcctgtaacttgagagtagatggtttgagcctgagcagagacatgactcagcctgttccatgaaggcagagccatggaccacgcaggaagggcctacagcccatttctccatacgcactggtatgtgtggatgatgctgccagggcgccatcgccaagtaagaaagtgaagcaaatcagaaacttgtgaagtggaaatgttctaaaggtggtgaggcaataaaaatcatagtactctttgtagcaaaattcttaagtatgttattttctgttgaagtttacaatcaaaggaaaatagtaatgttttatactgtttactgaaagaaaaagacctatgagcacataggactctagacggcatccagccggaggccagagctgagccctcagcccgggaggcaggctccaggcctcagcaggtgcggagccgtcactgcaccaagtctcactggctgtcagtatgacatttcacgggagatttcttgttgctcaaaaaatgagctcgcatttgtcaatgacagtttcttttttcttactagacctgtaacttttgtaaatacacatagcatgtaatggtatcttaaagtgtgtttctatgtgacaattttgtacaaatttgttattttccatttttatttcaaaatatacattcaaacttaaaatt

SEQ ID NO: 4766 - DNA, 549 bp, Homo sapiens
agtgcagacgcggctcctagcggatgggtgctattgtgaggcggttgtagaagagtttcgtgagtgctcgcagctcatacctgtggctgtgtatccgtggccacagctggttggcgtcgccttgaaatcccaggccgtgaggagttagcgagccctgctcacactcggcgctctggttttcgttaataaaggtatccatggagaacactgaaaactcagtggattcaaaatccattaaaaatttggaaccaaagatcatacatggaagcgaatcaatggactctggaatatccctggacaacagttataaaatggattatcctgagatgggtttatgtataataattaataataagaattttcataaaagcactggaatgacatctcggtctggtacagatgtcgatgcagcaaacctcagggaaacattcagaaacttgaaatatgaagtcaggaataaaaatgatcttacacgtgaagaaattgtggaattgatgcgtgatgtttctaaagaagatcacagcaaaaggagcagttttgtttgtgtgc

SEQ ID NO: 4767 - DNA, 2540 bp, Homo sapiens
aggggcgggcgggaggcggggctggcgctggagcacatctcccggcggcgggccgcggaagcagtgcagacgcggctcctagcggatgggtgctattgtgaggcggttgtagaagttaataaaggtatccatggagaacactgaaaactcagtggattcaaaatccattaaaaatttggaaccaaagatcatacatggaagcgaatcaatggactctggaatatccctggacaacagttataaaatggattatcctgagatgggtttatgtataataattaataataagaattttcataaaagcactggaatgacatctcggtctggtacagatgtcgatgcagcaaacctcagggaaacattcagaaacttgaaatatgaagtcaggaataaaaatgatcttacacgtgaagaaattgtggaattgatgcgtgatgtttctaaagaagatcacagcaaaaggagcagttttgtttgtgtgcttctgagccatggtgaagaaggaataatttttggaacaaatggacctgttgacctgaaaaaaataacaaactttttcagaggggatcgttgtagaagtctaactggaaaacccaaacttttcattattcaggcctgccgtggtacagaactggactgtggcattgagacagacagtggtgttgatgatgacatggcgtgtcataaaataccagtggaggccgacttcttgtatgcatactccacagcacctggttattattcttggcgaaattcaaaggatggctcctggttcatccagtcgctttgtgccatgctgaaacagtatgccgacaagcttgaatttatgcacattcttacccgggttaaccgaaaggtggcaacagaatttgagtccttttcctttgacgctacttttcatgcaaagaaacagattccatgtattgtttccatgctcacaaaagaactctatttttatcactaaagaaatggttggttggtggttttttttagtttgtatgccaagtgagaagatggtatatttggtactgtatttccctctcattttgacctactctcatgctgcagagggtactttaagacatactccttccatcaaatagaaccactatgaagctacctcaaacttccagtcaggtagttgcaattgaattaaattaggaataaataaaaatggatactggtgcagtcattatgagaggcaatgattgttaatttacagctttcatgattagcaagttacagtgatgctgtgctatgaattttcaagtaattgtgaaaaagttaaacattgaagtaatgaatttttatgatattccccccacttaagactgtgtattctagttttgtcaaactgtagaaatgatgatgtggaagaacttaggcatctgtgggcatggtcaaaggctcaaacctttattttagaattgatatacacggatgacttaactgcatttttagaccatttatctgggattatggttttgtgatgtttgtcctgaacacttttgttgtaaaaaaataataataatgtttaatattgagaaagaaactaatattttatgtgagagaaagtgtgagcaaactaacttgacttttaaggctaaaacttaacattcatagaggggtggagttttaactgtaaggtgctacaatgcccctggatctaccagcataaatatcttctgatttgtccctatgcatatcagttgagcttcatataccagcaatatatctgaagagctattatataaaaaccccaaactgttgattattagccaggtaatgtgaataaattctataggaacatatgaaaatacaacttaaataataaacagtggaatataaggaaagcaataaatgaatgggctgagctgcctgtaacttgagagtagatggtttgagcctgagcagagacatgactcagcctgttccatgaaggcagagccatggaccacgcaggaagggcctacagcccatttctccatacgcactggtatgtgtggatgatgctgccagggcgccatcgccaagtaagaaagtgaagcaaatcagaaacttgtgaagtggaaatgttctaaaggtggtgaggcaataaaaatcatagtactctttgtagcaaaattcttaagtatgttattttctgttgaagtttacaatcaaaggaaaatagtaatgttttatactgtttactgaaagaaaaagacctatgagcacataggactctagacggcatccagccggaggccagagctgagccctcagcccgggaggcaggctccaggcctcagcaggtgcggagccgtcactgcaccaagtctcactggctgtcagtatgacatttcacgggagatttcttgttgctcaaaaaatgagctcgcatttgtcaatgacagtttcttttttcttactagacctgtaacttttgtaaatacacatagcatgtaatggtatcttaaagtgtgtttctatgtgacaattttgtacaaatttgttattttccatttttatttcaaaatatacattcaaacttaaaatta

SEQ ID NO: 4768 - DNA, 1340 bp, Homo sapiens
cagaagcctttgtgatctcacctgttggaatgcactaatgttttctgagccccttaaatatcttgtctacattcttttaagaagctcttcaccaactgtcagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgactttgacatcacagggatgaaggagctacttgagggtctggactatagtgtagatgtagaagagaatctgacagccagggatatggagtcagcgctgagggcatttgctaccagaccagagcacaagtcctctgacagcacattcttggtactcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtgcaaaccgtggggaactgtgggtcagagactctccagcatccttggaagtggcctcttcacagtcatctgagaacctagaggaagatgctgtttacaagacccacgtggagaaggacttcattgctttctgctcttcaacgccacacaacgtgtcctggagagacagcacaatgggctctatcttcatcacacaactcatcacatgcttccagaaatattcttggtgctgccacctagaggaagtatttcggaaggtacagcaatcatttgaaactccaagggccaaagctcaaatgcccaccatagaacgactgtccatgacaagatatttctacctctttcctggcaattgaaaatggaagccacaagcagcccagccctccttaatcaacttcaaggagcaccttcattagtacagcttgcatatttaacattttgtatttcaataaaagtgaagacaaacg

SEQ ID NO: 4769 - DNA, 500 bp, Homo sapiens
aaaagaagttgagaaccagagaaaccgacctaaggggattctcccatttggcccgtcctaccctaaagtcaccacctgctgcttttctggagcgcttaccagtgaccaagaggaacagaacacagagcagcctggcagtgtccaagcaacaagcctccgctcctccttcctgcaccctggggctcctgaaactcacatgggtaaaaaagatacagtaaagacataaataccacatttgacaaatggaaaaaaaggagtgtccagaaaagagtagcagcagtgaggaagagctgccgagacgggacagtggatccagtaggaacatagatgcatccaaactcattagactacaaggatcacggaaactgttggttgacaatagcatacgggaactgcaatacacaaaaactggaattttttttcaggctgaggcctgtgtgacaaatgatacgtaagggacatctatttgttgggaaaaaattaaagatttggaattttgc

SEQ ID NO: 4770 - DNA, 3934 bp, Homo sapiens
ccccgtgcgcctcttgcccgcagaccctgaggacacggccatgccgggccgggcggaggcgggggaggccgaggaggaggccggggccggctcggggtctgaggcggaggaggacgcgctgtgggagcgaatcgagggcgtccggcatcggctggctcgcgccctgaacccggccaagctcacgccgtatctgcgccagtgccgggtcatcgacgagcaggacgaggaggaggtgctgagcacctaccgcttcccgtgccgcgtcaaccgcaccgggcgcctgatggacatcttgcgctgccgtggcaagaggggctatgaggccttcctggaagccctggagttctactaccccgaacacttcacgctgctcacgggccaggaacccgcccagcgctgctccatgatcctcgatgaggaggggcctgagggcctgacccaattcttgatgacagaggtgcgacggctgcgggaagctcgcaagagccagctgcagcgggagcagcaactgcaggcccggggccgggtgctcgaggaggagcgggcagggctggagcagcggctgcgggaccagcagcaggctcaggagcgctgtcaacggctgcgggaggactgggaggcgggcagcctggagctgctgcggctcaaggatgagaactacatgatcgccatgcgcctggcacagctcagtgaggagaagaactcggctgtacttcgcagccgtgacctgcagctggcggtggatcagctcaagctcaaagtgagtcggctggaggaagagtgtgcactgcttcgaagggccaggggcccgccccctggggcagaggagaaggagaaggagaaggagaaggagaaggagccagacaatgtggaccttgtctctgagctgcgtgctgagaaccagcggctgacggcgtcactgcgggagttgcaggagggcctgcagcaggaggcgagccggccgggggccccgggctccgagcgcatcctgctggacatcctagagcatgactggcgggaggcgcaggacagcaggcaggagctgtgccagaagctgcatgccgtgcagggggagctgcagtgggccgaggagctgcgcgaccagtacctgcaggagatggaagacctgcggctcaagcaccgcacgctgcagaaggactgtgacctgtacaagcaccgcatggccactgtcctggcccaactggaggagattgagaaggagcgagaccaggccatccagagccgtgaccggatccagttgcagtactcacagagcctcatcgagaaggaccagtaccgcaagcaggtgcggggcctggaggcggagcgggatgagctgctgacaacgctcaccagcctggagggcaccaaggctctgctggaggttcagctgcagcgggcccagggtggcacctgcctcaaggcctgtgcctcctcccattccctgtgctccaacctcagcagcacttggagcctgagcgagttcccctcccctctgggaggcccagaagcaactggggaggcagctgtcatggggggacctgagcctcacaactcggaggaagccacagacagtgaaaaggagatcaatcggctctccatcctgcccttcccccccagtgccggctccatcctccgccggcagcgtgaggaagaccccgcaccccctaagagatccttcagcagcatgtcagacatcacagggagtgtgacacttaagccctggtcccctggcctctcttcgtcctcatcctctgacagcgtgtggcctttgggaaagccggaaggcctcctggctcggggctgtggcctggacttcctcaacaggtctctggctattcgggtgtctggccggagccccccagggggcccagagccgcaggacaagggaccagatggactgtcgttttatggggacagatggtctggggctgtggtgcgcagggtgctgtctgggcctgggtccgccaggatggaaccaagagagcaaagggtggaagctgctggtctggagggggcgtgcctggaagccgaggcccagcagagaaccttgctctggaatcaggggtccacactcccctccctgatggactcgaaggcctgccagtccttccacgaggccctagaagcctgggcaaagggaccaggtgccgagcccttctacattcgtgccaacctcaccttgcctgagagggcagatccccatgccctttgcgtgaaagcccaagagatccttcgactggtggactcggcatacaagcggaggcaggaatggttctgcacccgggttgaccccctcactctgcgggacctggaccggggcaccgtgcccaattatcagagagcccagcagctcctagaagttcaggagaaatgcctgccctccagccggcaccgaggcccccgcagtaatctgaagaagagagccctggaccagctgcggctggtgaggcccaagcccgtgggggcgcctgcaggggactccccggatcagctgctgctggagccctgtgcagagccggagcggagcctcagaccctacagtttggtgcggccgctactggtgtctgccctgcggcccgtggtgctgttgcctgagtgcctggcgccccggctcatccgtaacctgctagacctgcccagctcccggctggacttccaagtgtgcccagcggaaagcctctctggggaggaactgtgcccatcctcagcgcctggagcccccaaggctcagcctgccacccctgggctaggcagcaggatccgggccatccaggagtctgttgggaagaagcactgcctgctggagctgggtgctcggggtgtgcgggagctggtgcagaacgagatctaccccatcgtcatccacgtggaggtgactgagaagaatgtccgggaagtcaggggtctgctgggccggccgggctggcgggactcagagctgctgcggcagtgccgtggctcagagcaggtgctctgggggctgccctgctcctgggtgcaggtgcccgcccatgagtggggacacgcagaggagctggccaaggtggtgcgcggccgcatcctgcaggagcaggcccgcctcgtgtgggtggagtgcggcagcagcagaggctgccccagcagcagtgaggcctgaggctcatctgatacctgcaccttctccccaagccagcgtggaccctggtgtctatggtgaagctgggccctcccaccctgagccttcctagacccttggactctcagatgcagggcccttggctctggcctctcacccccaaggctgtctctggccctgccgagcctatgggagtcccgggacagagtgcccactcccctctacttgctgctctgggcctccccacctttcctggggtctccacattcccactagtgggtcttatgtgtgtctgtgtcttctccttaaacactcgccctggagtctgttctcacacctgtgcgcaggtttgcacactcaagttctcatgggcaggctcaggtctgtcccgctgccctgggcacgaggtctcctgaggacctgggcctgttctgctcctaggagacctgagcccgttaccgcgtgactcccaccatccagctcgcgctcctcgtggattcagccatgcatggactggggtgttccctggcccatggtcacctgtgcccctcgtgtctcctcacatgggtgtctgtggttctctcctgtgtaaatgtcacgccccacccctgtttcatgtgggcactaacacgtgtgcgttcctggcgggcacactcaggaccgtgcctcacagggcccactccctgcctatgcctccctcttggggggccgaggagggcggctgctctgtcatgagaatgtacggcccgtggatgattaacgggcctttttcacttagaagctgcacattatggagcattaaacacttttgtcata

SEQ ID NO: 4771 - DNA, 4113 bp, Homo sapiens
ggcgtgcagacggacgcgcggggtggccgggggccggacgcacgacccggggcgggcggcaatgtggggaggcccgggcagcccaggaggctgcggggacgggggcggagccgggggcgccacgggcaccgcccccctgcgccggcggagccgccgcccgagtgcggacccgggagcccgaggcgactgtagcgtgcgggaccctgaggacacggccatgccgggccgggcggaggcgggggaggccgaggaggaggccggggccggctcggggtctgaggcggaggaggacgcgctgtgggagcgaatcgagggcgtccggcatcggctggctcgcgccctgaacccggccaagctcacgccgtatctgcgccagtgccgggtcatcgacgagcaggacgaggaggaggtgctgagcacctaccgcttcccgtgccgcgtcaaccgcaccgggcgcctgatggacatcttgcgctgccgtggcaagaggggctatgaggccttcctggaagccctggagttctactaccccgaacacttcacgctgctcacgggccaggaacccgcccagcgctgctccatgatcctcgatgaggaggggcctgagggcctgacccaattcttgatgacagaggtgcgacggctgcgggaagctcgcaagagccagctgcagcgggagcagcaactgcaggcccggggccgggtgctcgaggaggagcgggcagggctggagcagcggctgcgggaccagcagcaggctcaggagcgctgtcaacggctgcgggaggactgggaggcgggcagcctggagctgctgcggctcaaggatgagaactacatgatcgccatgcgcctggcacagctcagtgaggagaagaactcggctgtacttcgcagccgtgacctgcagctggcggtggatcagctcaagctcaaagtgagtcggctggaggaagagtgtgcactgcttcgaagggccaggggcccgccccctggggcagaggagaaggagaaggagaaggagaaggagaaggagccagacaatgtggaccttgtctctgagctgcgtgctgagaaccagcggctgacggcgtcactgcgggagttgcaggagggcctgcagcaggaggcgagccggccgggggccccgggctccgagcgcatcctgctggacatcctagagcatgactggcgggaggcgcaggacagcaggcaggagctgtgccagaagctgcatgccgtgcagggggagctgcagtgggccgaggagctgcgcgaccagtacctgcaggagatggaagacctgcggctcaagcaccgcacgctgcagaaggactgtgacctgtacaagcaccgcatggccactgtcctggcccaactggaggagattgagaaggagcgagaccaggccatccagagccgtgaccggatccagttgcagtactcacagagcctcatcgagaaggaccagtaccgcaagcaggtgcggggcctggaggcggagcgggatgagctgctgacaacgctcaccagcctggagggcaccaaggctctgctggaggttcagctgcagcgggcccagggtggcacctgcctcaaggcctgtgcctcctcccattccctgtgctccaacctcagcagcacttggagcctgagcgagttcccctcccctctgggaggcccagaagcaactggggaggcagctgtcatggggggacctgagcctcacaactcggaggaagccacagacagtgaaaaggagatcaatcggctctccatcctgcccttcccccccagtgccggctccatcctccgccggcagcgtgaggaagaccccgcaccccctaagagatccttcagcagcatgtcagacatcacagggagtgtgacacttaagccctggtcccctggcctctcttcgtcctcatcctctgacagcgtgtggcctttgggaaagccggaaggcctcctggctcggggctgtggcctggacttcctcaacaggtctctggctattcgggtgtctggccggagccccccagggggcccagagccgcaggacaagggaccagatggactgtcgttttatggggacagatggtctggggctgtggtgcgcagggtgctgtctgggcctgggtccgccaggatggaaccaagagagcaaagggtggaagctgctggtctggagggggcgtgcctggaagccgaggcccagcagagaaccttgctctggaatcaggggtccacactcccctccctgatggactcgaaggcctgccagtccttccacgaggccctagaagcctgggcaaagggaccaggtgccgagcccttctacattcgtgccaacctcaccttgcctgagagggcagatccccatgccctttgcgtgaaagcccaagagatccttcgactggtggactcggcatacaagcggaggcaggaatggttctgcacccgggttgaccccctcactctgcgggacctggaccggggcaccgtgcccaattatcagagagcccagcagctcctagaagttcaggagaaatgcctgccctccagccggcaccgaggcccccgcagtaatctgaagaagagagccctggaccagctgcggctggtgaggcccaagcccgtgggggcgcctgcaggggactccccggatcagctgctgctggagccctgtgcagagccggagcggagcctcagaccctacagtttggtgcggccgctactggtgtctgccctgcggcccgtggtgctgttgcctgagtgcctggcgccccggctcatccgtaacctgctagacctgcccagctcccggctggacttccaagtgtgcccagcggaaagcctctctggggaggaactgtgcccatcctcagcgcctggagcccccaaggctcagcctgccacccctgggctaggcagcaggatccgggccatccaggagtctgttgggaagaagcactgcctgctggagctgggtgctcggggtgtgcgggagctggtgcagaacgagatctaccccatcgtcatccacgtggaggtgactgagaagaatgtccgggaagtcaggggtctgctgggccggccgggctggcgggactcagagctgctgcggcagtgccgtggctcagagcaggtgctctgggggctgccctgctcctgggtgcaggtgcccgcccatgagtggggacacgcagaggagctggccaaggtggtgcgcggccgcatcctgcaggagcaggcccgcctcgtgtgggtggagtgcggcagcagcagaggctgccccagcagcagtgaggcctgaggctcatctgatacctgcaccttctccccaagccagcgtggaccctggtgtctatggtgaagctgggccctcccaccctgagccttcctagacccttggactctcagatgcagggcccttggctctggcctctcacccccaaggctgtctctggccctgccgagcctatgggagtcccgggacagagtgcccactcccctctacttgctgctctgggcctccccacctttcctggggtctccacattcccactagtgggtcttatgtgtgtctgtgtcttctccttaaacactcgccctggagtctgttctcacacctgtgcgcaggtttgcacactcaagttctcatgggcaggctcaggtctgtcccgctgccctgggcacgaggtctcctgaggacctgggcctgttctgctcctaggagacctgagcccgttaccgcgtgactcccaccatccagctcgcgctcctcgtggattcagccatgcatggactggggtgttccctggcccatggtcacctgtgcccctcgtgtctcctcacatgggtgtctgtggttctctcctgtgtaaatgtcacgccccacccctgtttcatgtgggcactaacacgtgtgcgttcctggcgggcacactcaggaccgtgcctcacagggcccactccctgcctatgcctccctcttggggggccgaggagggcggctgctctgtcatgagaatgtacggcccgtggatgattaacgggcctttttcacttagaagctgcacattatggagcattaaacacttttgtcataga

SEQ ID NO: 4772 - DNA, 3127 bp, Homo sapiens
gcacttggctggggtgtgggtctgggggcaagatcttgggcccagggtctacctgtatgggccaggctcagccccttgaagacccctagtcatgggggtgggagtaggtcttgggaatggcctccgtctgctgccctggatggaggcgagccggccgggggccccgggctccgagcgcatcctgctggacatcctagagcatgactggcgggaggcgcaggacagcaggcaggagctgtgccagaagctgcatgccgtgcagggggagctgcagtgggccgaggagctgcgcgaccagtacctgcaggagatggaagacctgcggctcaagcaccgcacgctgcagaaggactgtgacctgtacaagcaccgcatggccactgtcctggcccaactggaggagattgagaaggagcgagaccaggccatccagagccgtgaccggatccagttgcagtactcacagagcctcatcgagaaggaccagtaccgcaagcaggtgcggggcctggaggcggagcgggatgagctgctgacaacgctcaccagcctggagggcaccaaggctctgctggaggttcagctgcagcgggcccagggtggcacctgcctcaaggcctgtgcctcctcccattccctgtgctccaacctcagcagcacttggagcctgagcgagttcccctcccctctgggaggcccagaagcaactggggaggcagctgtcatggggggacctgagcctcacaactcggaggaagccacagacagtgaaaaggagatcaatcggctctccatcctgcccttcccccccagtgccggctccatcctccgccggcagcgtgaggaagaccccgcaccccctaagagatccttcagcagcatgtcagacatcacagggagtgtgacacttaagccctggtcccctggcctctcttcgtcctcatcctctgacagcgtgtggcctttgggaaagccggaaggcctcctggctcggggctgtggcctggacttcctcaacaggtctctggctattcgggtgtctggccggagccccccagggggcccagagccgcaggacaagggaccagatggactgtcgttttatggggacagatggtctggggctgtggtgcgcagggtgctgtctgggcctgggtccgccaggatggaaccaagagagcaaagggtggaagctgctggtctggagggggcgtgcctggaagccgaggcccagcagagaaccttgctctggaatcaggggtccacactcccctccctgatggactcgaaggcctgccagtccttccacgaggccctagaagcctgggcaaagggaccaggtgccgagcccttctacattcgtgccaacctcaccttgcctgagagggcagatccccatgccctttgcgtgaaagcccaagagatccttcgactggtggactcggcatacaagcggaggcaggaatggttctgcacccgggttgaccccctcactctgcgggacctggaccggggcaccgtgcccaattatcagagagcccagcagctcctagaagttcaggagaaatgcctgccctccagccggcaccgaggcccccgcagtaatctgaagaagagagccctggaccagctgcggctggtgaggcccaagcccgtgggggcgcctgcaggggactccccggatcagctgctgctggagccctgtgcagagccggagcggagcctcagaccctacagtttggtgcggccgctactggtgtctgccctgcggcccgtggtgctgttgcctgagtgcctggcgccccggctcatccgtaacctgctagacctgcccagctcccggctggacttccaagtgtgcccagcggaaagcctctctggggaggaactgtgcccatcctcagcgcctggagcccccaaggctcagcctgccacccctgggctaggcagcaggatccgggccatccaggagtctgttgggaagaagcactgcctgctggagctgggtgctcggggtgtgcgggagctggtgcagaacgagatctaccccatcgtcatccacgtggaggtgactgagaagaatgtccgggaagtcaggggtctgctgggccggccgggctggcgggactcagagctgctgcggcagtgccgtggctcagagcaggtgctctgggggctgccctgctcctgggtgcaggtgcccgcccatgagtggggacacgcagaggagctggccaaggtggtgcgcggccgcatcctgcaggagcaggcccgcctcgtgtgggtggagtgcggcagcagcagaggctgccccagcagcagtgaggcctgaggctcatctgatacctgcaccttctccccaagccagcgtggaccctggtgtctatggtgaagctgggccctcccaccctgagccttcctagacccttggactctcagatgcagggcccttggctctggcctctcacccccaaggctgtctctggccctgccgagcctatgggagtcccgggacagagtgcccactcccctctacttgctgctctgggcctccccacctttcctggggtctccacattcccactagtgggtcttatgtgtgtctgtgtcttctccttaaacactcgccctggagtctgttctcacacctgtgcgcaggtttgcacactcaagttctcatgggcaggctcaggtctgtcccgctgccctgggcacgaggtctcctgaggacctgggcctgttctgctcctaggagacctgagcccgttaccgcgtgactcccaccatccagctcgcgctcctcgtggattcagccatgcatggactggggtgttccctggcccatggtcacctgtgcccctcgtgtctcctcacatgggtgtctgtggttctctcctgtgtaaatgtcacgccccacccctgtttcatgtgggcactaacacgtgtgcgttcctggcgggcacactcaggaccgtgcctcacagggcccactccctgcctatgcctccctcttggggggccgaggagggcggctgctctgtcatgagaatgtacggcccgtggatgattaacgggcctttttcacttagaagctgcacattatggagcattaaacacttttgtcata

SEQ ID NO: 4773 - DNA, 2140 bp, Homo sapiens
agtgcactcatagtccagcaaactggccatgcacgtctgctcccagcttggtggtcacaccacagctgcccaccccccataccaggccaacttctggctgcacactccgaactggtgattggttaggggcatgggattttgtttgaagctgtgaagacagccacggtcacactgtggcagctctgtagcccttcatagtttagaggcctctgcccacttgctgtcttgtttgattcttgcaacacctttgggaggcaaatgatggggccaggggattgactgggcccattttactgatgaggaaactgaggcccagaggaggtggatcagctcaagctcaaagtgagtcggctggaggaagagtgtgcactgcttcgaagggccaggggcccgccccctggggcagaggagaaggagaaggagaaggagaaggagaaggagccagacaatgtggaccttgtctctgagctgcgtgctgagaaccagcggctgacggcgtcactgcgggagttgcaggagggcctgcagcaggaggcgagccggccgggggccccgggctccgagcgcatcctgctggacatcctagagcatgactggcgggaggcgcaggacagcaggcaggagctgtgccagaagctgcatgccgtgcagggggagctgcagtgggccgaggagctgcgcgaccagtacctgcaggagatggaagacctgcggctcaagcaccgcacgctgcagaaggactgtgacctgtacaagcaccgcatggccactgtcctggcccaactggaggagattgagaaggagcgagaccaggccatccagagccgtgaccggatccagttgcagtactcacagagcctcatcgagaaggaccagtaccgcaagcaggtgcggggcctggaggcggagcgggatgagctgctgacaacgctcaccagcctggagggcaccaaggctctgctggaggttcagctgcagcgggcccagggtggcacctgcctcaaggcctgtgcctcctcccattccctgtgctccaacctcagcagcacttggagcctgagcgagttcccctcccctctgggaggcccagaagcaactggggaggcagctgtcatggggggacctgagcctcacaactcggaggaagccacagacagtgaaaaggagatcaatcggctctccatcctgcccttcccccccagtgccggctccatcctccgccggcagcgtgaggaagaccccgcaccccctaagagatccttcagcagcatgtcagacatcacagggagtgtgacacttaagccctggtcccctggcctctcttcgtcctcatcctctgacagcgtgtggcctttgggaaagccggaaggcctcctggctcggggctgtggcctggacttcctcaacaggtctctggctattcgggtgtctggccggagccccccagggggcccagagccgcaggacaagggaccagatggactgtcgttttatggggacagatggtctggggctgtggtgcgcagggtgctgtctgggcctgggtccgccaggatggaaccaagagagcaaagggtggaagctgctggtctggagggggcgtgcctggaagccgaggcccagcagagaaccttgctctggaatcaggggtccacactcccctccctgatggactcgaaggcctgccagtccttccacgaggccctagaagcctgggcaaagggaccaggtgccgagcccttctacattcgtgccaacctcaccttgcctgagagggcagatccccatgccctttgcgtgaaagcccaagagatccttcgactggtggactcggcatacaagcggaggcaggaatggttctgcacccgggttgaccccctcactctgcgggacctggaccggggcaccgtgcccaattatcagagagcccagcagctcctagaagttcaggagaaatgcctgccctccagccggcaccgaggcccccgcagtaatctgaagaagagagccctggaccagctgcggctggtgaggcccaagcccgtgggggcgcctgcaggggactccccggatcagctgctgctggagccctgtgcagagccggagcggagcctcagaccctacagtttggtgcggccgc

SEQ ID NO: 4774 - DNA, 584 bp, Homo sapiens
gactcctgcccgcgccgcccgcagccccctcccggccctgcagcccctgggcgggcggcgcccctcggaggacggctccgggcccggggggacggagggcctggtcgcctggaggaagccggaggcctgcgtggaggaggcgccccgcgcagctggctggcggagcatgagcgccccaggaggagagagaatttgagaggaacacgaggaacccccaggacccagctggctcacaaccgcatcccaagcactgcaagtccagatgcaacgggagcctggctcaagggacgacaagatccagccggaaagtgtagaagtcacaccccaatggcgggatagcagcccctgtgtgtgagcacccctccatgccaggaggagggccagagatggatgactacatggagacgctgaaggatgaagaggacgccttgtgggagaatgtggagtgtaaccggcacatgctcagccgctatatcaaccctgccaagctcacgccctacctgcgtcagtgtaaggtcattgatgagcaggatgaagatgaagtgcttaatgcccctatgctgccatccaagatcaaccgagca

SEQ ID NO: 4775 - DNA, 4366 bp, Homo sapiens
agtctcatttcctgtcgggttttgcatttccctcccccgcccctcccagcctatgacatactttctctccttttttctctcctgcctcctctggccttcggactcctgcccgcgccgcccgcagccccctcccggccctgcagcccctgggcgggcggcgcccctcggaggacggctccgggcccggggggacggagggcctggtcgcctggaggaagccggaggcctgcgtggaggaggcgccccgcgcagctggctggcggagcatgagcgccccagatcccaagcactgcaagtccagatgcaacgggagcctggctcaagggacgacaagatccagccggaaagtgtagaagtcacaccccaatggcgggatagcagcccctgtgtgtgagcacccctccatgccaggaggagggccagagatggatgactacatggagacgctgaaggatgaagaggacgccttgtgggagaatgtggagtgtaaccggcacatgctcagccgctatatcaaccctgccaagctcacgccctacctgcgtcagtgtaaggtcattgatgagcaggatgaagatgaagtgcttaatgcccctatgctgccatccaagatcaaccgagcaggccggctgttggacattctacataccaaggggcaaaggggctatgtggtcttcttggagagcctagaattttattacccagaactgtacaaactggtgactgggaaagagcccactcggagattctccaccattgtggtggaggaaggccacgagggcctcacgcacttcctgatgaacgaggtcatcaagctgcagcagcagatgaaggccaaggacctgcaacgctgcgagctgctggccaggttgcggcagctggaggatgagaagaagcagatgacgctgacgcgcgtggagctgctaaccttccaggagcggtactacaagatgaaggaagagcgggacagctacaatgacgagctggtcaaggtgaaggacgacaactacaacttagccatgcgctacgcacagctcagtgaggagaagaacatggcggtcatgaggagccgagacctccaactcgagatcgatcagctaaagcaccggttgaataagatggaggaggaatgtaagctggagagaaatcagtctctaaaactgaagaatgacattgaaaatcggcccaagaaggagcaggttctggaactggagcgggagaatgaaatgctgaagaccaaaaaccaggagctgcagtccatcatccaggccgggaagcgcagcctgccagactcagacaaggccatcctggacatcttggaacacgaccgcaaggaggccctggaggacaggcaggagctggtcaacaggatctacaacctgcaggaggaggcccgccaggcagaggagctgcgagacaagtacctggaggagaaggaggacctggagctcaagtgctcgaccctgggaaaggactgtgaaatgtacaagcaccgcatgaacacggtcatgctgcagctggaggaggtggagcgggagcgggaccaggccttccactcccgagatgaagctcagacacagtactcgcagtgcttaatcgaaaaggacaagtacaggaagcagatccgcgagctggaggagaagaacgacgagatgaggatcgagatggtgcggcgggaggcctgcatcgtcaacctggagagcaagctgcggcgcctctccaaggacagcaacaacctggaccagagtctgcccaggaacctgccagtaaccatcatctctcaggactttggggatgccagccccaggaccaatggtcaagaagctgacgattcttccacctcggaggagtcacctgaagacagcaagtacttcctgccctaccatccgccccagcgcaggatgaacctgaagggcatccagctgcagagagccaaatcccccatcagcctgaagcgaacatcagattttcaagccaaggggcacgaggaagaaggcacggacgccagccctagctcctgcggatctctgcccatcaccaactccttcaccaagatgcagcccccccggagccgcagcagcatcatgtcaatcaccgccgagcccccgggaaacgactccatcgtcagacgctacaaggaggacgcgccccatcgcagcacagtcgaagaagacaatgacagcggcgggtttgacgccttagatctggatgatgacagtcacgaacgctactccttcggaccctcctccatccactcctcctcctcctcccaccaatccgagggcctggatgcctacgacctggagcaggtcaacctcatgttcaggaagttctctctggaaagacccttccggccttcggtcacctctgtggggcacgtgcggggcccagggccctcggtgcagcacacgacgctgaatggcgacagcctcacctcccagctcaccctgctggggggcaacgcgcgagggagcttcgtgcactcggtcaagcctggctctctggccgagaaagccggcctccgtgagggccaccagctgctgctgctagaaggctgcatccgaggcgagaggcagagtgtcccgttggacacatgcaccaaagaggaagcccactggaccatccagaggtgcagcggccccgtcacgctgcactacaaggtcaaccacgaagggtaccggaagctggtgaaggacatggaggacggcctgatcacatcgggggactcgttctacatccggctgaacctgaacatctccagccagctggacgcctgcaccatgtccctgaagtgtgacgatgttgtgcacgtccgtgacaccatgtaccaggacaggcacgagtggctgtgcgcgcgggtcgaccctttcacagaccatgacctggatatgggcaccatacccagctacagccgagcccagcagctcctcctggtgaaactgcagcgcctgatgcaccgaggcagccgggaggaggtagacggcacccaccacaccctgcgggcactccggaacaccctgcagccagaagaagcgctttcaacaagcgacccccgggtcagcccccgtctctcgcgagcaagcttcctttttggccagctccttcagttcgtcagcaggtccgagaacaagtataagcggatgaacagcaacgagcgggtccgcatcatctcggggagtccgctagggagcctggcccggtcctcgctggacgccaccaagctcttgactgagaagcaggaagagctggaccctgagagcgagctgggcaagaacctcagcctcatcccctacagcctggtacgcgccttctactgcgagcgccgccggcccgtgctcttcacacccaccgtgctggccaagacgctggtgcagaggctgctcaactcgggaggtgccatggagttcaccatctgcaagtcagatatcgtcacaagagatgagttcctcagaaggcagaagacggagaccatcatctactcccgagagaagaaccccaacgcgttcgaatgcatcgcccctgccaacattgaagctgtggccgccaagaacaagcactgcctgctggaggctgggatcggctgcacaagagacttgatcaagtccaacatctaccccatcgtgctcttcatccgggtgtgtgagaagaacatcaagaggttcagaaagctgctgccccgacctgagacggaggaggagttcctgcgcgtgtgccggctgaaggagaaggagctggaggccctgccgtgcctgtacgccacggtggaacctgacatgtggggcagcgtagaggagctgctccgcgttgtcaaggacaagatcggcgaggagcagcgcaagaccatctgggtggacgaggaccagctgtgaggcgggcgccctgggcagagagactctgtggcgcggggcatcctatgaggcaggcaccctgggcagagagatgcagtgggtgcggggggatcctgtggcccacagagctgccccagcagacgctccgccccacccggtgatggagccccggggggacagtcgtgcctggggaggagcagggtacagcccattcccccagccctggctgacctggcctagcagtttggccctgctggccttagcagggagacaggggagcaaagaacgccaagccggaggcccgaggccagccggcctctcgagagccagagcagcagttgaatgtaatgctggggacaggcatgctgccgccagtagggcggggacccggacagccaggtgactaccagtcctggggacacactcaccataaacacatccccaggcaggacagatcggggaaggggtgtgtaccaggctatgatttctcttgcattaaaatgtattattatttcttt

SEQ ID NO: 4776 - DNA, 4221 bp, Homo sapiens
ccacaaggaccccggatcagagagtgctccgagctgggttgccccactgtgcttgtatctgcactctccaacactaggcatcattgacatgttaaagcttagccaaatagaattgttctttgtcattctttttttaacttttacttattcattaggatgatttcataatatatttcctggtttagaggaaacaggaacaatggctaccgagagtactccctcagagatcatagaaagagaaagaaaaaagttgcttgaaatccttcaacatgatcctgattctatcttagacacgttaacttctcggaggctgatttctgaggaagagtatgagactctggagaatgttacagatctcctgaagaaaagtcggaagctgttaattttggtacagaaaaagggagaggcgacctgtcagcattttctcaagtgtttatttagtacttttccacagtcagctgccatttgcggcttaaggcatgaagttttaaaacatgagaatacagtacctcctcaatctatgggggcaagcagtaattcagaagatgctttttctcctggaataaaacagcctgaagcccctgagatcacagtgttcttcagtgagaaggaacacttggatttggaaacctctgagtttttcagggacaagaaaactagttatagggaaacagctttgtctgccaggaagaatgagaaggaatatgacacaccagaagtcacattatcatattcagttgagaaagttggatgtgaagttccagcaactattacatatataaaagatggacagagatatgaggagctagatgattctttatacttaggaaaagaggaatatctaggatctgttgacacccctgaagatgcagaagccactgtggaagaggaggtttatgatgacccagagcacgttggatatgatggtgaagaggacttcgagaattcagaaaccacagagttctctggtgaagaaccaagttatgagggatcagaaaccagcctttcattggaggaggaacaggagaaaagtatagaagaaagaaaaaaggtgtttaaagatgtcctgttatgtttgaacatggatagaagcagaaaggttctgccagattttgttaaacaattctccttagatcgaggatgtaagtggacccctgagagtccaggagacttagcctggaatttcctgatgaaagttcaagcacgagatgtgaccgctagggattcaatcctcagtcacaaggttctggatgaagatagcaaggaggatttgctggctggagtggagaatttggaaattcgagacatacaaaccattaatccccttgacgtgctttgtgccaccatgctgtgttcagatagctctttgcaacgccaagtcatgtcaaacatgtatcagtgccagtttgctcttcccctgctactgccagatgcagaaaacaacaaaagcatcttaatgctgggggccatgaaagacattgtgaagaagcagtcaacacagttttcaggggggcctacagaggatacagaaaagtttctgactctcatgaagatgcctgtcatctcttttgtgcgtctaggatactgtagcttctctaagtccagaatcctcaacacacttctcagccctgcccagttgaaattacacaaaatctttcttcatcaagatttgcctcttttggtgcttccccggcaaatctctgatggcctggttgagataacatggtgttttcctgatagcgatgatagaaaggaaaacccctttttccaaaagcctgttgctctggctaatctccgtggaaatctagaaagcttttggactcagtttggttttttgatggaagtttcttcagctgtgttttttttcactgactgtttaggtgagaaggaatgggacttgctaatgtttttaggagaggctgccattgaaagatgctactttgttctcagttcccaagccagggagagtgaagaggctcaaatttttcagaggatactgaacttgaagccagcacagctactgttttgggagaggggagatgctggggatagaaggaagaacatggagggccttcaagctgccctccaggaagtgatgttctcttcttgcctcagatgtgtgtctgtggaggatatggccgccctggccagggagctggggattcaggtagatgaagactttgaaaacactcagagaattcaagtttcctctggagaaaacatggctgggacagctgaaggtgagggtcagcaaagacacagtcagctaaaaagctcatctaaaagccaggctctaatgccaattcaagagcctgggactcaatgtgagctcagccagaatcttcagaatctctatggtaccccagtattcaggcctgttctagagaactcctggctctttccaaccagaattggaggtaactttaaccatgtttccttgaaagcctcctgggttatgggccgcccctttgggtcagagcagaggcctaagtggttccatcctttgccttttcagaatgcaggggcccagggccgaggtaaaagttttggtattcaatccttccatccccagatattttattcaggtgaaagattcatgaaattttccagagttgctcggggatgtcactcgaatggaacatttgggagactgccaagacccatttgtcagcatgtacaggcctgccctgagagaccacaaatgatgggaactcttgaaaggtctagggcagtagcctccaagataggtcactcctattccctggattcacagccagcaagagcagtagggaagccatggcctcagcaagcttgcaccagggtaacagagttaactgaagcaactggaaaactgataagaacatcccatattggaaagcctcaccctcagtcctttcaaccagcagcagccacacaaaaactaagacctgcttctcagcaaggagtccagatgaagacacaaggtggggcttcaaatccagctctccaaatagggtcccatcccatgtgcaagagctctcagttcaaatccgatcagtccaacccatccacagtcaaacactcccagcctaaacccttccattctgtgccctctcaacctaaatcctctcagacaaaatcctgtcagtcccagccctcccaaactaaaccttctccatgcaaatctactcagcctaagccaagccagccctggcctccccagtctaagccttctcagcccagaccccctcaacctaagtcatcctcaaccaatccttcacaagctaaggcacaccactcaaaagcagggcagaagaggggagggaagcattaaagagctaactccagagatctataaagcatatcctttacccaggccattcctatcatatagtaagcagaagagttgccatgaaagtaaaagactactgtcattagcatgtaaaacaaagaaagatatacatgactgaattggatatctttgtttgtttgtttgagacagagtttcactcttgttgcccaggctggagtgcaatggcacgatctcggctcaccgcaacctctgcttcctggcttaaagtgattctcctgcctcagcctctcgagtagctgggattacaggcatgcaccaccacacccagctaattttgtatttttagtagaggcagggtttctccatgttggtcaggctggtcttgaactcccgacctcaggtgatccgcccacctaggcctctcaaagtgttgggattacgtgtgtaagccacagtgcccagcccgaattggatatctttaagatatctgtaagtgttatatccctaaccaagaagaaaaatatgaaaataattaagactagaatcaagcagtagataattgaatccaatcttgggtattattagataatgtataacttgcacccagggaatgggggtctatgagacaaccccacttggagaagaatggggttagggtctctaattgcaaagtgactgtacaataggacgaaagttgcctctgtgtctgagaaagtatcttagttgttggctgctccagaggtatctttgtcaaaagcttctggttcaatatcagccactgagcagataaccctgcttatttggtgtggttaaatcaactagcttctgctaatagccccaatttgcttgaatgggaaaactctctcatttgacccttataggtagaaataatgaattaacaaccaataaaattaatcatttggcattaa

SEQ ID NO: 4777 - DNA, 1085 bp, Homo sapiens
attctttttttaacttttacttattcattaggatgatttcataatatatttcctggtttagaggaaacaggaacaatggctaccgagagtactccctcagagatcatagaaagagaaagaaaaaagttgcttgaaatccttcaacatgatcctgattctatcttagacacgttaacttctcggaggctgatttctgaggaagagtatgagactctggagaatgttacagatctcctgaagaaaagtcggaagctgttaattttggtacagaaaaagggagaggcgacctgtcagcattttctcaagtgtttatttagtacttttccacagtcagctgccatttgcggcttaaggccagaagttttaaaacatgagaatacagtacctcctcaatctatgggggcaagcagtaattcagaagatgctttttctcctggaataaaacagcctgaagcccctgagatcacagtgttcttcagtgagaaggaacacttggatttggaaacctctgagtttttcagggacaagaaaactagttatagggaaacagctttgtctgccaggaagaatgagaaggaatatgacacaccagaagtcacattatcatattcagttgagaaagttggatgtgaagttccagcaactattacatatataaaagatggacagagatatgaggagctagatgattctttatacttaggaaaagaggaatatctaggatctgttgacacccctgaagatgcagaagccactgtggaagaggaggtttatgatgacccagagcacgttggatatgatggtgaagaggacttcgagaattcagaaaccacagagttctctggtgaagaaccaagttatgagggatcagaaaccagcctttcattggaggaggaacaggagaaaagtatagaaggctggtctcgaactcatgggcttaagcgatcctcccacgttggcctcccaaagtgctgggattacaggcgtgagccaccctgcctggcctgaaaattctgcctcaaacatctcaaacatccatttatattttgtacaagaaagtaaataaaatttttctttttaacatt

SEQ ID NO: 4778 - DNA, 1555 bp, Homo sapiens
aggaacaatggctaccgagagtactccctcagagatcatagaaagagaaagaaaaaagttgcttgaaatccttcaacatgatcctgattctatcttagacacgttaacttctcggaggctgatttctgaggaagagtatgagactctggagaatgttacagatctcctgaagaaaagtcggaagctgttaattttggtacagaaaaagggagaggcgacctgtcagcattttctcaagtgtttatttagtacttttccacagtcagctgccatttgcggcttaaggcatgaagttttaaaacatgagaatacagtacctcctcaatctatgggggcaagcagtaattcagaagatgctttttctcctggaataaaacagcctgaagcccctgagatcacagtgttcttcagtgagaaggaacacttggatttggaaacctctgagtttttcagggacaagaaaactagttatagggaaacagctttgtctgccaggaagaatgagaaggaatatgacacaccagaagtcacattatcatattcagttgagaaagttggatgtgaagttccagcaactattacatatataaaagatggacagagatatgaggagctagatgattctttatacttaggaaaagaggaatatctaggatctgttgacacccctgaagatgcagaagccactgtggaagaggaggtttatgatgacccagagcacgttggatatgatggtgaagaggacttcgagaattcagaaaccacagagttctctggtgaagaaccaagttatgagggatcagaaaccagcctttcattggaggaggaacaggagaaaagtatagaagaaagaaaaaaggtgtttaaagatgtcctgttatgtttgaacatggatagaagcagaaaggttctgccagattttgttaaacaattctccttagatcgaggatgtaagtggacccctgagagtccaggagacttagcctggaatttcctgatgaaagttcaagcacgagatgtgaccgctagggattcaatcctcagtcacaaggttctggatgaagatagcaaggaggatttgctggctggagtggagaatttggaaattcgagacatacaaaccattaatccccttgacgtgctttgtgccaccatgctgtgttcagatagctctttgcaacgccaagtcatgtcaaacatgtatcagtgccagtttgctcttcccctgctactgccagatgcagaaaacaacaaaagcatcttaatgctgggggccatgaaagacattgtgaagaagcagtcaacacagttttcaggggggcctacagaggatacagaaaagtttctgactctcatgaagactttgaaaacactcagagaattcaagtttcctctggagaaaacatggctgggacagctgaaggtgagggtcagcaaagacacagtcagctaaaaagctcatctaaaagccaggctctaatgccaattcaagagcctgggactcaatgtgagctcagccagaatcttcagaatctctatggtaccccagtattca

SEQ ID NO: 4779 - DNA, 1890 bp, Homo sapiens
acagagcagcctggcagtgtccaagcaacaagcctccgctcctccttcctgcaccctggggctcctgaaactcacatgggtaaaaaagatacagtaaagacataaataccacatttgacaaatggaaaaaaaggagtgtccagaaaagagtagcagcagtgaggaagagctgccgagacgggtatacagggagctaccctgtgtttctgagaccctttgtgacatctcacattttttccaagaagatgatgagacagaggcagagccattattgttccgtgctgttcctgagtgtcaactatctgggggggacattcccaggagacatttgctcagaagagaatcaaatagtttcctcttatgcttctaaagtctgttttgagatcgaagaagattataaaaatcgtcagtttctggggcctgaaggaaatgtggatgttgagttgattgataagagcacaaacagatacagcgtttggttccccactgctggctggtatctgtggtcagccacaggcctcggcttcctggtaagggatgaggtcacagtgacgattgcgtttggttcctggagtcagcacctggccctggacctgcagcaccatgaacagtggctggtgggcggccccttgtttgatgtcactgcagagccagaggaggctgtcgccgaaatccacctcccccacttcatctccctccaagcaggtgaggtggacgtctcctggtttctcgttgcccattttaagaatgaagggatggtcctggagcatccagcccgggtggagcctttctatgctgtcctggaaagccccagcttctctctgatgggcatcctgctgcggatcgccagtgggactcgcctctccatccccatcacttccaacacattgatctattatcacccccaccccgaagatattaagttccacttgtaccttgtccccagcgacgccttgctaacaaaggcgatagatgatgaggaagatcgcttccatggtgtgcgcctgcagacttcgcccccaatggaacccctgaactttggttccagttatattgtgtctaattctgctaacctgaaagtaatgcccaaggagttgaaattgtcctacaggagccctggagaaattcagcacttctcaaaattctatgctgggcagatgaaggaacccattcaacttgagattactgaaaaaagacatgggactttggtgtgggatactgaggtgaagccagtggatctccagcttgtagctgcatcagcccctcctcctttctcagggttactgtggcaacgccaacctttgaatccccctcctgcgcgctgagcggctcgtaaccatggagaccgaagcaggtttcccgcgtccgcctcctcacccagagactgcagccccggcgcccagaccctttggacaaggagatccaagcgggccccacaatgctcagcgggtaaagagctcctccccactcctctcccgccagcagacgaaggaaacaccccgcagcctgcacatgctcagatggagctctgggcccgcgggttctactgcgcaggccctcacactcagcaaagggacttggacgcgaaagcgctggtggcgctcagccggctgggagttgtagctttctggctgctacagcaggagatacaggtggccaatgggtgagctggctggaggtaggaacaaggttaaggaagctgggatcttcgtgcagactggatcgtcactatagcaacaatgaaacatcgggaagggctagttctgctaggcagtctgccattttcattctttcatctttttttttaactcaaagcttactttgcaacaggcactgttctaggcactggggatacaatggaaaacaaaatagagcttctattttggcggg

SEQ ID NO: 4780 - DNA, 5215 bp, Homo sapiens
ctagttctcaacttcttttgaaataatgttcatagagaaggagggctgtctgagattcgagggaaacaagctctcaggacttccggtcgccatgatggctgtgggcggtaaacgcggttagtgcaagcatctgggccatcttcaatggtaaaaaagatacagtaaagacataaataccacatttgacaaatggaaaaaaaggagtgtccagaaaagagtagcagcagtgaggaagagctgccgagacgggtatacagggagctaccctgtgtttctgagaccctttgtgacatctcacattttttccaagaagatgatgagacagaggcagagccattattgttccgtgctgttcctgagtgtcaactatctgggggggacattcccaggagacatttgctcagaagagaatcaaatagtttcctcttatgcttctaaagtctgttttgagatcgaagaagattataaaaatcgtcagtttctggggcctgaaggaaatgtggatgttgagttgattgataagagcacaaacagatacagcgtttggttccccactgctggctggtatctgtggtcagccacaggcctcggcttcctggtaagggatgaggtcacagtgacgattgcgtttggttcctggagtcagcacctggccctggacctgcagcaccatgaacagtggctggtgggcggccccttgtttgatgtcactgcagagccagaggaggctgtcgccgaaatccacctcccccacttcatctccctccaaggtgaggtggacgtctcctggtttctcgttgcccattttaagaatgaagggatggtcctggagcatccagcccgggtggagcctttctatgctgtcctggaaagccccagcttctctctgatgggcatcctgctgcggatcgccagtgggactcgcctctccatccccatcacttccaacacattgatctattatcacccccaccccgaagatattaagttccacttgtaccttgtccccagcgacgccttgctaacaaaggcgatagatgatgaggaagatcgcttccatggtgtgcgcctgcagacttcgcccccaatggaacccctgaactttggttccagttatattgtgtctaattctgctaacctgaaagtaatgcccaaggagttgaaattgtcctacaggagccctggagaaattcagcacttctcaaaattctatgctgggcagatgaaggaacccattcaacttgagattactgaaaaaagacatgggactttggtgtgggatactgaggtgaagccagtggatctccagcttgtagctgcatcagcccctcctcctttctcaggtgcagcctttgtgaaggagaaccaccggcaactccaagccaggatgggggacctgaaaggggtgctcgatgatctccaagacaatgaggttcttactgagaatgagaaggagctggtggagcaggaaaagacacggcagagcaagaatgaggccttgctgagcatggtggagaagaaaggggacctggccctggacgtgctcttcagaagcattagtgaaagggacccttacctcgtgtcctatcttagacagcagaatttgtaaaatgagtcagttaggtagtctggaagagagaatccagcgttctcattggaaatggataaacagaaatgtgatcattgatttcagtgttcaagacagaagaagactgggtaacatctatcacacaggctttcaggacagacttgtaacctggcatgtacctattgactgtatcctcatgcattttcctcaagaatgtctgaagaaggtagtaatattccttttaaattttttccaaccattgcttgatatatcactattttatccattgacatgattcttgaagacccaggataaaggacatccggataggtgtgtttatgaaggatggggcctggaaaggcaacttttcctgattaatgtgaaaaataattcctatggacactccgtttgaagtatcaccttctcataactaaaagcagaaaagctaacaaaagcttctcagctgaggacactcaaggcatacatgatgacagtcttttttttttttgtatgttaggactttaacactttatctatggctactgttattagaacaatgtaaatgtatttgctgaaagagagcacaaaaatgggagaaaatgcaaacatgagcagaaaatattttcccactggtgtgtagcctgctacaaggagttgttgggttaaatgttcatggtcaactccaaggaatactgagatgaaatgtggtaaatcaactccacagaaccaccaaaaagaaaatgagggtaattcagcttattctgagacagacattcctggcaatgtaccatacaaaaaataagccaactctgacatttggattctaccatagactctgtcattttgtagccatttcagctgtcttttgattaatgttttcgtggcacacatatttccatccttttatgtttaatctgtttaaaacaagttcctagtagacaccatctggttgagtcagttttttttatggtgtattttgaacccattctgatagtctcttttaactggaagatttcaattacttacgttaatgtaattattaatatgttaggatttatcctcagtcagccagtttgttatgtcttttctattctactgttatcacatttgtaccacttaaagtggaatctaggcactttatcaccatttagatcctattaccttttctcatctaggatatagttatcttctacataatctttctgtatcttaaaacccatcaataaattattatatattttctacttttaatcactcagaagatttaaaaaactcatgagaagagtaatctgttatgtttttccagatatttaccatttctgttgctcttccttcattattttccaaatttcgttctgcaaatttccacttcctctgatagacgttttttagttcttttagagtggttctgataggtacagattctcttattttttgcttcctctgaggacatctttttctcaccttcattctcagtgatgttttttgcttgtagtatttttagttgacattgttttctgttcagcagtttccttttagcttccgtatttcctgatgagaaatctgcagtcattcaaattgttgtttccctgtatgtagtgtgtcatttttctgtcagatttcaaggtatttatctttagtttttagccatttcattatgttggggatgagtttccttgttttattccctttggaatttgctccaattcataaatttgcagttttatgtcttttaccaaacttagaggttttcagcctaatttctaaaaatactttttattagcctgattttcatctttataggaaatagtttaagtgatgacaagttccaatagcttatatgcccagaaggccttcaaaataagaattttgaaagaatacagaaaacaaacttttatatccttctcatgtcttctactgtaaaattcatatgctttgctactctaaacctagtttgaaatcaacagtcttgagaatagatgaaaattttgatgaatagtggaattcttttaaatggaaacctcttacatgtgattttccttgccatctagaaataaaccatagtatttatgttgaatcaatcaatattatattttgtttttttcctcctcttctgagactcttattgtggaaatgttagacttttatgttttcctaaatgtccctgatattctacttatttagaacatcttttcattttttccattattctgattgggtaattttaatttgtctattttcaaatttgctggagtgttcacctgttgttatctgtgtcgtcccactgagtgcattcaccaccttttaaattttggtcactgtatgtatcagttctaaaatttccattttgttctctatattttaaatttcttgccttatattctattttcctgcaaatgtgtcagcatttgcttgtttgagctttttttttttcaagacagggtctcaactctgttacccaggctggagtgcagtggtgcgatctcagctcactgcaacctctgcctcctggttcaagcgattattgtgcctcagcctccagagtagctgggattacaggcatgcaccaccacagcccagctaattttttgtatttttagtagagacagagttttgctatgttggccaggctggttttgaactcctggcctcaagtgatccacccacctcagcctcccaaagtgctgggattacaggccactacacctggcacatttgagtatttttttttttttttttttttttttgagatggagtctcgctctgtcatctaggctggagtgcagtggtgtgatctcagctcactgcagcctctgtctcccgggctcaagcgattctcttgcctcagcctcctgagtagctaggactacaggtgcatgccaacacgcccggctaatttttttttaaaaatatttttagtagagacagggtttcaccattttggccaggatggtcttgatctcctgacctcatgatccacccgcctcggccttccaaagtgctgggattacaggcatgagccaccgtgcctggcctcatttgagtatttttataatgtctcttttaaagtctttgtcagataatttcactgtacatgttattcagtgtttggtgtccactgagttgtcatttgccagacaagtggagatttttgcagctcatccttgtattctcagtagttccgatatgtaccctcgaaatgtgaatgttatcttatgagactctgttttatttgtatccaacagaagatgtttattatttatttggctttctgtgaactgaggtcttaatatcagctcattttaaaagtctttgcagtggtattcggatctatcctgtgtgtgcctatgagattgggtgcagtgtatcctgttagctccattctcagggcgtttgaatgtgaattaggaccagcgcaatgaatgctcaagttggggttgggcgttagaattcataaaagtctttatatgctcagattctgcagctccatcctcttcatgattgtgatcgtaaggacagtggaattttgcagttgtctataccttatcttgaagtagaactaaattgttacatttgaagaatgtacttcataaatttacaaaaataaaaaaataggttaatgttatt

SEQ ID NO: 4781 - DNA, 5263 bp, Homo sapiens
ggtaaaaaagatacagtaaagacataaataccacatttgacaaatggaaaaaaaggagtgtccagaaaagagtagcagcagtgaggaagagctgccgagacgggacagtggatccagtaggaacatagatgcatccaaactcattagactacaaggatcacggaaactgttggttgacaatagcatacgggaactgcaatacacaaaaactggaattttttttcaggctgaggcctgtgtgacaaatgatacggtatacagggagctaccctgtgtttctgagaccctttgtgacatctcacattttttccaagaagatgatgagacagaggcagagccattattgttccgtgctgttcctgagtgtcaactatctgggggggacattcccagtgtatcagaagagcaggaatcttcagagggacaagattcaggagacatttgctcagaagagaatcaaatagtttcctcttatgcttctaaagtctgttttgagatcgaagaagattataaaaatcgtcagtttctggggcctgaaggaaatgtggatgttgagttgattgataagagcacaaacagatacagcgtttggttccccactgctggctggtatctgtggtcagccacaggcctcggcttcctggtaagggatgaggtcacagtgacgattgcgtttggttcctggagtcagcacctggccctggacctgcagcaccatgaacagtggctggtgggcggccccttgtttgatgtcactgcagagccagaggaggctgtcgccgaaatccacctcccccacttcatctccctccaagcaggtgaggtggacgtctcctggtttctcgttgcccattttaagaatgaagggatggtcctggagcatccagcccgggtggagcctttctatgctgtcctggaaagccccagcttctctctgatgggcatcctgctgcggatcgccagtgggactcgcctctccatccccatcacttccaacacattgatctattatcacccccaccccgaagatattaagttccacttgtaccttgtccccagcgacgccttgctaacaaaggcgatagatgatgaggaagatcgcttccatggtgtgcgcctgcagacttcgcccccaatggaacccctgaactttggttccagttatattgtgtctaattctgctaacctgaaagtaatgcccaaggagttgaaattgtcctacaggagccctggagaaattcagcacttctcaaaattctatgctgggcagatgaaggaacccattcaacttgagattactgaaaaaagacatgggactttggtgtgggatactgaggtgaagccagtggatctccagcttgtagctgcatcagcccctcctcctttctcaggtgcagcctttgtgaaggagaaccaccggcaactccaagccaggatgggggacctgaaaggggtgctcgatgatctccaagacaatgaggttcttactgagaatgagaaggagctggtggagcaggaaaagacacggcagagcaagaatgaggccttgctgagcatggtggagaagaaaggggacctggccctggacgtgctcttcagaagcattagtgaaagggacccttacctcgtgtcctatcttagacagcagaatttgtaaaatgagtcagttaggtagtctggaagagagaatccagcgttctcattggaaatggataaacagaaatgtgatcattgatttcagtgttcaagacagaagaagactgggtaacatctatcacacaggctttcaggacagacttgtaacctggcatgtacctattgactgtatcctcatgcattttcctcaagaatgtctgaagaaggtagtaatattccttttaaattttttccaaccattgcttgatatatcactattttatccattgacatgattcttgaagacccaggataaaggacatccggataggtgtgtttatgaaggatggggcctggaaaggcaacttttcctgattaatgtgaaaaataattcctatggacactccgtttgaagtatcaccttctcataactaaaagcagaaaagctaacaaaagcttctcagctgaggacactcaaggcatacatgatgacagtcttttttttttttgtatgttaggactttaacactttatctatggctactgttattagaacaatgtaaatgtatttgctgaaagagagcacaaaaatgggagaaaatgcaaacatgagcagaaaatattttcccactggtgtgtagcctgctacaaggagttgttgggttaaatgttcatggtcaactccaaggaatactgagatgaaatgtggtaaatcaactccacagaaccaccaaaaagaaaatgagggtaattcagcttattctgagacagacattcctggcaatgtaccatacaaaaaataagccaactctgacatttggattctaccatagactctgtcattttgtagccatttcagctgtcttttgattaatgttttcgtggcacacatatttccatccttttatgtttaatctgtttaaaacaagttcctagtagacaccatctggttgagtcagttttttttatggtgtattttgaacccattctgatagtctcttttaactggaagatttcaattacttacgttaatgtaattattaatatgttaggatttatcctcagtcagccagtttgttatgtcttttctattctactgttatcacatttgtaccacttaaagtggaatctaggcactttatcaccatttagatcctattaccttttctcatctaggatatagttatcttctacataatctttctgtatcttaaaacccatcaataaattattatatattttctacttttaatcactcagaagatttaaaaaactcatgagaagagtaatctgttatgtttttccagatatttaccatttctgttgctcttccttcattattttccaaatttcgttctgcaaatttccacttcctctgatagacgttttttagttcttttagagtggttctgataggtacagattctcttattttttgcttcctctgaggacatctttttctcaccttcattctcagtgatgttttttgcttgtagtatttttagttgacattgttttctgttcagcagtttccttttagcttccgtatttcctgatgagaaatctgcagtcattcaaattgttgtttccctgtatgtagtgtgtcatttttctgtcagatttcaaggtatttatctttagtttttagccatttcattatgttggggatgagtttccttgttttattccctttggaatttgctccaattcataaatttgcagttttatgtcttttaccaaacttagaggttttcagcctaatttctaaaaatactttttattagcctgattttcatctttataggaaatagtttaagtgatgacaagttccaatagcttatatgcccagaaggccttcaaaataagaattttgaaagaatacagaaaacaaacttttatatccttctcatgtcttctactgtaaaattcatatgctttgctactctaaacctagtttgaaatcaacagtcttgagaatagatgaaaattttgatgaatagtggaattcttttaaatggaaacctcttacatgtgattttccttgccatctagaaataaaccatagtatttatgttgaatcaatcaatattatattttgtttttttcctcctcttctgagactcttattgtggaaatgttagacttttatgttttcctaaatgtccctgatattctacttatttagaacatcttttcattttttccattattctgattgggtaattttaatttgtctattttcaaatttgctggagtgttcacctgttgttatctgtgtcgtcccactgagtgcattcaccaccttttaaattttggtcactgtatgtatcagttctaaaatttccattttgttctctatattttaaatttcttgccttatattctattttcctgcaaatgtgtcagcatttgcttgtttgagctttttttttttcaagacagggtctcaactctgttacccaggctggagtgcagtggtgcgatctcagctcactgcaacctctgcctcctggttcaagcgattattgtgcctcagcctccagagtagctgggattacaggcatgcaccaccacagcccagctaattttttgtatttttagtagagacagagttttgctatgttggccaggctggttttgaactcctggcctcaagtgatccacccacctcagcctcccaaagtgctgggattacaggccactacacctggcacatttgagtatttttttttttttttttttttttttgagatggagtctcgctctgtcatctaggctggagtgcagtggtgtgatctcagctcactgcagcctctgtctcccgggctcaagcgattctcttgcctcagcctcctgagtagctaggactacaggtgcatgccaacacgcccggctaatttttttttaaaaatatttttagtagagacagggtttcaccattttggccaggatggtcttgatctcctgacctcatgatccacccgcctcggccttccaaagtgctgggattacaggcatgagccaccgtgcctggcctcatttgagtatttttataatgtctcttttaaagtctttgtcagataatttcactgtacatgttattcagtgtttggtgtccactgagttgtcatttgccagacaagtggagatttttgcagctcatccttgtattctcagtagttccgatatgtaccctcgaaatgtgaatgttatcttatgagactctgttttatttgtatccaacagaagatgtttattatttatttggctttctgtgaactgaggtcttaatatcagctcattttaaaagtctttgcagtggtattcggatctatcctgtgtgtgcctatgagattgggtgcagtgtatcctgttagctccattctcagggcgtttgaatgtgaattaggaccagcgcaatgaatgctcaagttggggttgggcgttagaattcataaaagtctttatatgctcagattctgcagctccatcctcttcatgattgtgatcgtaaggacagtggaattttgcagttgtctataccttatcttgaagtagaactaaattgttacatttgaagaatgtacttcataaatttacaaaaataaaaaaataggttaatgttatt

SEQ ID NO: 4782 - DNA, 5210 bp, Homo sapiens
tgaccaagaggaacagaacacagagcagcctggcagtgtccaagcaacaagcctccgctcctccttcctgcaccctggggctcctgaaactcacatgggtaaaaaagatacagtaaagacataaataccacatttgacaaatggaaaaaaaggagtgtccagaaaagagtagcagcagtgaggaagagctgccgagacgggtatacagggagctaccctgtgtttctgagaccctttgtgacatctcacattttttccaagaagatgatgagacagaggcagagccattattgttccgtgctgttcctgagtgtcaactatctgggggggacattcccagtgtatcagaagagcaggaatcttcagagggacaagattcaggagacatttgctcagaagagaatcaaatagtttcctcttatgcttctaaagtctgttttgagatcgaagaagattataaaaatcgtcagtttctggggcctgaaggaaatgtggatgttgagttgattgataagagcacaaacagatacagcgtttggttccccactgctggctggtatctgtggtcagccacaggcctcggcttcctggtaagggatgaggtcacagtgacgattgcgtttggttcctggagtcagcacctggccctggacctgcagcaccatgaacagtggctggtgggcggccccttgtttgatgtcactgcagagccagaggaggctgtcgccgaaatccacctcccccacttcatctccctccaagcaggtgaggtggacgtctcctggtttctcgttgcccattttaagaatgaagggatggtcctggagcatccagcccgggtggagcctttctatgctgtcctggaaagccccagcttctctctgatgggcatcctgctgcggatcgccagtgggactcgcctctccatccccatcacttccaacacattgatctattatcacccccaccccgaagatattaagttccacttgtaccttgtccccagcgacgccttgctaacaaaggcgatagatgatgaggaagatcgcttccatggtgtgcgcctgcagacttcgcccccaatggaacccctgaactttggttccagttatattgtgtctaattctgctaacctgaaagtaatgcccaaggagttgaaattgtcctacaggagccctggagaaattcagcacttctcaaaattctatgctgggcagatgaaggaacccattcaacttgagattactgaaaaaagacatgggactttggtgtgggatactgaggtgaagccagtggatctccagcttgtagctgcatcagcccctcctcctttctcaggtgcagcctttgtgaaggagaaccaccggcaactccaagccaggatgggggacctgaaaggggtgctcgatgatctccaagacaatgaggttcttactgagaatgagaaggagctggtggagcaggaaaagacacggcagagcaagaatgaggccttgctgagcatggtggagaagaaaggggacctggccctggacgtgctcttcagaagcattagtgaaagggacccttacctcgtgtcctatcttagacagcagaatttgtaaaatgagtcagttaggtagtctggaagagagaatccagcgttctcattggaaatggataaacagaaatgtgatcattgatttcagtgttcaagacagaagaagactgggtaacatctatcacacaggctttcaggacagacttgtaacctggcatgtacctattgactgtatcctcatgcattttcctcaagaatgtctgaagaaggtagtaatattccttttaaattttttccaaccattgcttgatatatcactattttatccattgacatgattcttgaagacccaggataaaggacatccggataggtgtgtttatgaaggatggggcctggaaaggcaacttttcctgattaatgtgaaaaataattcctatggacactccgtttgaagtatcaccttctcataactaaaagcagaaaagctaacaaaagcttctcagctgaggacactcaaggcatacatgatgacagtcttttttttttttgtatgttaggactttaacactttatctatggctactgttattagaacaatgtaaatgtatttgctgaaagagagcacaaaaatgggagaaaatgcaaacatgagcagaaaatattttcccactggtgtgtagcctgctacaaggagttgttgggttaaatgttcatggtcaactccaaggaatactgagatgaaatgtggtaaatcaactccacagaaccaccaaaaagaaaatgagggtaattcagcttattctgagacagacattcctggcaatgtaccatacaaaaaataagccaactctgacatttggattctaccatagactctgtcattttgtagccatttcagctgtcttttgattaatgttttcgtggcacacatatttccatccttttatgtttaatctgtttaaaacaagttcctagtagacaccatctggttgagtcagttttttttatggtgtattttgaacccattctgatagtctcttttaactggaagatttcaattacttacgttaatgtaattattaatatgttaggatttatcctcagtcagccagtttgttatgtcttttctattctactgttatcacatttgtaccacttaaagtggaatctaggcactttatcaccatttagatcctattaccttttctcatctaggatatagttatcttctacataatctttctgtatcttaaaacccatcaataaattattatatattttctacttttaatcactcagaagatttaaaaaactcatgagaagagtaatctgttatgtttttccagatatttaccatttctgttgctcttccttcattattttccaaatttcgttctgcaaatttccacttcctctgatagacgttttttagttcttttagagtggttctgataggtacagattctcttattttttgcttcctctgaggacatctttttctcaccttcattctcagtgatgttttttgcttgtagtatttttagttgacattgttttctgttcagcagtttccttttagcttccgtatttcctgatgagaaatctgcagtcattcaaattgttgtttccctgtatgtagtgtgtcatttttctgtcagatttcaaggtatttatctttagtttttagccatttcattatgttggggatgagtttccttgttttattccctttggaatttgctccaattcataaatttgcagttttatgtcttttaccaaacttagaggttttcagcctaatttctaaaaatactttttattagcctgattttcatctttataggaaatagtttaagtgatgacaagttccaatagcttatatgcccagaaggccttcaaaataagaattttgaaagaatacagaaaacaaacttttatatccttctcatgtcttctactgtaaaattcatatgctttgctactctaaacctagtttgaaatcaacagtcttgagaatagatgaaaattttgatgaatagtggaattcttttaaatggaaacctcttacatgtgattttccttgccatctagaaataaaccatagtatttatgttgaatcaatcaatattatattttgtttttttcctcctcttctgagactcttattgtggaaatgttagacttttatgttttcctaaatgtccctgatattctacttatttagaacatcttttcattttttccattattctgattgggtaattttaatttgtctattttcaaatttgctggagtgttcacctgttgttatctgtgtcgtcccactgagtgcattcaccaccttttaaattttggtcactgtatgtatcagttctaaaatttccattttgttctctatattttaaatttcttgccttatattctattttcctgcaaatgtgtcagcatttgcttgtttgagctttttttttttcaagacagggtctcaactctgttacccaggctggagtgcagtggtgcgatctcagctcactgcaacctctgcctcctggttcaagcgattattgtgcctcagcctccagagtagctgggattacaggcatgcaccaccacagcccagctaattttttgtatttttagtagagacagagttttgctatgttggccaggctggttttgaactcctggcctcaagtgatccacccacctcagcctcccaaagtgctgggattacaggccactacacctggcacatttgagtatttttttttttttttttttttttttgagatggagtctcgctctgtcatctaggctggagtgcagtggtgtgatctcagctcactgcagcctctgtctcccgggctcaagcgattctcttgcctcagcctcctgagtagctaggactacaggtgcatgccaacacgcccggctaatttttttttaaaaatatttttagtagagacagggtttcaccattttggccaggatggtcttgatctcctgacctcatgatccacccgcctcggccttccaaagtgctgggattacaggcatgagccaccgtgcctggcctcatttgagtatttttataatgtctcttttaaagtctttgtcagataatttcactgtacatgttattcagtgtttggtgtccactgagttgtcatttgccagacaagtggagatttttgcagctcatccttgtattctcagtagttccgatatgtaccctcgaaatgtgaatgttatcttatgagactctgttttatttgtatccaacagaagatgtttattatttatttggctttctgtgaactgaggtcttaatatcagctcattttaaaagtctttgcagtggtattcggatctatcctgtgtgtgcctatgagattgggtgcagtgtatcctgttagctccattctcagggcgtttgaatgtgaattaggaccagcgcaatgaatgctcaagttggggttgggcgttagaattcataaaagtctttatatgctcagattctgcagctccatcctcttcatgattgtgatcgtaaggacagtggaattttgcagttgtctataccttatcttgaagtagaactaaattgttacatttgaagaatgtacttcataaatttacaaaaataaaaaaataggttaatgttatt

SEQ ID NO: 4783 - DNA, 1267 bp, Homo sapiens
gactgtggagttaagcagaacccatcaggaagtgcacaggcgtccggcgtgctcctccctccctgcagccccgggcagcatctcccagaggctccgcggcccaggctcctggtgtgtctgcagtgcaggtggctcctggaagaccctcagcctgcctgctgaggccatgtcggactacgagaacgatgacgagtgctggagcgtcctggagggcttccgggtgacgctcacctcggtcatcgacccctcacgcatcacaccttacctgcggcagtgcaaggtcctgaaccccgatgatgaggagcaggtgctcagcgaccccaacctggtcatccgcaaacggaaagtgggtgtgctcctggacatcctgcagcggaccggccacaagggctacgtggccttcctcgagagcctggagctctactacccgcagctgtacaagaaggtcacaggcaaggagccggcccgcgtcttctccatgatcatcgacgcgtccggggagtcaggcctgactcagctgctgatgactgaggtcatgaagctgcagaagaaggtgcaggacctgaccgcgctgctgagctccaaagatgacttcatcaaggagctgcgggtgaaggacagcctgctgcgcaagcaccaggagcgtgtgcagaggctcaaggaggagtgcgaggccggcagccgcgagctcaagcgctgcaaggaggagaactacgacctggccatgcgcctggcgcaccagagtgaggagaagggcgccgcgctcatgcggaaccgtgacctgcagctggagattgaccagctcaagcacagcctcatgaaggccgaggacgactgcaaggtggagcgcaagcacacgctgaagctcaggcacgccatggagcagcggcccagccaggagctgctgtgggagctgcagcaggagaaggccctgctccaggcccgggtgcaggagctggaggcctccgtccaggaggggaagctggacaggagcagcccctacatccaggtactggaggaggactggcggcaggcgctgcgggaccaccaggagcaggccaacaccatcttctccctgcgcaaggacctccgccagggcgaggcccgacgcctccggtgcatggaggagaaggagatgttcgagctgcagtgcctggcactacgtaaggactccaagatgtacaaggaccgcatcgaggccatcctgctgcagatggaggaggtcgccattgagcgggaccagagcacacaaatggaggggctgtga

SEQ ID NO: 4784 - DNA, 2123 bp, Homo sapiens
gactgtggagttaagcagaacccatcaggaagtgcacaggcgtccggcgtgctcctccctccctgcagccccgggcagcatctcccagaggctccgcggcccaggctcctggtgtgtctgcagtgcaggtggctcctggaagaccctcagcctgcctgctgaggccatgtcggactacgagaacgatgacgagtgctggagcgtcctggagggcttccgggtgacgctcacctcggtcatcgacccctcacgcatcacaccttacctgcggcagtgcaaggtcctgaaccccgatgatgaggagcaggtgctcagcgaccccaacctggtcatccgcaaacggaaagtgggtgtgctcctggacatcctgcagcggaccggccacaagggctacgtggccttcctcgagagcctggagctctactacccgcagctgtacaagaaggtcacaggcaaggagccggcccgcgtcttctccatgatcatcgacgcgtccggggagtcaggcctgactcagctgctgatgactgaggtcatgaagctgcagaagaaggtgcaggacctgaccgcgctgctgagctccaaagatgacttcatcaaggagctgcgggtgaaggacagcctgctgcgcaagcaccaggagcgtgtgcagaggctcaaggaggagtgcgaggccggcagccgcgagctcaagcgctgcaaggaggagaactacgacctggccatgcgcctggcgcaccagagtgaggagaagggcgccgcgctcatgcggaaccgtgacctgcagctggagattgaccagctcaagcacagcctcatgaaggccgaggacgactgcaaggtggagcgcaagcacacgctgaagctcaggcacgccatggagcagcggcccagccaggagctgctgtgggagctgcagcaggagaaggccctgctccaggcccgggtgcaggagctggaggcctccgtccaggaggggaagctggacaggagcagcccctacatccaggtactggaggaggactggcggcaggcgctgcgggaccaccaggagcaggccaacaccatcttctccctgcgcaaggacctccgccagggcgaggcccgacgcctccggtgcatggaggagaaggagatgttcgagctgcagtgcctggcactacgtaaggactccaagatgtacaaggaccgcatcgaggccatcctgctgcagatggaggaggtcgccattgagcgggaccaggccatagccacgcgggaggagctgcacgcacagcacgcccggggcctgcaggagaaggacgcgctgcgcaagcaggtgcgggagctgggcgagaaggcggatgagctgcagctgcaggtgttccagtgtgaggcgcagctactggccgtggagggcaggctcaggcggcagcagctggagacgctcgtcctgagctccgacctggaagatggctcacccaggaggtcccaggagctctcactcccccaggacctggaggacacccagctctcagacaaaggctgccttgccggcggggggagcccgaaacagccctttgcagctctgcaccaggagcaggttttgcggaacccccatgacgcaggcctgagcagcggggagccgcccgagaaggagcggcggcgcctcaaagagagttttgagaactaccgcaggaagcgcgccctcaggaagatgcagaaaggatggcggcagggggaggaggaccgggagaacaccacgggcagcgacaacaccgacactgagggctcctagccgcagcagcgcaggccccgaccagggcacacccaccggcccggcctcctgccacccgggggtgccgacgccctggggcgcagacttccccgagccgtcgctgacttggcctggaacgaggaatctggtgccctgaaaggcccagccggactgccgggcattggggccgtttgttaagcggcactcattttgcggaggccatgcgggtgctcaccacccccatgcacacgccatctgtgtaacttcaggatctgttctgtttcaccatgtaacacacaatacatgcatgcattgtattagtgttagaaaacacagctgcgtaaataaacagcacgggtgacccgca

SEQ ID NO: 4785 - DNA, 1814 bp, Homo sapiens
gactgtggagttaagcagaacccatcaggaagtgcacaggcgtccggcgtgctcctccctccctgcagccccgggcagcatctcccagaggctccgcggcccaggctcctggtgtgtctgcagtgcaggtggctcctggaagaccctcagcctgcctgctgaggccatgtcggactacgagaacgatgacgagtgctggagcgtcctggagggcttccgggtgacgctcacctcggtcatcgacccctcacgcatcacaccttacctgcggcagtgcaaggtcctgaaccccgatgatgaggagcaggtgctcagcgaccccaacctggtcatccgcaaacggaaagtgggtgtgctcctggacatcctgcagcggaccggccacaagggctacgtggccttcctcgagagcctggagctctactacccgcagctgtacaagaaggtcacaggcaaggagccggcccgcgtcttctccatgatcatcgacgcgtccggggagtcaggcctgactcagctgctgatgactgaggtcatgaagctgcagaagaaggtgcaggacctgaccgcgctgctgagctccaaagatgacttcatcaaggagctgcgggtgaaggacagcctgctgcgcaagcaccaggagcgtgtgcagaggctcaaggaggagtgcgaggccggcagccgcgagctcaagcgctgcaaggaggagaactacgacctggccatgcgcctggcgcaccagagtgaggagaagggcgccgcgctcatgcggaaccgtgacctgcagctggagattgaccagctcaagcacagcctcatgaaggccgaggacgactgcaaggtggagcgcaagcacacgctgaagctcaggcacgccatggagcagcggcccagccaggagctgctgtgggagctgcagcaggagaaggccctgctccaggcccgggtgcaggagctggaggcctccgtccaggaggggaagctggacaggagcagcccctacatccaggtactggaggaggactggcggcaggcgctgcgggaccaccaggagcaggccaacaccatcttctccctgcgcaaggacctccgccagggcgaggcccgacgcctccggtgcatggaggagaaggagatgttcgagctgcagtgcctggcactacgtaaggactccaagatgtacaaggaccgcatcgaggccatcctgctgcagatggaggaggtcgccattgagcgggaccaggccatagccacgcgggaggagctgcacgcacagcacgcccggggcctgcaggagaaggacgcgctgcgcaagcaggtgcgggagctgggcgagaaggcggatgagctgcagctgcaggtgttccagtgtgaggcgcagctactggccgtggagggcaggctcaggcggcagcagctggagacgctcgtcctgagctccgacctggaagatggctcacccaggaggtcccaggagctctcactcccccaggacctggaggacacccagctctcagacaaaggctgccttgccggcggggggagcccgaaacagccctttgcagctctgcaccaggagcaggttttgcggaacccccatgacgcaggcccagccggactgccgggcattggggccgtttgttaagcggcactcattttgcggaggccatgcgggtgctcaccacccccatgcacacgccatctgtgtaacttcaggatctgttctgtttcaccatgtaacacacaatacatgcatgcattgtattagtgttagaaaacacagctgcgtaaataaacagcacgggtgacccgca

SEQ ID NO: 4786 - DNA, 4405 bp, Homo sapiens
gcatgcgcgcccgcggcgctccatcccaaacacacacacatttttcccccggacttggaaagtcacccaaagccgccccaagtgcaggcaaacagaccttgctgactgaaggcaaagactcctccatcccacctgccctcccagctgccacggccatcgacccctcctttacaaggggctcctgcaactccccagcagcacgtgttggaatggacttcggaccctggcctcttgggatgcaaaggatgaagtgacacccccagctacatccgaggaggttctaggacctgctacgagagtttgggaccaaggagaagagaatggatcttggaacagctgagggcacccggtgcacggacccgcctgcaggcaagcccgccatggcgcccaaacgcaagggtggcctgaagctgaacgccatctgcgccaagctgagccgccaggtggtggtggagaagcgagctgacgccggctcccacacggagggcagcccatcgcagccccgggaccaagagcgcagtggccctgagtctggggcagcccgggccccccgcagcgaggaagacaagagacgggcagtgatcgagaagtgggtgaacggggagtacagcgaggagccggcacccacacccgtgttggggcggattgcccgcgagggcctggagctgcctcccgagggtgtctacatggtgcagccccaggggtgcagcgatgaggaagaccacgcggaggagccctccaaggacggcggtgccctggaggagaaggattcggacggggcagcctccaaggaggacagcggccccagcaccaggcaggcttcaggagaggcctcctcgctgcgggactacgcggcctccaccatgaccgagttcctcggcatgtttggctatgatgaccagaacacgcgggacgagctggccaggaagatcagctttgagaagctgcacgcgggctccaccccggaggcagccacctcctccatgctgcccacctccgaggataccctcagcaagcgggcgcggttctctaagtatgaggagtacatccgcaagctcaaggctggcgagcagctctcctggccggcccccagcaccaagaccgaggagcgggtgggcaaggaggtggtgggcaccctgcccggcctgcggctgcccagcagcacggcccacctggagaccaaggccaccatcctgcccctgccgtcgcacagcagtgtccagatgcagaacctggtagcccgggcctccaagtacgacttcttcatccaaaaactgaagaccggcgagaatctgcggccccagaacgggagcacctacaagaagccatccaagtacgacctggagaatgtcaagtacctgcacctcttcaaacccggggagggcagccccgacatgggcggggccatcgccttcaagacaggcaaggtggggcgcccttccaagtacgacgtccggggcatccagaagccaggccccgccaaggttccgcccacccccagcctggctcccgcacccctcgccagcgtgcccagtgcccccagcgcccccgggccagggccagagcctcctgcctccctgtccttcaacactcccgagtacctgaagtcaaccttctccaaaacagactccatcaccacggggaccgtctccactgtcaagaacggactgcccacagataaaccagccgtcactgaagatgtaaacatttaccagaaatatattgccaggttctcgggcagccagcactgtggccacatccactgtgcctaccagtaccgcgagcactaccactgccttgaccctgagtgtaactaccagaggttcacgagtaagcaggacgtgatccgccactacaacatgcacaagaagcgcgacaactccctgcagcacggcttcatgcgtttcagcccgctggacgactgcagcgtctactaccacggctgccacctcaatgggaagagcacccactatcactgcatgcaggtgggctgtaacaaggtgtacacgagcacgtctgacgtgatgacccacgagaacttccacaagaagaatacccagctcattaacgacggcttccagcgcttccgagccaccgaagactgtggcacagccgactgccagttctacggacagaagaccacgcacttccactgcaggcgccccggctgcacattcactttcaagaacaagtgtgacatcgagaagcacaagagctaccacatcaaggacgatgcctacgccaaggacggcttcaagaagttctacaagtacgaggagtgcaagtacgagggctgcgtgtacagcaaggctaccaaccacttccactgcatccgcgccggctgcggcttcaccttcacctccaccagccagatgacctctcacaagcgcaagcatgagcgccggcacatccgctcctcgggcgcgctggggctgccgccctcgctgctgggcgccaaggacacggagcacgaggagtccagcaacgacgaccttgttgacttctccgccctgagcagcaagaactccagcctgagcgcctcccctaccagccagcagtcctctgcgtccctggctgccgccactgccgccaccgaggctgggcccagtgccaccaaacctcccaacagcaagatctcggggctgctgccccagggcctgcctggctcaatccccctggccctggccctctccaactcgggcctgcccacccccacgccctacttccccatactggctggccgtgggagcacctccctgcctgtgggcacccccagcctcctgggtgccgtgtcgtctgggtcagcagcctcagccacccctgacacacccacgctggtcgcctcgggagctggagactcagcccccgtggctgccgcctctgtcccggcaccacccgcctccatcatggagaggatctctgcaagcaagggcctcatctcgcccatgatggccaggctggctgcagctgccctcaagccctctgccacctttgacccaggaagcgggcagcaggtcaccccagccaggttccccccggcccaagtgaagccggaacccggtgagagcaccggcgccccaggcccccacgaagcctcccaggaccgcagtctagacctgactgtgaaggagcccagcaacgaatcaaatggccacgcagtcccggcaaattcatctcttttatcctcgcttatgaataagatgtctcagggcaaccctggcctgggcagcctgctgaacatcaaggcggaagcggaggggagccccgctgcggagccctcgcccttcctaggcaaggccgtgaaggcgctggttcaggagaagttggcagagccctggaaggtgtacctgcgcaggtttggtacaaaggacttctgtgacggccagtgtgacttcctccacaaggcccacttccactgcgtggtggaggaatgcggcgcgctcttcagcaccttggacggggccatcaagcacgcaaacttccacttccggacagagggaggagcagcaaaaggaaacacagaggctgcctttccggcctcggccgccgagaccaaacctcccatggccccctcgtcccctccggtccctcctgtcaccacggccacggtgtcctctctggaggggcccgctcccagcccggcctccgtgccctccacccccaccctgctcgcctggaagcagctggcttccaccataccccagatgcctcagatcccagcgtcagtgcctcacctgcccgcctcgcccttggcaacgacttctctagagaacgccaagccccaggtcaaacccggattcctccagttccaggagaagtgagtccctcgatgagccgggagtcccgcgttcccctcgcgtctcgggagtaggtgctagcaagggcgctaggaggccctgttcctcactgcggatggtgctgctgtccccagcctctctggggcatggccatcgggtgatgtccttctagccaaagatgctgctgctcctacctcactgcctgtcccagagcaggccagcccgcgtgggccgatggtggcggcagtggctactgctcctgcagggcatgtggtgatcctgccagggccaggtggggtggactgggcgtggtggtcctcagaggacaactcccagcctgacaaggagggctgcgtctccctccgagcctccgtattggcctcctctgtggctcacacccatggctgaatctctgcagggcacgtgaagtcacgggtaggggccaggcccctccaggccgtcactggcctgcacagtggtctgagctcttgggtggaagggaccctcctcactggatggtggtggctccttgcagggagaacggtgactttgtattgtcatgtgtgcggcttcctgttctcaataaaagtaataaattggattattta

SEQ ID NO: 4787 - DNA, 7936 bp, Homo sapiens
atgcgcgcccgcggcgctccatcccaaacacacacacatttttcccccggacttggaaagtcacccaaagccgccccaagtgcaggcaaacagaccttgctgactgaaggcaaagactcctccatcccacctgccctcccagctgccacggccatcgacccctcctttacaaggggctcctgcaactccccagcagcacgtgttggaatggacttcggaccctggcctcttgggatgcaaaggatgaagtgacacccccagctacatccgaggaggttctaggacctgctacgagagtttgggaccaaggagaagagaatggatcttggaacagctgagggcacccggtgcacggacccgcctgcaggcaagcccgccatggcgcccaaacgcaagggtggcctgaagctgaacgccatctgcgccaagctgagccgccaggtggtggtggagaagcgagctgacgccggctcccacacggagggcagcccatcgcagccccgggaccaagagcgcagtggccctgagtctggggcagcccgggccccccgcagcgaggaagacaagagacgggcagtgatcgagaagtgggtgaacggggagtacagcgaggagccggcacccacacccgtgttggggcggattgcccgcgagggcctggagctgcctcccgagggtgtctacatggtgcagccccaggggtgcagcgatgaggaagaccacgcggaggagccctccaaggacggcggtgccctggaggagaaggattcggacggggcagcctccaaggaggacagcggccccagcaccaggcaggcttcaggagaggcctcctcgctgcgggactacgcggcctccaccatgaccgagttcctcggcatgtttggctatgatgaccagaacacgcgggacgagctggccaggaagatcagctttgagaagctgcacgcgggctccaccccggaggcagccacctcctccatgctgcccacctccgaggataccctcagcaagcgggcgcggttctctaagtatgaggagtacatccgcaagctcaaggctggcgagcagctctcctggccggcccccagcaccaagaccgaggagcgggtgggcaaggaggtggtgggcaccctgcccggcctgcggctgcccagcagcacggcccacctggagaccaaggccaccatcctgcccctgccgtcgcacagcagtgtccagatgcagaacctggtagcccgggcctccaagtacgacttcttcatccaaaaactgaagaccggcgagaatctgcggccccagaacgggagcacctacaagaagccatccaagtacgacctggagaatgtcaagtacctgcacctcttcaaacccggggagggcagccccgacatgggcggggccatcgccttcaagacaggcaaggtggggcgcccttccaagtacgacgtccggggcatccagaagccaggccccgccaaggttccgcccacccccagcctggctcccgcacccctcgccagcgtgcccagtgcccccagcgcccccgggccagggccagagcctcctgcctccctgtccttcaacactcccgagtacctgaagtcaaccttctccaaaacagactccatcaccacggggaccgtctccactgtcaagaacggactgcccacagataaaccagccgtcactgaagatgtaaacatttaccagaaatatattgccaggttctcgggcagccagcactgtggccacatccactgtgcctaccagtaccgcgagcactaccactgccttgaccctgagtgtaactaccagaggttcacgagtaagcaggacgtgatccgccactacaacatgcacaagaagcgcgacaactccctgcagcacggcttcatgcgtttcagcccgctggacgactgcagcgtctactaccacggctgccacctcaatgggaagagcacccactatcactgcatgcaggtgggctgtaacaaggtgtacacgagcacgtctgacgtgatgacccacgagaacttccacaagaagaatacccagctcattaacgacggcttccagcgcttccgagccaccgaagactgtggcacagccgactgccagttctacggacagaagaccacgcacttccactgcaggcgccccggctgcacattcactttcaagaacaagtgtgacatcgagaagcacaagagctaccacatcaaggacgatgcctacgccaaggacggcttcaagaagttctacaagtacgaggagtgcaagtacgagggctgcgtgtacagcaaggctaccaaccacttccactgcatccgcgccggctgcggcttcaccttcacctccaccagccagatgacctctcacaagcgcaagcatgagcgccggcacatccgctcctcgggcgcgctggggctgccgccctcgctgctgggcgccaaggacacggagcacgaggagtccagcaacgacgaccttgttgacttctccgccctgagcagcaagaactccagcctgagcgcctcccctaccagccagcagtcctctgcgtccctggctgccgccactgccgccaccgaggctgggcccagtgccaccaaacctcccaacagcaagatctcggggctgctgccccagggcctgcctggctcaatccccctggccctggccctctccaactcgggcctgcccacccccacgccctacttccccatactggctggccgtgggagcacctccctgcctgtgggcacccccagcctcctgggtgccgtgtcgtctgggtcagcagcctcagccacccctgacacacccacgctggtcgcctcgggagctggagactcagcccccgtggctgccgcctctgtcccggcaccacccgcctccatcatggagaggatctctgcaagcaagggcctcatctcgcccatgatggccaggctggctgcagctgccctcaagccctctgccacctttgacccaggaagcgggcagcaggtcaccccagccaggttccccccggcccaagtgaagccggaacccggtgagagcaccggcgccccaggcccccacgaagcctcccaggaccgcagtctagacctgactgtgaaggagcccagcaacgaatcaaatggccacgcagtcccggcaaattcatctcttttatcctcgcttatgaataagatgtctcagggcaaccctggcctgggcagcctgctgaacatcaaggcggaagcggaggggagccccgctgcggagccctcgcccttcctaggcaaggccgtgaaggcgctggttcaggagaagttggcagagccctggaaggtgtacctgcgcaggtttggtacaaaggacttctgtgacggccagtgtgacttcctccacaaggcccacttccactgcgtggtggaggaatgcggcgcgctcttcagcaccttggacggggccatcaagcacgcaaacttccacttccggacagagggaggagcagcaaaaggaaacacagaggctgcctttccggcctcggccgccgagaccaaacctcccatggccccctcgtcccctccggtccctcctgtcaccacggccacggtgtcctctctggaggggcccgctcccagcccggcctccgtgccctccacccccaccctgctcgcctggaagcagctggcttccaccataccccagatgcctcagatcccagcgtcagtgcctcacctgcccgcctcgcccttggcaacgacttctctagagaacgccaagccccaggtcaaacccggattcctccagttccaggagaacgatccttgcctcgccacggactgcaagtacgccaacaagttccacttccactgtctctttgggaactgcaagtacgtctgcaaaacgtctggcaaggccgaatcccactgcctggaccacatcaaccccaacaacaacctggtgaacgtgcgagaccagtttgcatactactctctgcagtgtctctgtcccaaccagcactgcgagttccgaatgcgtgggcactaccactgcctccgcaccggctgctattttgtgaccaacatcaccaccaagctcccctggcacatcaagaagcatgagaaggcggagcggcgggcagccaatggcttcaaatacttcaccaagcgcgaggagtgtggcaggctaggttgcaagtacaaccaggtgaacagccacttccactgcatccgggagggctgccagttctccttcctcctcaagcaccagatgacctcccacgcgcggaagcacatgcggaggatgctggggaagaacttcgaccgcgtgcccccctcccagggccccccaggcctgatggatgctgagacagatgagtgcatggactacactggctgcagcccaggcgccatgtcctctgagtcatccaccatggaccggagctgctccagcacccccgtgggtaacgagagcaccgcggcagggaacaccatctctatgccgacagcctcgggggccaaaaagcgcttctggatcatcgaggacatgtcgcccttcggcaagcggcggaagacggcgtcctcccggaagatgctggacgagggcatgatgctggagggcttccggcgcttcgacctttacgaggactgcaaggacgcagcttgtcagttctcgctcaaggtcacccactaccactgcacgcgcgagaactgcggctacaagttctgcgggcgcacgcacatgtacaagcacgcgcagcaccacgaccgcgtggacaacctggtgctggacgacttcaagcgcttcaaggcctcactcagctgccacttcgccgactgccccttctcgggcaccagcacgcacttccactgcctgcgctgccgcttccgctgcaccgacagcaccaaggtcacggcgcatcgcaagcaccacggcaaacaggacgtgatcagcgccgcgggcttctgccagttcagctccagcgccgactgcgccgtgcccgactgcaagtacaagctcaagtgctcgcacttccactgcaccttcccgggctgccgccacacggtggtgggcatgtcgcagatggactcgcacaagcgcaagcacgagaagcaggagcgcggcgagcccgcggcagagggccccgcgcccgggcctcccatcagtctggacggctccctgtcgctgggcgccgagccgggctcgctgctcttcctgcagtcggcggccgccggcctgggcctggcgctgggcgacgcgggcgaccccggcccgcccgacgccgccgcccccgggccgcgcgagggcgccgccgccgccgccgccgcagctggggagtcctcgcaggaggacgaggaggaggagctggagctgccggaggaggaggccgaagacgacgaggacgaggacgacgacgaggacgacgacgacgaggacgacgacgaggacgacgacgacgaggacctgcgcaccgactcggaggagtcgctgcccgaggcggcggcggaggcggcgggcgcgggcgcgcggaccccggccttggcggcgctggcggccctgggcgcccccggccccgcgcccactgcagcctcctcgccctagcggcgcccgcgggtggccctggcggcggcctcggcctcggcctcgggagcggcgccgccccgcgcgaagcggcccctgggcagagccccgcgccccgccggtgcttccggaccccgagtccgtctcaggacagaggcggggacccctctggtgctccgcggccgaggacacaggcggcggcggtggccctgctctagggaggccgggtctcttcagggaaacagaaggtgctcttgtcccggggtagggaacctaggagcaggggtcccgggcgaatgcggcgcagctcccggccgctgccccggcgcccctccccgcggccgattcggccccgcgaccattgctcaggactgggacgggcgctgggggccaccgggacccccaccgcgcgccaccagggcggggtggctcctggagccgctggcggggcctccctcatgcagctaggatcctcccccctgcccagggggagacgggcagaaggcagtcagcacgggtgacactacagggaccgtggaggaagcctcacgggagtagcagccgcggagctccagctcagccccaccccagggcccggctgctcccccaggcctgggtcgggtctgtttggcgactccctggccccagcctccgccccagggaaaccgaggctgcgtccaaaacccagagtagcccgctgggggccggggcggggtctcggccaccctggtggtgcaaacaggaaggatgcgcctggttttggctttaatgttcaaaatggaaaaaaatacaagaaagttgtacagtatttttcctgtaaaggttattattctacatagaacaaaaaggaagaaagcaggcgtggtgagagtgcagacccgcctgggcccggcctgaggttggaggctcagtcccgtttatcctgtgggatttggtccagggtttttgtagaggccttaactgtttgaggctgtctgtcttcacaatagcactgatgggagctgcgtgattccaactcttaacttgaattttgtagagacaagaaaaaaggactattactgttgatccaagtttgtagttaatttaacatttgagttctctcttggtgatgcgtgtggctttatagggcttttttttttttccagtttgttttattactttgtttgggatgcttcttcgctggtgcagtctacccagattgggttccctttgcaaaacatcccccttcctggagatgatgatgccatcgaagcccgggccagggcctgacctggcaggcacacacctggccagtggctctgaggtccccggggaccgagtcccctgcgagggcaggctgcccgaggccacacctgcccaccttccctactccaggccaccagctggtgtcagattgggccaccgggagagaacaggcctaggagggaatggaaggctggcggggaggctgtcatccagaagcctcctccccagaggtctccaggaggaacctggctcaactggggggcagtggtttacttttcccttttttcttcctttcttttgtcctctcagctgcccacagccagaaagccaggaccacccgaactggacagggagcagggagggaggagtggtcgcacggagcgtacctgattcaacaggaaatcagttattttctaaaacagcccctaccagagcctcctgaactctgtgggcaccacgtgctgctgtgagcatctgcccagacagtgacccgccacaggccccgggcgtctgtggaaggagttttgtaaaggaaaaaaaaacacacacacacaaacattttttcaatgtagcaaaatcaaacttaaaaaaaaaaaagaagaaaagaagaagatgccgacagtgcggagtctagccttttgtaaacttcatattgcacactaggactataagccattgctagctcattttgaattttaacgtgtaatttttgttttattttctttctgtggggaaacaatgcttgatccaccaatgctctttttaatgttttataactatgtatgtgtatatatataaatatcaaataatatgtatgcacatatgtgtgtgtatatatctatatgtatatacatatatagatatatagagatatatagagaggttttgagacaaaaaaaatacagaacgtgaaacccgagctgaacagcgtgtgctctgattacttgaatctggtctcctcggcacctggttattaagaactgaatatttttccacttgaatttagtgctattagaaatttaatatatgtgttttatttatttgatttttttttttttttttgcatgactgatgcaaggtttgacattttcactcaataaaaactggaaaaaaa

SEQ ID NO: 4788 - DNA, 5637 bp, Homo sapiens
caggagttagaagccgctcttcacagagatgacgtggagtttatcagtgacctgattgcctgcctgcttcagggctgctatcaacgaagagatatcacgcctcagacattccacagctacctagaggacatcatcaactaccgctgggagctcgaagaagggaagcccaaccctctgagggaagccagtttccaggacctgcctcttcgcacacgggtggagatcctgcaccgactctgtgattaccggctggatgcagacgatgtcttcgatcttctaaagggcctggatgcagacagtctccgtgtggagccattgggtgaagacaattctggggcactatattggtatttctatggaacacgaatgtacaaagaggacccggtgcaaggaaaatccaatggagaactctctttgagcagggaaagtgaaggacaaaaaaatgtctcaagtattcctggaaaaacgggaaaaagaagaggaagacccccaaaacggaagaaactgcaggaggagattctgttgagtgaaaagcaggaagaaaattccttggcatccgagccacagacaagacatgggtcccaagggccaggccaaggtacttggtggctcctgtgccagacagaagaggaatggagacaggtcaccgagagttttcgcgagaggacctcccttcgagaacggcagctctacaagctcctcagtgaggacttcctgcctgagatctgcaacatgatcgcccagaagggaaaacgtccacagcgcacaaaggcagagttgcatcctaggtggatgtctgaccacctgtccatcaaacccgtcaagcaagaggagactcctgtgctgaccagaatagaaaaacaaaagcgcaaagaggaggaagaagagcgtcagattcttctagcagtgcagaagaaggagcaggagcagatgctaaaggaagagaggaaacgcgagttggaggagaaggtcaaggcagtggaaggtatgtgcagtgtccgcgtggtctggagaggtgcatgtctgtcgaccagccgtcctgtagatcgagcgaagaggagaaagctcagggaagaaagggcatggctgctggctcaaggaaaggagctccctccagaactttcccatctggaccccaattcccccatgagagaggaaaaaaagactaaagacctctttgagttggatgatgatttcactgctatgtataaagttctagacgtggtaaaggctcacaaggattcctggcccttcttggaacctgtggatgaatcttatgcccctaactattatcagattattaaggcccccatggatatttccagcatggagaagaaactgaatggaggtttatactgtaccaaggaggaatttgtaaatgacatgaagaccatgttcaggaattgtcgaaagtataatggggaaagtagtgagtataccaagatgtctgataatttagagaggtgtttccatcgggcaatgatgaaacattttcctggagaagatggagacacagatgaagaattttggattcgagaggatgaaaagcgggagaaaagacggagtcgggctgggcgaagtggtgggagccatgtttggacccgctccagggacccagaagggtccagcaggaaacagcagcccatggagaatggaggaaagtcgttgccccccacacgccgagcgccctcttctggggacgatcagagcagcagctccacacagcccccgcgggaggtgggcacttccaatggccgaggtttttctcatcccctgcattgtggtgggacacccagccaggcaccctttttaaaccagatgaggccagcagtaccaggaacatttggccctctgcgaggatcagatcctgccaccttgtatggctcctctggagtcccggagccacaccccggggagcctgtgcagcagcgtcagcctttcaccatgcagcctccagttggaattaacagcctccgaggacccaggctaggcacaccagaggagaagcaaatgtgcggggggctgacacacctttctaacatgggcccacaccctggatccttgcagcttgggcagataagtggcccaagtcaggatggaagcatgtatgctccagctcagttccagccaggattcattcctccccggcatgggggggctccagcccggccaccagactttcctgaaagctcagaaattcctcccagccatatgtatcgatcgtacaagtacctgaatcgagtacactctgccgtctggaatgggaaccatggtgctacgaaccaaggacccttgggcccagatgagaagccccacctggggccaggaccctctcaccagcctcgcactctcggtcacgtgatggattcccgagtcatgagaccacctgtcccccccaaccagtggactgaacaatcaggcttcctacctcatggagttccttcctcagggtacatgcgaccgccctgcaagtctgccggacatcggttacagccacctccagtgccagcacccagttctttgtttggagcacctgcccaggctcttcggggggtgcagggaggggactccatgatggacagcccagagatgattgcgatgcagcagctctcctcccgcgtctgccccccaggtgtgccttaccacccccaccagcctgcacacccccgtttacctggcccttttccgcaggtagctcacccaatgtcagtcactgtgtcagcccccaagcctgccctgggcaaccctgggagggcaccggagaacagtgaagcacaagagcctgagaatgaccaagcagagccgttgcctggccttgaagagaaaccaccaggtgttggtacttcagagggggtctacctcacacaactacctcaccccacacctcccctgcagactgactgcaccaggcagagctcaccacaagaaagggaaacagtgggcccggagctcaaaagcagctcctccgaatctgcggacaactgtaaagcaatgaagggcaagaatccctggccctcggatagcagctaccccggcccagccgcccaagggtgcgtgagagacctctccacggtggcagacaggggcgctctatccgagaacggagtcattggggaagcatctccttgtggatcggaggggaagggccttggtagcagtggttccgaaaagctgctctgccccagaggcagaacgttgcaggaaaccatgccatgcacgggacagaacgcagcgacaccgcccagcacagaccccggtttgacgggaggcactgtgagccagtttcccccgctgtatatgcctggcctagagtacccgaattcagctgcccattaccacatcagtccaggcctgcagggtgtgggccctgtgatgggagggaagtccccagcatcccatccccagcattttcccccaaggggctttcagtctaaccacccacattctggaggctttccccggtatcgccccccacaaggaatgaggtattcctaccacccaccgccacagccttcctaccaccactatcagcgaactccttactatgcctgtccacagagcttttctgactggcagagacctctccatccccagggaagcccaagcggacccccagccagtcagcctcccccaccaaggtccctcttctcagataagaatgccatggccagtctgcaaggctgtgagacactgaatgctgccttaacttctccaacccgtatggatgcagtggctgctaaagtcccaaatgacgggcagaatcctggtccagaggaagagaagctggatgaatctatggagaggccagagagtcccaaagaatttttagacctggacaaccataacgcagctaccaagcggcagagctcgttgtcagccagcgagtatctctatggaactcctccgcctctgagttcaggaatgggatttggttcatctgcatttccaccccacagtgtgatgctgcagacggggcctccctatacccctcagcggccggccagtcactttcagcccagggcttactcttcccctgtggctgccctcccacctcaccacccaggggccacccagcccaacggcctctctcaggagggtcccatctatcgctgccaggaagaaggcctgggtcactttcaagctgtgatgatggaacaaattggcactagaagtggaataagaggacctttccaggaaatgtacagaccatcaggaatgcagatgcacccggtccagtcgcaggcctcgttcccaaagacccccacagcagcaacatcacaggaggaggtgccgcctcataagcctccaacacttcccctggatcagagctagtccaaggaggaaatgagccccaagcaatggaaagctgcacacgaagactggaatgtggagaactggggagtgccctgtcagctctattcccatcacctgctccaccccttcacggcgacccactcgtgccatacttgagctggagccagtcacgggccctaaaaggacactccttagatgactgacacacagattgcaaaggtcctcggccagggatctcttgcacagctgatgtagacagtcaggcaaaactaatgaacgtggagttaatgatgacttttccaaatcctgagacacttttcagggaaaatcactttaaacttgggggagggggtatactcaagaatggagtggtgcttttaaactttgatgagcagctaaactcaggtatatatttggggaagggactactcttagtattaatggttttggagctgggtccagtttacagaattttcatgttgccttttaaaataatttttgttggtggtgaatgtattgtacataaagtgggaagggtgggtggggatgcggaagaaatgggggtcctaactggtgggcacacagcactggagtgatttttatctgtttacaatcatgtcacactgaatacttatgggagccggagatgagggtaggaaaggtttgatcttgtaatgtgtcactgtgtttccttagtggccagccagccttcagaatagctaaaggccttccttccttccagtcagcctgagagagaacacctgtcccctaagcacctggtgtctccattggaggcagactgctctcaggagactactagaagcttcagcccggaagacaggctgctctctcatgctggtggcccaaattgagaaagtggtgtcccttcctgattttgccaccagccctaccgaatagttgtaaaccagtatcaggaattgggatcgctagagtgtttcacgtattagaagatgaatcgtcctcatcacagacctccctgtcaggactgtgatctagaaggcatcacacacagctttctggcacgaatcacattttgtggaagtgactactcaggtttgtatattttagtatcaataaagaattgcacaggtttgaataggaaaaatgtattctatagatttacagtttgaatttaggaatatttcagtatatatagtttttattcgttttaagtgaatcatagtaaaatcagtcatggtgatttaaaatagctatcaagaacaagttcttggaattatctgttgtatctgtgataggaaaccattttacagtattaaattactttattacagttgtagagtt

SEQ ID NO: 4789 - DNA, 1448 bp, Homo sapiens
aaaggaaaaaggatgaacaaatgcctgtgtggtttcacttatatagtactcagcttgacgccatgtgaaatgaagaggagttagaagccgctcttcacagagatgacgtggagtttatcagtgacctgattgcctgcctgcttcagggctgctatcaacgaagagatatcacgcctcagacattccacagctacctagaggacatcatcaactaccgctgggagctcgaagaagggaagcccaaccctctgagggaagccagtttccaggacctgcctcttcgcacacgggtggagatcctgcaccgactctgtgattaccggctggatgcagacgatgtcttcgatcttctaaagggcctggatgcagacagtctccgtgtggagccattgggtgaagacaattctggggcactatattggtatttctatggaacacgaatgtacaaagaggacccggtgcaaggaaaatccaatggagaactctctttgagcagggaaagtgaaggacaaaaaaatgtctcaagtattcctggaaaaacgggaaaaagaagaggaagacccccaaaacggaagaaactgcaggaggagattctgttgagtgaaaagcaggaagaaaattccttggcatccgagccacagacaagacatgggtcccaagggccaggccaaggtacttggtggctcctgtgccagacagaagaggaatggagacaggtcaccgagagttttcgcgagaggacctcccttcgagaacggcagctctacaagctcctcagtgaggacttcctgcctgagatctgcaacatgatcgcccagaaggagactcctgtgctgaccagaatagaaaaacaaaagcgcaaagaggaggaagaagagcgtcagattcttctagcagtgcagaagaaggagcaggagcagatgctaaaggaagagaggaaacgcgagttggaggagaaggtcaaggcagtggaaggtatgtgcagtgtccgcgtggtctggagaggtgcatgtctgtcgaccagccgtcctgtagatcgagcgaagaggagaaagctcagggaagaaagggcatggctgctggctcaaggaaaggagctccctccagaactttcccatctggaccccaattcccccatgagagaggaaaaaaagactaaagacctctttgagttggatgatgatttcactgctatgtataaagttctagacgtggtaaaggctcacaaggattcctggcccttcttggaacctgtggatgaatcttatgcccctaactattatcagattattaaggcccccatggatatttccagcatggagaagaaactgaatggaggtttatactgtaccaaggaggaatttgtaaatgacatgaagaccatgttcaggaattgtcgaaagtataatggggaaagtagtggtaagcagggaaggagtttgtgctag

SEQ ID NO: 4790 - DNA, 2302 bp, Homo sapiens
actcggggcaacaggcagatttgcctgctgagggtggagacccacgagccgaggcctcctgcagtgttctgcacagcaaaccgcacgctatggctgacagccgggatcccgccagcgaccagatgcagcactggaaggagcagcgggccgcgcagaaagctgatgtcctgaccactggagctggtaacccagtaggagacaaacttaatgttattacagtagggccccgtgggccccttcttgttcaggatgtggttttcactgatgaaatggctcattttgaccgagagagaattcctgagagagttgtgcatgctaaaggagcaggggcctttggctactttgaggtcacacatgacattaccaaatactccaaggcaaaggtatttgagcatattggaaagaagactcccatcgcagttcggttctccactgttgctggagaatcgggttcagctgacacagttcgggaccctcgtgggtttgcagtgaaattttacacagaagatggtaactgggatctcgttggaaataacacccccattttcttcatcagggatcccatattgtttccatcttttatccacagccaaaagagaaatcctcagacacatctgaaggatccggacatggtctgggacttctggagcctacgtcctgagtctctgcatcaggtttctttcttgttcagtgatcgggggattccagatggacatcgccacatgaatggatatggatcacatactttcaagctggttaatgcaaatggggaggcagtttattgcaaattccattataagactgaccagggcatcaaaaacctttctgttgaagatgcggcgagactttcccaggaagatcctgactatggcatccgggatctttttaacgccattgccacaggaaagtacccctcctggactttttacatccaggtcatgacatttaatcaggcagaaacttttccatttaatccattcgatctcaccaaggtttggcctcacaaggactaccctctcatcccagttggtaaactggtcttaaaccggaatccagttaattactttgctgaggttgaacagatagccttcgacccaagcaacatgccacctggcattgaggccagtcctgacaaaatgcttcagggccgcctttttgcctatcctgacactcaccgccatcgcctgggacccaattatcttcatatacctgtgaactgtccctaccgtgctcgagtggccaactaccagcgtgacggcccgatgtgcatgcaggacaatcagggtggtgctccaaattactaccccaacagctttggtgctccggaacaacagccttctgccctggagcacagcatccaatattctggagaagtgcggagattcaacactgccaatgatgataacgttactcaggtgcgggcattctatgtgaacgtgctgaatgaggaacagaggaaacgtctgtgtgagaacattgccggccacctgaaggatgcacaaattttcatccagaagaaagcggtcaagaacttcactgaggtccaccctgactacgggagccacatccaggctcttctggacaagtacaatgctgagaagcctaagaatgcgattcacacctttgtgcagtccggatctcacttggcggcaagggagaaggcaaatctgtgaggccggggccctgcacctgtgcagcgaagcttagcgttcatccgtgtaacccgctcatcactggatgaagattctcctgtgctagatgtgcaaatgcaagctagtggcttcaaaatagagaatcccactttctatagcagattgtgtaacaattttaatgctatttccccaggggaaaatgaaggttaggatttaacagtcatttaaaaaaaaaatttgttttgacggatgattggattattcatttaaaatgattagaaggcaagtttctagctagaaatatgattttatttgacaaaatttgttgaaattatgtatgtttacatatcacctcatggcctattatattaaaatatggctataaatatataaaaagaaaagataaagatgatctactcagaaatttttatttttctaaggttctcataggaaaagtacatttaatacagcagtgtcatcagaagataacttgagcaccgtcatggcttaatgtttattcctgataataattgatcaaattcatttttttcactggagttacattaatgttaattcagcactgatttcacaacagatcaatttgtaattgcttacatttttacaataaataatctgtacgtaagaacaga

SEQ ID NO: 4791 - DNA, 2437 bp, Homo sapiens
cggggacaccctggccaccgccgcgcggacaccctcacgaggacaccccggccgcgcggacacctaccgcggggacgccccgaccccatcctacctgctgcgccccgcgccgcgccccgcaccccgcccgccacggcctgcgtccgccaccggaagcgccctcctaatccccgcagcgccaccgccattgccgccatcgtcgtggggcttctggggcagctagggctgcccgccgcgctgcctgcgccggaccggggcgggtccagtcccgggcgggccgtcgcgggagagaaataacatctgctttgctgccgagctcagaggagaccccagacccctcccgcagccagagggctggagcctgctcagaggtgctttgaagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtcacccttgtggttggagcgtcccaggacatcatcccccagctgaagaagaagtatgatgtggacacactggacatggtcttcctcgaccactggaaggaccggtacctgccggacacgcttctcttggaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgcccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaagaatctaaatatttagatataactcgacttagtacatccttctcaactgccattcccctgctgcccttgacttgggcaccaaacattcaaagctccccttgacggacgctaacgctaagggcggggcccctagctggctgggttctgggtggcacgcctggcccactggcctcccagccacagtggtgcagaggtcagccctcctgcagctaggccaggggcacctgttagccccatggggacgactgccggcctgggaaacgaagaggagtcagccagcattcacacctttctgaccaagcaggcgctggggacaggtggaccccgcagcagcaccagcccctctgggccccatgtggcacagagtggaagcatctccttccctactccccactgggccttgcttacagaagaggcaatggctcagaccagctcccgcatccctgtagttgcctccctggcccatgagtgaggatgcagtgctggtttctgcccacctacacctagagctgtccccatctcctccaaggggtcagactgctagccacctcagaggctccaagggcccagttcccaggcccaggacaggaatcaaccctgtgctagctgagttcacctgcaccgagaccagcccctagccaagattctactcctgggctcaaggcctggctagcccccagccagcccactcctatggatagacagaccagtgagcccaagtggacaagtttggggccacccagggaccagaaacagagcctctgcaggacacagcagatgggcacctgggaccacctccacccagggccctgccccagacgcgcagaggcccgacacaagggagaagccagccacttgtgccagacctgagtggcagaaagcaaaaagttcctttgctgctttaatttttaaattttcttacaaaaatttaggtgtttaccaatagtcttattttggcttatttttaa

SEQ ID NO: 4792 - DNA, 1548 bp, Homo sapiens
atccccgcagcgccaccgccattgccgccatcgtcgtggggcttctggggcagctagggctgcccgccgcgctgcctgcgccggaccggggcgggtccagtcccgggcgggccgtcgcgggagagaaataacatctgctttgctgccgagctcagaggagaccccagacccctcccgcagccagagggctggagcctgctcagaggtgctttgaagaggatccctgggctgcctggggaagcacccagggccagggagtgtgaccctgcaggctccacacaggactgccagaggcacacacctgctctgtctacccgagggcaccagagggcacgagaaggctggctccctggcgctgacacgtcaggcaactgaggcacaaggctggcatttctgaaccttgcccctctgcaaacacaagggggcgatggtggcactccaagcaaaggggcgtgtgggtgctgcaggaggagcacagagcactggcgcccctcccctcccgccctgcagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtcacccttgtggttggagcgtcccaggacatcatcccccagctgaagaagaagtatgatgtggacacactggacatggtcttcctcgaccactggaaggaccggtacctgccggacacgcttctcttggaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgcccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctata

SEQ ID NO: 4793 - DNA, 1339 bp, Homo sapiens
cccgcatgagcaggcagagtggagataacacggatcgctgtgtacactgtgtgctccggttgttgcatccgagggttgatcggatggtggttcccatccagatccaagtcctggcccctgatcacagagaaacacagctggacattaaagtgaaataacatctgctttgctgccgagctcagaggagaccccagacccctcccgcagccagagggctggagcctgctcagaggtgctttgaagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtcacccttgtggttggagcgtcccaggacatcatcccccagctgaagaagaagtatgatgtggacacactggacatggtcttcctcgaccactggaaggaccggtacctgccggacacgcttctcttggaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgcccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaagaatctaaa

SEQ ID NO: 4794 - DNA, 1457 bp, Homo sapiens
ccgccattgccgccatcgtcgtggggcttctggggcagctagggctgcccgccgcgctgcctgcgccggaccggggcgggtccagtcccgggcgggccgtcgcgggagagaaataacatctgctttgctgccgagctcagaggagaccccagacccctcccgcagccagagggctggagcctgctcagaggtgctttgaagggtctgtgacctgaacccctgggcttctgcctcaggcctcctgtgctctgctctctgcctgctgggtcccctcaccaggcttctgtctggttcccaggctacctgcctggagggtcacaccaggaggatttcaaacaggtttcaagtggggtcacttgccatcactgtgccccacgagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtcacccttgtggttggagcgtcccaggacatcatcccccagctgaagaagaagtatgatgtggacacactggacatggtcttcctcgaccactggaaggaccggtacctgccggacacgcttctcttggaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgcccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaat

SEQ ID NO: 4795 - DNA, 871 bp, Homo sapiens
acgggaggagcaagaacacagaacagagggggcaagacagctccaccaggagtcaggagtgaatcccctctgggaacgaggcactaggaagaagaacttccagcccaggagaaataacatctgctttgctgccgagctcagaggagaccccagacccctcccgcagccagagggctggagcctgctcagaggtgctttgaagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtcacccttgtggttggagcgtcccaggacatcatcccccagctgaagaagaagtatgatgtggacacactggacatggtcttcctcgaccactggaaggaccggtacctgccggacacgcttctcttggaggaatgtggcctgctgcggaaggggacagtgctactggctgacaacgtgatctgc

SEQ ID NO: 4796 - DNA, 2035 bp, Homo sapiens
gctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtcacccttgtggttggagcgtcccaggacatcatcccccagctgaagaagaagtatgatgtggacacactggacatggtcttcctcgaccactggaaggaccggtacctgccggacacgcttctcttggaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgcccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaagaatctaaatatttagatataactcgacttagtacatccttctcaactgccattcccctgctgcccttgacttgggcaccaaacattcaaagctccccttgacggacgctaacgctaagggcggggcccctagctggctgggttctgggtggcacgcctggcccactggcctcccagccacagtggtgcagaggtcagccctcctgcagctaggccaggggcacctgttagccccatggggacgactgccggcctgggaaacgaagaggagtcagccagcattcacacctttctgaccaagcaggcgctggggacaggtggaccccgcagcagcaccagcccctctgggccccatgtggcacagagtggaagcatctccttccctactccccactgggccttgcttacagaagaggcaatggctcagaccagctcccgcatccctgtagttgcctccctggcccatgagtgaggatgcagtgctggtttctgcccacctacacctagagctgtccccatctcctccaaggggtcagactgctagccacctcagaggctccaagggcccagttcccaggcccaggacaggaatcaaccctgtgctagctgagttcacctgcaccgagaccagcccctagccaagattctactcctgggctcaaggcctggctagcccccagccagcccactcctatggatagacagaccagtgagcccaagtggacaagtttggggccacccagggaccagaaacagagcctctgcaggacacagcagatgggcacctgggaccacctccacccagggccctgccccagacgcgcagaggcccgacacaagggagaagccagccacttgtgccagacctgagtggcagaaagcaaaaagttcctttgctgctttaatttttaaattttcttacaaaaatttaggtgtttaccaatagtcttattttggcttatttttaa

SEQ ID NO: 4797 - DNA, 5931 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataacaactattccacaccaaatgagagaggagaccacaatagaacactggatcgatcgggggatctaggcgacatggagccattgaagggaacaacacccttgatgcaggacgaggggcaggaatctctggaggaagagttggatgtgttggttttggatgatgaggggggccaagtgtcttacccctccatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 4798 - DNA, 2846 bp, Homo sapiens
agaagcagagttagataaaatgtggtgcctaccctgtgtgttcacagttctggagtggagatgatgagtaacaaaccaatattattcatgctatggcagagatgtaaacaagagctgtggttgaagagatttttctagctaattgagcaagaccaggtagaggaaggaagacgaattgaccagatggatggatggagaaggccactccagtcagtaggcaaagtctgtgaaaaaaatatgaagacttctgagatgcataccatgtctggagcacagactggaaggaaagaaaaaggagatcctctcaacattgcgattgataagatgactaagaaaacaagagatctaaggagacagcttcggaaagcagtgatggatcacatatctgactctttcctggaaaccaatgttcctttgctagttctcattgaggctgcaaagagcggaaatgaaaaggaagtgaaagaatatgcccaagttttccgtgagcatgccaacaaactggtagaggttgccaatttggcctgttccatctccaacaatgaagaaggggtgaaattagttcggatggcagccacccagattgacagcctgtgtccccaggtcatcaatgccgctctgacactggctgcccggccacagagcaaagttgctcaggataacatggacgtcttcaaagaccagtgggagaagcaggtccgagtgttgacagaggccgtggatgacatcacctcagtggatgacttcctctctgtctcagaaaatcacatcttggaggatgtgaacaagtgtgtgatagccctccaagagggcgatgtggacactctggaccggactgcaggggccatcaggggccgggcagctcgagtcatacacatcatcaatgctgagatggagaactatgaagctggggtttatactgagaaggtgttggaagctacaaaattgctttctgaaacagtgatgccacgcttcgctgaacaagtagaggttgccattgaagccctgagtgccaacgttcctcaaccgtttgaggagaatgagttcatcgatgcctctcgcctggtgtatgatggcgttcgggacatcagaaaggctgtgctgatgatcaggaccccagaagaactagaggatgattctgactttgagcaggaagattatgatgtgcgtagcaggacaagtgttcagactgaggatgaccagctcattgcagggcagagcgcacgggccatcatggcgcaactaccgcaggaggagaaggcaaaaatagctgagcaggtggagatattccatcaagagaaaagcaagctggatgcagaagtggccaaatgggacgacagcggcaatgatatcattgtactggccaagcagatgtgtatgatcatgatggaaatgacagacttcacaagaggcaaaggcccattgaaaaatacatctgatgtcattaatgctgccaagaaaattgccgaagcaggttctcgaatggacaaattagctcgtgctgtggctgatcagtgtcctgattcagcatgtaagcaggatttattagcctaccttcaacgaattgccttgtattgccatcagcttaatatctgcagcaaggtgaaggcagaagtgcagaatctgggaggagagctcattgtgtcagggctggacagtgccacatcgcttatccaggcagctaaaaacctgatgaatgctgttgtcctcacggtgaaagcatcctatgtggcctcaaccaaataccagaaggtctatgggacagcagctgtcaactcacctgttgtgtcttggaagatgaaggctccagagaagaagccccttgtgaagagagaaaagcctgaagaattccagacacgagttcgacgaggttctcagaagaaacacatttcgcctgtacaggctttaagtgaattcaaagcaatggattccttctaggacgataggttttaacaagaaagctttttctttcttttctttctttctttttctttttaattccatttttgtatgcatacctgccagctcgtatgcctctggcatggggaaattaagggaacagtgtctgtttgcatgtaagatgagatgagatcaatactactgatccatctgtagcctgggaaggagacaggacattcctgtactaaggtggcacagagctgtcctttgcaacattctcataaaattgggcacagagttcgcattggcgcaatatttatgggagtgggagggatggggaaaataaacttaactctacaaaagcaaactctaatgcatgcaagaatcattaggttggcaggtatatgcataagtgaaaaatctggaagtgtaatggtagaacataaaacttgtattgcttctgtttcagtgcaaaaatgtactagccaatacgcttaagtgtgtggcccatgaattgaacaatttaaccttgaagtctatatccgtgatattatgtcgatttttaactgaggggaaattaactagtccagcctaaaatgcttcttttaatctgcattctgtttcctcttctagttgtgccattactagtgatcatgtttttttcccccctttaatgaaaacaataaacatctatttgagacaattaaaatccttctgggggcactggaagcacaatacggtgaccaatcttgctttcatttttttttctttttaatttgaaccatgattttgctagaaatagaaggcccagtggtggaatattagagggaaggaaactgacaacgtgtgaaagttagaggcaaatacataggtgtagcttggagtgctggtatctaatataccattgtattcactaactaactcaaaataaacacatttaatcttga

SEQ ID NO: 4799 - DNA, 2820 bp, Homo sapiens
atgtctgggttgatctgccttcaatatgggctgtggcatgggcagaagattgattttgggggccccaggagactgcttcaaagaaatagaggtgaagggagcatgacttcggcaacttcacctatcattctgaaatgggaccccaaaagtttggaaatccggacgctaacagtggaaaggctgttggagccacttgttacacaggtgactacacttgtcaacacaagcaacaaaggcccatctggtaaaaagaaagggaggtcaaagaaagcccatgtactagctgcctctgtagagcaagccactcagaatttcctggaaaagggtgaacagatcgctaaggagagtcaagatctcaaagaagagttggtggctgctgtagaggatgtgcgcaaacaaggtgagacgatgcggatcgcctcctccgagtttgcagatgacccttgctcgtcggtaaagcgcggcaccatggtacgggcggcaagggctttgctctccgcggtgacacgcttactcatcctggcggacatggcagatgtcatgagacttttatcccatctgaaaattgtggaagaggccctggaagctgtcaaaaatgctacaaatgagcaagaccttgcaaaccgttttaaagagtttgggaaagagatggtgaaacttaactatgtagcagcaagaagacaacaggagctgaaggatcctcactgtcgggatgagatggcagccgcccgaggggctctgaagaagaatgccacaatgctgtacacggcctctcaagcatttctccgccacccagatgtcgccgctacgagagccaaccgagattatgtgttcaaacaagtccaggaggccatcgccggcatctccaatgctgctcaagctacctcgcccactgacgaagccaagggccacacgggcatcggcgagctggctgcggctcttaatgagtttgacaataagattatcctggaccccatgacgttcagcgaggccaggttccggccgtccctggaggagaggctggagagcatcatcagcggcgcagcgctgatggccgactcctcctgcacgcgagacgaccggcgcgagaggatcgtggcggagtgcaacgccgtgcggcaggcgctccaggacctgctcagcgagtacatgaataatactggaaggaaagaaaaaggagatcctctcaacattgcgattgataagatgactaagaaaacaagagatctaaggagacagcttcggaaagcagtgatggatcacatatctgactctttcctggaaaccaatgttcctttgctagttctcattgaggctgcaaagagcggaaatgaaaaggaagtgaaagaatatgcccaagttttccgtgagcatgccaacaaactggtagaggttgccaatttggcctgttccatctccaacaatgaagaaggggtgaaattagttcggatggcagccacccagattgacagcctgtgtccccaggtcatcaatgccgctctgacactggctgcccggccacagagcaaagttgctcaggataacatggacgtcttcaaagaccagtgggagaagcaggtccgagtgttgacagaggccgtggatgacatcacctcagtggatgacttcctctctgtctcagaaaatcacatcttggaggatgtgaacaagtgtgtgatagccctccaagagggcgatgtggacactctggaccggactgcaggggccatcaggggccgggcagctcgagtcatacacatcatcaatgctgagatggagaactatgaagctggggtttatactgagaaggtgttggaagctacaaaattgctttctgaaacagtgatgccacgcttcgctgaacaagtagaggttgccattgaagccctgagtgccaacgttcctcaaccgtttgaggagaatgagttcatcgatgcctctcgcctggtgtatgatggcgttcgggacatcagaaaggctgtgctgatgatcaggaccccagaagaactagaggatgattctgactttgagcaggaagattatgatgtgcgtagcaggacaagtgttcagactgaggatgaccagctcattgcagggcagagcgcacgggccatcatggcgcaactaccgcaggaggagaaggcaaaaatagctgagcaggtggagatattccatcaagagaaaagcaagctggatgcagaagtggccaaatgggacgacagcggcaatgatatcattgtactggccaagcagatgtgtatgatcatgatggaaatgacagacttcacaagaggcaaaggcccattgaaaaatacatctgatgtcattaatgctgccaagaaaattgccgaagcaggttctcgaatggacaaattagctcgtgctgtggctgatcagtgtcctgattcagcatgtaagcaggatttattagcctaccttcaacgaattgccttgtattgccatcagcttaatatctgcagcaaggtgaaggcagaagtgcagaatctgggaggagagctcattgtgtcagggctggacagtgccacatcgcttatccaggcagctaaaaacctgatgaatgctgttgtcctcacggtgaaagcatcctatgtggcctcaaccaaataccagaaggtctatgggacagcagctgtcaactcacctgttgtgtcttggaagatgaaggctccagagaagaagccccttgtgaagagagaaaagcctgaagaattccagacacgagttcgacgaggttctcagaagaaacacatttcgcctgtacaggctttaagtgaattcaaagcaatggattccttctag

SEQ ID NO: 4800 - DNA, 3684 bp, Homo sapiens
ggagcatgacttcggcaacttcacctatcattctgaaatgggaccccaaaagtttggaaatccggacgctaacagtggaaaggctgttggagccacttgttacacaggtgactacacttgtcaacacaagcaacaaaggcccatctggtaaaaagaaagggaggtcaaagaaagcccatgtactagctgcctctgtagagcaagccactcagaatttcctggaaaagggtgaacagatcgctaaggagagtcaagatctcaaagaagagttggtggctgctgtagaggatgtgcgcaaacaaggtgagacgatgcggatcgcctcctccgagtttgcagatgacccttgctcgtcggtaaagcgcggcaccatggtacgggcggcaagggctttgctctccgcggtgacacgcttactcatcctggcggacatggcagatgtcatgagacttttatcccatctgaaaattgtggaagaggccctggaagctgtcaaaaatgctacaaatgagcaagaccttgcaaaccgttttaaagagtttgggaaagagatggtgaaacttaactatgtagcagcaagaagacaacaggagctgaaggatcctcactgtcgggatgagatggcagccgcccgaggggctctgaagaagaatgccacaatgctgtacacggcctctcaagcatttctccgccacccagatgtcgccgctacgagagccaaccgagattatgtgttcaaacaagtccaggaggccatcgccggcatctccaatgctgctcaagctacctcgcccactgacgaagccaagggccacacgggcatcggcgagctggctgcggctcttaatgagtttgacaataagattatcctggaccccatgacgttcagcgaggccaggttccggccgtccctggaggagaggctggagagcatcatcagcggcgcagcgctgatggccgactcctcctgcacgcgagacgaccggcgcgagaggatcgtggcggagtgcaacgccgtgcggcaggcgctccaggacctgctcagcgagtacatgaataatactggaaggaaagaaaaaggagatcctctcaacattgcgattgataagatgactaagaaaacaagagatctaaggagacagcttcggaaagcagtgatggatcacatatctgactctttcctggaaaccaatgttcctttgctagttctcattgaggctgcaaagagcggaaatgaaaaggaagtgaaagaatatgcccaagttttccgtgagcatgccaacaaactggtagaggttgccaatttggcctgttccatctccaacaatgaagaaggggtgaaattagttcggatggcagccacccagattgacagcctgtgtccccaggtcatcaatgccgctctgacactggctgcccggccacagagcaaagttgctcaggataacatggacgtcttcaaagaccagtgggagaagcaggtccgagtgttgacagaggccgtggatgacatcacctcagtggatgacttcctctctgtctcagaaaatcacatcttggaggatgtgaacaagtgtgtgatagccctccaagagggcgatgtggacactctggaccggactgcaggggccatcaggggccgggcagctcgagtcatacacatcatcaatgctgagatggagaactatgaagctggggtttatactgagaaggtgttggaagctacaaaattgctttctgaaacagtgatgccacgcttcgctgaacaagtagaggttgccattgaagccctgagtgccaacgttcctcaaccgtttgaggagaatgagttcatcgatgcctctcgcctggtgtatgatggcgttcgggacatcagaaaggctgtgctgatgatcaggaccccagaagaactagaggatgattctgactttgagcaggaagattatgatgtgcgtagcaggacaagtgttcagactgaggatgaccagctcattgcagggcagagcgcacgggccatcatggcgcaactaccgcaggaggagaaggcaaaaatagctgagcaggtggagatattccatcaagagaaaagcaagctggatgcagaagtggccaaatgggacgacagcggcaatgatatcattgtactggccaagcagatgtgtatgatcatgatggaaatgacagacttcacaagaggcaaaggcccattgaaaaatacatctgatgtcattaatgctgccaagaaaattgccgaagcaggttctcgaatggacaaattagctcgtgctgtggctgatcagtgtcctgattcagcatgtaagcaggatttattagcctaccttcaacgaattgccttgtattgccatcagcttaatatctgcagcaaggtgaaggcagaagtgcagaatctgggaggagagctcattgtgtcagggacaggagttcagagcactttcactaccttttatgaggtagattgtgatgtcatagatgggggcagggctagtcaactttctacccacctcccaacctgtgctgagggagctccgatcgggagtggaagcagtgattcctccatgctggacagtgccacatcgcttatccaggcagctaaaaacctgatgaatgctgttgtcctcacggtgaaagcatcctatgtggcctcaaccaaataccagaaggtctatgggacagcagctgtcaactcacctgttgtgtcttggaagatgaaggctccagagaagaagccccttgtgaagagagaaaagcctgaagaattccagacacgagttcgacgaggttctcagaagaaacacatttcgcctgtacaggctttaagtgaattcaaagcaatggattccttctaggacgataggttttaacaagaaagctttttctttcttttctttctttctttttctttttaattccatttttgtatgcatacctgccagctcgtatgcctctggcatggggaaattaagggaacagtgtctgtttgcatgtaagatgagatgagatcaatactactgatccatctgtagcctgggaaggagacaggacattcctgtactaaggtggcacagagctgtcctttgcaacattctcataaaattgggcacagagttcgcattggcgcaatatttatgggagtgggagggatggggaaaataaacttaactctacaaaagcaaactctaatgcatgcaagaatcattaggttggcaggtatatgcataagtgaaaaatctggaagtgtaatggtagaacataaaacttgtattgcttctgtttcagtgcaaaaatgtactagccaatacgcttaagtgtgtggcccatgaattgaacaatttaaccttgaagtctatatccgtgatattatgtcgatttttaactgaggggaaattaactagtccagcctaaaatgcttcttttaatctgcattctgtttcctcttctagttgtgccattactagtgatcatgtttttttcccccctttaatgaaaacaataaacatctatttgagacaattaaaatccttctgggggcactggaagcacaatacggtgaccaatcttgctttcatttttttttctttttaatttgaaccatgattttgctagaaatagaaggcccagtggtggaatattagagggaaggaaactgacaacgtgtgaaagtta

SEQ ID NO: 4801 - DNA, 541 bp, Homo sapiens
tttttacatggcgggacagccatgcctcagaatgtttagcatatttatcatctcagaagggtccaacagtatttagtgtgaatgagacactgttcagattggaaatacactgtctatactgtactccagacacacctattttgcttttaaaattattctcaatatctgtcttttccatagtaacggagcatgacttcggcaacttcacctatcattctgaaatgggaccccaaaagtttggaaatccggacgctaacagtggaaaggctgttggagccacttgttacacaggtgactacacttgtcaacacaagcaacaaaggcccatctggtaaaaagaaagggaggtcaaagaaagcccatgtactagctgcctctgtagagcaagccactcagaatttcctggaaaagggtgaacagatcgctaaggagagtcaagatctcaaagaagagttggtggctgctgtagaggatgtgcgcaaacaaggtgagacgatgcggatcgcctcctccgagtttgcagatgacccttgctcgtcgg

SEQ ID NO: 4802 - DNA, 521 bp, Homo sapiens
gacccaggcgggcgggcagagcaggcggcaccgcacctcggccagaggcggctgcagcagctgctgcccttgtccctgccgccgcctctccagtcccttctgtgattaccactccagctgctgggaacgggcgagaaagaggaggaggcgagaaactcccaccgacccacagagctagtcaaaggaagcgtttcattccacctatctttggtcagaggagagggaggagtgtagaccagcattctacccactgacgacaggtcatctgtctctattattgaagaaccattgcagagcctatgctcaccttctgcgagggagcatgacttcggcaacttcacctatcattctgaaatgggaccccaaaagtttggaaatccggacgctaacagtggaaaggctgttggagccacttgttacacaggtgactacacttgtcaacacaagcaacaaaggcccatctggtaaaaagaaagggaggtcaaagaaagcccatgtactagctgcctctgtagagcaag

SEQ ID NO: 4803 - DNA, 4349 bp, Homo sapiens
gctgaaggaagctacaatcatccaagtgggaagtaatgtctaccgatgttctgatttaagtgaatgaaggtcttctttccacctcgggaaatcttgagggttatgtaacagcagctttgaaaggcttgtgagatgtactttgtgctagtccatctcaaatcttcaccggctgtaccaagaacagaaaaaaaaaggaatttgagacgggatctcagcatgtttgccaggatggtctcagtctcttgacctcgtgatccgcctaccttggcctcccaaagtgttggaattacaggtgtgagccactgcgcccagccatcagaacaaaatatacagctggatgtttgtcacaattctaatgtccctgcaaagatgagatgcatgaatcacacagcaatctcatcaaaaagataagaaaattgagactcagagcatttaagcagccagcctggagtcacagagatttaagtctcagagccagcactcaggatgagtgccaatggaagcctgtccttggagtccagaatgaacgtcagaagcaacccagccacagcaggagactgtccatgaatgtcatctggctgaacctaaagcacctctggatttagatgcactccttcaaggaccatgggttctgcaacagtaccccctctccattgttccagctctgactcagatgggccctccttgatggcactcccagcagcacagccttagcactgggagcatgacttcggcaacttcacctatcattctgaaatgggaccccaaaagtttggaaatccggacgctaacagtggaaaggctgttggagccacttgttacacaggtgactacacttgtcaacacaagcaacaaaggcccatctggtaaaaagaaagggaggtcaaagaaagcccatgtactagctgcctctgtagagcaagccactcagaatttcctggaaaagggtgaacagatcgctaaggagagtcaagatctcaaagaagagttggtggctgctgtagaggatgtgcgcaaacaaggtgagacgatgcggatcgcctcctccgagtttgcagatgacccttgctcgtcggtaaagcgcggcaccatggtacgggcggcaagggctttgctctccgcggtgacacgcttactcatcctggcggacatggcagatgtcatgagacttttatcccatctgaaaattgtggaagaggccctggaagctgtcaaaaatgctacaaatgagcaagaccttgcaaaccgttttaaagagtttgggaaagagatggtgaaacttaactatgtagcagcaagaagacaacaggagctgaaggatcctcactgtcgggatgagatggcagccgcccgaggggctctgaagaagaatgccacaatgctgtacacggcctctcaagcatttctccgccacccagatgtcgccgctacgagagccaaccgagattatgtgttcaaacaagtccaggaggccatcgccggcatctccaatgctgctcaagctacctcgcccactgacgaagccaagggccacacgggcatcggcgagctggctgcggctcttaatgagtttgacaataagattatcctggaccccatgacgttcagcgaggccaggttccggccgtccctggaggagaggctggagagcatcatcagcggcgcagcgctgatggccgactcctcctgcacgcgagacgaccggcgcgagaggatcgtggcggagtgcaacgccgtgcggcaggcgctccaggacctgctcagcgagtacatgaataatactggaaggaaagaaaaaggagatcctctcaacattgcgattgataagatgactaagaaaacaagagatctaaggagacagcttcggaaagcagtgatggatcacatatctgactctttcctggaaaccaatgttcctttgctagttctcattgaggctgcaaagagcggaaatgaaaaggaagtgaaagaatatgcccaagttttccgtgagcatgccaacaaactggtagaggttgccaatttggcctgttccatctccaacaatgaagaaggggtgaaattagttcggatggcagccacccagattgacagcctgtgtccccaggtcatcaatgccgctctgacactggctgcccggccacagagcaaagttgctcaggataacatggacgtcttcaaagaccagtgggagaagcaggtccgagtgttgacagaggccgtggatgacatcacctcagtggatgacttcctctctgtctcagaaaatcacatcttggaggatgtgaacaagtgtgtgatagccctccaagagggcgatgtggacactctggaccggactgcaggggccatcaggggccgggcagctcgagtcatacacatcatcaatgctgagatggagaactatgaagctggggtttatactgagaaggtgttggaagctacaaaattgctttctgaaacagtgatgccacgcttcgctgaacaagtagaggttgccattgaagccctgagtgccaacgttcctcaaccgtttgaggagaatgagttcatcgatgcctctcgcctggtgtatgatggcgttcgggacatcagaaaggctgtgctgatgatcaggaccccagaagaactagaggatgattctgactttgagcaggaagattatgatgtgcgtagcaggacaagtgttcagactgaggatgaccagctcattgcagggcagagcgcacgggccatcatggcgcaactaccgcaggaggagaaggcaaaaatagctgagcaggtggagatattccatcaagagaaaagcaagctggatgcagaagtggccaaatgggacgacagcggcaatgatatcattgtactggccaagcagatgtgtatgatcatgatggaaatgacagacttcacaagaggcaaaggcccattgaaaaatacatctgatgtcattaatgctgccaagaaaattgccgaagcaggttctcgaatggacaaattagctcgtgctgtggctgatcagtgtcctgattcagcatgtaagcaggatttattagcctaccttcaacgaattgccttgtattgccatcagcttaatatctgcagcaaggtgaaggcagaagtgcagaatctgggaggagagctcattgtgtcagggctggacagtgccacatcgcttatccaggcagctaaaaacctgatgaatgctgttgtcctcacggtgaaagcatcctatgtggcctcaaccaaataccagaaggtctatgggacagcagctgtcaactcacctgttgtgtcttggaagatgaaggctccagagaagaagccccttgtgaagagagaaaagcctgaagaattccagacacgagttcgacgaggttctcagaagaaacacatttcgcctgtacaggctttaagtgaattcaaagcaatggattccttctaggacgataggttttaacaagaaagctttttctttcttttctttctttctttttctttttaattccatttttgtatgcatacctgccagctcgtatgcctctggcatggggaaattaagggaacagtgtctgtttgcatgtaagatgagatgagatcaatactactgatccatctgtagcctgggaaggagacaggacattcctgtactaaggtggcacagagctgtcctttgcaacattctcataaaattgggcacagagttcgcattggcgcaatatttatgggagtgggagggatggggaaaataaacttaactctacaaaagcaaactctaatgcatgcaagaatcattaggttggcaggtatatgcataagtgaaaaatctggaagtgtaatggtagaacataaaacttgtattgcttctgtttcagtgcaaaaatgtactagccaatacgcttaagtgtgtggcccatgaattgaacaatttaaccttgaagtctatatccgtgatattatgtcgatttttaactgaggggaaattaactagtccagcctaaaatgcttcttttaatctgcattctgtttcctcttctagttgtgccattactagtgatcatgtttttttcccccctttaatgaaaacaataaacatctatttgagacaattaaaatccttctgggggcactggaagcacaatacggtgaccaatcttgctttcatttttttttctttttaatttgaaccatgattttgctagaaatagaaggcccagtggtggaatattagagggaaggaaactgacaacgtgtgaaagttagaggcaaatacataggtgtagcttggagtgctggtatctaatataccattgtattcactaactaactcaaaataaacacatttaatcttg

SEQ ID NO: 4804 - DNA, 3839 bp, Homo sapiens
gagcggcttcgcttccagccccgagtgaggcggagacccaggcgggcgggcagagcaggcggcaccgcacctcggccagaggcggctgcagcagctgctgcccttgtccctgccgccgcctctccagtcccttctgtgattaccactccagctgctgggaacgggcgagaaagaggaggaggcgagaaactcccaccgacccacagagggagcatgacttcggcaacttcacctatcattctgaaatgggaccccaaaagtttggaaatccggacgctaacagtggaaaggctgttggagccacttgttacacaggtgactacacttgtcaacacaagcaacaaaggcccatctggtaaaaagaaagggaggtcaaagaaagcccatgtactagctgcctctgtagagcaagccactcagaatttcctggaaaagggtgaacagatcgctaaggagagtcaagatctcaaagaagagttggtggctgctgtagaggatgtgcgcaaacaaggtgagacgatgcggatcgcctcctccgagtttgcagatgacccttgctcgtcggtaaagcgcggcaccatggtacgggcggcaagggctttgctctccgcggtgacacgcttactcatcctggcggacatggcagatgtcatgagacttttatcccatctgaaaattgtggaagaggccctggaagctgtcaaaaatgctacaaatgagcaagaccttgcaaaccgttttaaagagtttgggaaagagatggtgaaacttaactatgtagcagcaagaagacaacaggagctgaaggatcctcactgtcgggatgagatggcagccgcccgaggggctctgaagaagaatgccacaatgctgtacacggcctctcaagcatttctccgccacccagatgtcgccgctacgagagccaaccgagattatgtgttcaaacaagtccaggaggccatcgccggcatctccaatgctgctcaagctacctcgcccactgacgaagccaagggccacacgggcatcggcgagctggctgcggctcttaatgagtttgacaataagattatcctggaccccatgacgttcagcgaggccaggttccggccgtccctggaggagaggctggagagcatcatcagcggcgcagcgctgatggccgactcctcctgcacgcgagacgaccggcgcgagaggatcgtggcggagtgcaacgccgtgcggcaggcgctccaggacctgctcagcgagtacatgaataatactggaaggaaagaaaaaggagatcctctcaacattgcgattgataagatgactaagaaaacaagagatctaaggagacagcttcggaaagcagtgatggatcacatatctgactctttcctggaaaccaatgttcctttgctagttctcattgaggctgcaaagagcggaaatgaaaaggaagtgaaagaatatgcccaagttttccgtgagcatgccaacaaactggtagaggttgccaatttggcctgttccatctccaacaatgaagaaggggtgaaattagttcggatggcagccacccagattgacagcctgtgtccccaggtcatcaatgccgctctgacactggctgcccggccacagagcaaagttgctcaggataacatggacgtcttcaaagaccagtgggagaagcaggtccgagtgttgacagaggccgtggatgacatcacctcagtggatgacttcctctctgtctcagaaaatcacatcttggaggatgtgaacaagtgtgtgatagccctccaagagggcgatgtggacactctggaccggactgcaggggccatcaggggccgggcagctcgagtcatacacatcatcaatgctgagatggagaactatgaagctggggtttatactgagaaggtgttggaagctacaaaattgctttctgaaacagtgatgccacgcttcgctgaacaagtagaggttgccattgaagccctgagtgccaacgttcctcaaccgtttgaggagaatgagttcatcgatgcctctcgcctggtgtatgatggcgttcgggacatcagaaaggctgtgctgatgatcaggaccccagaagaactagaggatgattctgactttgagcaggaagattatgatgtgcgtagcaggacaagtgttcagactgaggatgaccagctcattgcagggcagagcgcacgggccatcatggcgcaactaccgcaggaggagaaggcaaaaatagctgagcaggtggagatattccatcaagagaaaagcaagctggatgcagaagtggccaaatgggacgacagcggcaatgatatcattgtactggccaagcagatgtgtatgatcatgatggaaatgacagacttcacaagaggcaaaggcccattgaaaaatacatctgatgtcattaatgctgccaagaaaattgccgaagcaggttctcgaatggacaaattagctcgtgctgtggctgatcagtgtcctgattcagcatgtaagcaggatttattagcctaccttcaacgaattgccttgtattgccatcagcttaatatctgcagcaaggtgaaggcagaagtgcagaatctgggaggagagctcattgtgtcagggctggacagtgccacatcgcttatccaggcagctaaaaacctgatgaatgctgttgtcctcacggtgaaagcatcctatgtggcctcaaccaaataccagaaggtctatgggacagcagctgtcaactcacctgttgtgtcttggaagatgaaggctccagagaagaagccccttgtgaagagagaaaagcctgaagaattccagacacgagttcgacgaggttctcagaagaaacacatttcgcctgtacaggctttaagtgaattcaaagcaatggattccttctaggacgataggttttaacaagaaagctttttctttcttttctttctttctttttctttttaattccatttttgtatgcatacctgccagctcgtatgcctctggcatggggaaattaagggaacagtgtctgtttgcatgtaagatgagatgagatcaatactactgatccatctgtagcctgggaaggagacaggacattcctgtactaaggtggcacagagctgtcctttgcaacattctcataaaattgggcacagagttcgcattggcgcaatatttatgggagtgggagggatggggaaaataaacttaactctacaaaagcaaactctaatgcatgcaagaatcattaggttggcaggtatatgcataagtgaaaaatctggaagtgtaatggtagaacataaaacttgtattgcttctgtttcagtgcaaaaatgtactagccaatacgcttaagtgtgtggcccatgaattgaacaatttaaccttgaagtctatatccgtgatattatgtcgatttttaactgaggggaaattaactagtccagcctaaaatgcttcttttaatctgcattctgtttcctcttctagttgtgccattactagtgatcatgtttttttcccccctttaatgaaaacaataaacatctatttgagacaattaaaatccttctgggggcactggaagcacaatacggtgaccaatcttgctttcatttttttttctttttaatttgaaccatgattttgctagaaatagaaggcccagtggtggaatattagagggaaggaaactgacaacgtgtgaaagttagaggcaaatacataggtgtagcttggagtgctggtatctaatataccattgtattcactaactaactcaaaataaacacatttaatcttga

SEQ ID NO: 4805 - DNA, 2583 bp, Homo sapiens
atgacttcggcaacttcacctatcattctgaaatgggaccccaaaagtttggaaatccggacgctaacagtggaaaggctgttggagccacttgttacacaggtgactacacttgtcaacacaagcaacaaaggcccatctggtaaaaagaaagggaggtcaaagaaagcccatgtactagctgcctctgtagagcaagccactcagaatttcctggaaaagggtgaacagatcgctaaggagagtcaagatctcaaagaagagttggtggctgctgtagaggatgtgcgcaaacaaggtgagacgatgcggatcgcctcctccgagtttgcagatgacccttgctcgtcggtaaagcgcggcaccatggtacgggcggcaagggctttgctctccgcggtgacacgcttactcatcctggcggacatggcagatgtcatgagacttttatcccatctgaaaattgtggaagaggccctggaagctgtcaaaaatgctacaaatgagcaagaccttgcaaaccgttttaaagagtttgggaaagagatggtgaaacttaactatgtagcagcaagaagacaacaggagctgaaggatcctcactgtcgggatgagatggcagccgcccgaggggctctgaagaagaatgccacaatgctgtacacggcctctcaagcatttctccgccacccagatgtcgccgctacgagagccaaccgagattatgtgttcaaacaagtccaggaggccatcgccggcatctccaatgctgctcaagctacctcgcccactgacgaagccaagggccacacgggcatcggcgagctggctgcggctcttaatgagtttgacaataagattatcctggaccccatgacgttcagcgaggccaggttccggccgtccctggaggagaggctggagagcatcatcagcggcgcagcgctgatggccgactcctcctgcacgcgagacgaccggcgcgagaggatcgtggcggagtgcaacgccgtgcggcaggcgctccaggacctgctcagcgagtacatgaataatactggaaggaaagaaaaaggagatcctctcaacattgcgattgataagatgactaagaaaacaagagatctaaggagacagcttcggaaagcagtgatggatcacatatctgactctttcctggaaaccaatgttcctttgctagttctcattgaggctgcaaagagcggaaatgaaaaggaagtgaaagaatatgcccaagttttccgtgagcatgccaacaaactggtagaggttgccaatttggcctgttccatctccaacaatgaagaaggggtgaaattagttcggatggcagccacccagattgacagcctgtgtccccaggtcatcaatgccgctctgacactggctgcccggccacagagcaaagttgctcaggataacatggacgtcttcaaagaccagtgggagaagcaggtccgagtgttgacagaggccgtggatgacatcacctcagtggatgacttcctctctgtctcagaaaatcacatcttggaggatgtgaacaagtgtgtgatagccctccaagagggcgatgtggacactctggaccggactgcaggggccatcaggggccgggcagctcgagtcatacacatcatcaatgctgagatggagaactatgaagctggggtttatactgagaaggtgttggaagctacaaaattgctttctgaaacagtgatgccacgcttcgctgaacaagtagaggttgccattgaagccctgagtgccaacgttcctcaaccgtttgaggagaatgagttcatcgatgcctctcgcctggtgtatgatggcgttcgggacatcagaaaggctgtgctgatgatcaggaccccagaagaactagaggatgattctgactttgagcaggaagattatgatgtgcgtagcaggacaagtgttcagactgaggatgaccagctcattgcagggcagagcgcacgggccatcatggcgcaactaccgcaggaggagaaggcaaaaatagctgagcaggtggagatattccatcaagagaaaagcaagctggatgcagaagtggccaaatgggacgacagcggcaatgatatcattgtactggccaagcagatgtgtatgatcatgatggaaatgacagacttcacaagaggcaaaggcccattgaaaaatacatctgatgtcattaatgctgccaagaaaattgccgaagcaggttctcgaatggacaaattagctcgtgctgtggctgatcagctggacagtgccacatcgcttatccaggcagctaaaaacctgatgaatgctgttgtcctcacggtgaaagcatcctatgtggcctcaaccaaataccagaaggtctatgggacagcagctgtcaactcacctgttgtgtcttggaagatgaaggctccagagaagaagccccttgtgaagagagaaaagcctgaagaattccagacacgagttcgacgaggttctcagaagaaacacatttcgcctgtacaggctttaagtgaattcaaagcaatggattccttctag

SEQ ID NO: 4806 - DNA, 3625 bp, Homo sapiens
atgacttcggcaacttcacctatcattctgaaatgggaccccaaaagtttggaaatccggacgctaacagtggaaaggctgttggagccacttgttacacaggtgactacacttgtcaacacaagcaacaaaggcccatctggtaaaaagaaagggaggtcaaagaaagcccatgtactagctgcctctgtagagcaagccactcagaatttcctggaaaagggtgaacagatcgctaaggagagtcaagatctcaaagaagagttggtggctgctgtagaggatgtgcgcaaacaaggtgagacgatgcggatcgcctcctccgagtttgcagatgacccttgctcgtcggtaaagcgcggcaccatggtacgggcggcaagggctttgctctccgcggtgacacgcttactcatcctggcggacatggcagatgtcatgagacttttatcccatctgaaaattgtggaagaggccctggaagctgtcaaaaatgctacaaatgagcaagaccttgcaaaccgttttaaagagtttgggaaagagatggtgaaacttaactatgtagcagcaagaagacaacaggagctgaaggatcctcactgtcgggatgagatggcagccgcccgaggggctctgaagaagaatgccacaatgctgtacacggcctctcaagcatttctccgccacccagatgtcgccgctacgagagccaaccgagattatgtgttcaaacaagtccaggaggccatcgccggcatctccaatgctgctcaagctacctcgcccactgacgaagccaagggccacacgggcatcggcgagctggctgcggctcttaatgagtttgacaataagattatcctggaccccatgacgttcagcgaggccaggttccggccgtccctggaggagaggctggagagcatcatcagcggcgcagcgctgatggccgactcctcctgcacgcgagacgaccggcgcgagaggatcgtggcggagtgcaacgccgtgcggcaggcgctccaggacctgctcagcgagtacatgaataatactggaaggaaagaaaaaggagatcctctcaacattgcgattgataagatgactaagaaaacaagagatctaaggagacagcttcggaaagcagtgatggatcacatatctgactctttcctggaaaccaatgttcctttgctagttctcattgaggctgcaaagagcggaaatgaaaaggaagtgaaagaatatgcccaagttttccgtgagcatgccaacaaactggtagaggttgccaatttggcctgttccatctccaacaatgaagaaggggtgaaattagttcggatggcagccacccagattgacagcctgtgtccccaggtcatcaatgccgctctgacactggctgcccggccacagagcaaagttgctcaggataacatggacgtcttcaaagaccagtgggagaagcaggtccgagtgttgacagaggccgtggatgacatcacctcagtggatgacttcctctctgtctcagaaaatcacatcttggaggatgtgaacaagtgtgtgatagccctccaagagggcgatgtggacactctggaccggactgcaggggccatcaggggccgggcagctcgagtcatacacatcatcaatgctgagatggagaactatgaagctggggtttatactgagaaggtgttggaagctacaaaattgctttctgaaacagtgatgccacgcttcgctgaacaagtagaggttgccattgaagccctgagtgccaacgttcctcaaccgtttgaggagaatgagttcatcgatgcctctcgcctggtgtatgatggcgttcgggacatcagaaaggctgtgctgatgatcaggaccccagaagaactagaggatgattctgactttgagcaggaagattatgatgtgcgtagcaggacaagtgttcagactgaggatgaccagctcattgcagggcagagcgcacgggccatcatggcgcaactaccgcaggaggagaaggcaaaaatagctgagcaggtggagatattccatcaagagaaaagcaagctggatgcagaagtggccaaatgggacgacagcggcaatgatatcattgtactggccaagcagatgtgtatgatcatgatggaaatgacagacttcacaagaggcaaaggcccattgaaaaatacatctgatgtcattaatgctgccaagaaaattgccgaagcaggttctcgaatggacaaattagctcgtgctgtggctgatcagtgtcctgattcagcatgtaagcaggatttattagcctaccttcaacgaattgccttgtattgccatcagcttaatatctgcagcaaggtgaaggcagaagtgcagaatctgggaggagagctcattgtgtcagggctggacagtgccacatcgcttatccaggcagctaaaaacctgatgaatgctgttgtcctcacggtgaaagcatcctatgtggcctcaaccaaataccagaaggtctatgggacagcagctgtcaactcacctgttgtgtcttggaagatgaaggctccagagaagaagccccttgtgaagagagaaaagcctgaagaattccagacacgagttcgacgaggttctcagaagaaacacatttcgcctgtacaggctttaagtgaattcaaagcaatggattccttctaggacgataggttttaacaagaaagctttttctttcttttctttctttctttttctttttaattccatttttgtatgcatacctgccagctcgtatgcctctggcatggggaaattaagggaacagtgtctgtttgcatgtaagatgagatgagatcaatactactgatccatctgtagcctgggaaggagacaggacattcctgtactaaggtggcacagagctgtcctttgcaacattctcataaaattgggcacagagttcgcattggcgcaatatttatgggagtgggagggatggggaaaataaacttaactctacaaaagcaaactctaatgcatgcaagaatcattaggttggcaggtatatgcataagtgaaaaatctggaagtgtaatggtagaacataaaacttgtattgcttctgtttcagtgcaaaaatgtactagccaatacgcttaagtgtgtggcccatgaattgaacaatttaaccttgaagtctatatccgtgatattatgtcgatttttaactgaggggaaattaactagtccagcctaaaatgcttcttttaatctgcattctgtttcctcttctagttgtgccattactagtgatcatgtttttttcccccctttaatgaaaacaataaacatctatttgagacaattaaaatccttctgggggcactggaagcacaatacggtgaccaatcttgctttcatttttttttctttttaatttgaaccatgattttgctagaaatagaaggcccagtggtggaatattagagggaaggaaactgacaacgtgtgaaagttagaggcaaatacataggtgtagcttggagtgctggtatctaatataccattgtattcactaactaactcaaaataaacacatttaatcttg

SEQ ID NO: 4807 - DNA, 697 bp, Homo sapiens
atcataagccaaattgtgagccatgatagtggcactgaatttctaaatacaagaaattgcttagacaattggtttagtatctgtatatgggcaatactctgtcctgcagtaggcagcatgtcagctgaaacaccaatcacattgaatatcgatcctcaggatctgcaggtccaaacattcaccgtggagaagctactggagcctctcataatccaggttaccacacttgtaaactgtccccagaacccttccagcaggaaaaaaggacgttcgaaaagagccagtgtccttctagcttctgtggaggaagcaacttggaatttattagacaagggagagaagattgcccaggaagctacagttttaaaggatgagcttacggcttcacttgaggaagttcgcaaagaaagtgaagctctgaaagtatcagctgagagatttacagatgacccctgttttctcccaaaaagggaggctgtggttcaagctgcccgtgccttgctggctgcggtgacgagactccttatccttgcggacatgattgatgtcatgtgcctcttgcaacatgtgtcagcttttcaaaggacatttgagtctctcaaaaatgttgccaacaaatctgacctccagaaaacctaccagaagcttgggaaggagctggaaaatttggattatttagccttcaaacgtcagcagg

SEQ ID NO: 4808 - DNA, 1083 bp, Homo sapiens
aagcaggaaagcttatttataacttgaagggcctcattatctgactgagtagtctgtctcttttttgatagattttcttttccatctttgtggtcagactaatacaccttctgtctacttccaatttactgtaaactgggtcatggaattcaggctaagatgactcaactgcctgaggcagaaaaagaaaagattgctgagcaagttgctgatttcaagaaagtaaagagtaagctggatgctgagattgagatatgggatgatacaagcaacgacatcattgttctggccaagaacatgtgtatgatcatgatggagatgacagacttcactaggggcaaaggaccactaaagcatacaactgatgtgatctatgcagcgaaaatgatatcagaatcaggatcaaggatggatgtccttgctcggcagattgctaatcagtgcccagatccatcttgtaaacaggacttgttggcctacctggaacagattaagttctactcccaccaactgaaaatctgcagtcaagttaaagctgagatccagaacctgggaggagagctcatcatgtcagctttggacagtgtcacatccctgatccaagcagccaaaaatttaatgaatgctgtagtgcaaacagtgaaaatgtcttacattgcctcaaccaagatcatccgaatccagagtcctgctgggccccggcacccagttgtgatgtggagaatgaaggctcctgcaaaaaaacccttgattaaaagagagaagccagaggaaacgtgtgcagctgtcagacgaggctcagcaaagaaaaaaatccatccattgcaagtcatgagtgaatttagaggaagacaaatctactgaaaccactattctacatatagtgcctatatgacaaaatcctgcctaaccacactgctttattttacacttaagaagttctgtaatttcactaagttttggtgtttaactcacaaataacataaaatattgggcgctaaatcaacaaaagcaatatatatttgggatcatatcactgtcatttctgtatggtcagcacctaatagttaaggaatatttgct

SEQ ID NO: 4809 - DNA, 2999 bp, Homo sapiens
atgtcagctgaaacaccaatcacattgaatatcgatcctcaggatctgcaggtccaaacattcaccgtggagaagctactggagcctctcataatccaggttaccacacttgtaaactgtccccagaacccttccagcaggaaaaaaggacgttcgaaaagagccagtgtccttctagcttctgtggaggaagcaacttggaatttattagacaagggagagaagattgcccaggaagctacagttttaaaggatgagcttacggcttcacttgaggaagttcgcaaagaaagtgaagctctgaaagtatcagctgagagatttacagatgacccctgttttctcccaaaaagggaggctgtggttcaagctgcccgtgccttgctggctgcggtgacgagactccttatccttgcggacatgattgatgtcatgtgcctcttgcaacatgtgtcagcttttcaaaggacatttgagtctctcaaaaatgttgccaacaaatctgacctccagaaaacctaccagaagcttgggaaggagctggaaaatttggattatttagccttcaaacgtcagcaggacttaaaatctccaaatcagagagatgaaattgcaggagcccgagcttcactgaaggagaactctcccctcttgcattcaatttgttcagcttgtttggagcattctgatgttgcttccctcaaagcaagcaaggacacagtttgtgaagaaattcagaatgctctcaatgtaatttcaaatgcttcacaagggatccagaatatgacaaccccaccagaacctcaggcagcaaccctgggaagtgcccttgatgagctggagaatttaattgtcctgaatccactcacagtaactgaggaggaaatacgaccatcactagagaaacgccttgaagccattatcagtggggctgctctgctggcggattcttcatgtacgagggacttacaccgagagcggattatcgcagaatgcaacgccattcgccaggctcttcaggatctgctttcagagtacatgaacaacgctggaaaaaaagaaaggagtaataccctgaatattgctttagacaacatgtgtaagaagacaagagaccttcgcagacagctccgcaaggctattatagatcatgtgtcagactctttcctggatacgacagtccctcttttggttctcattgaagctgctaagaatggccgggaaaaggaaataaaagaatatgctgcgatatttcatgaacacaccagcaggcttgtagaggtggcaaatcttgcttgttccatgtcaacaaatgaagatggaattaaaattgtcaaaattgcagccaatcatttggaaaccttgtgtccacagattattaatgctgcacttgctttggctgcaagacccaaaagtcaagcggtcaaaaacaccatggaaatgtacaagcgtacatgggagaatcatatacatgtcctcactgaagccgtagatgacattacaagcattgatgacttccttgctgtatctgaaagccatatcttggaagatgtcaacaagtgtatcatagccttaagagaccaggatgctgataatttagaccgtgctgcgggtgctatcagaggccgggcagcaagagttgctcacatcgtcacgggtgaaatggacagttacgagccaggggcttacacggaaggtgtaatgagaaatgttaacttccttacaagtactgtaattcctgaatttgtaacacaagtgaatgttgccttggaagccttaagcaaaagctcattgaatgtgttggatgataatcaatttgtggacatctcaaagaagatctatgatacaattcatgatatcagatgttcagtcatgatgattcggaccccagaggaactggaggatgtttctgaccttgaagaggaacacgaggtccgcagtcacaccagcattcagaccgaagggaaaactgatagggctaagatgactcaactgcctgaggcagaaaaagaaaagattgctgagcaagttgctgatttcaagaaagtaaagagtaagctggatgctgagattgagatatgggatgatacaagcaacgacatcattgttctggccaagaacatgtgtatgatcatgatggagatgacagacttcactaggggcaaaggaccactaaagcatacaactgatgtgatctatgcagcgaaaatgatatcagaatcaggatcaaggatggatgtccttgctcggcagattgctaatcagtgcccagatccatcttgtaaacaggacttgttggcctacctggaacagattaagttctactcccaccaactgaaaatctgcagtcaagttaaagctgagatccagaacctgggaggagagctcatcatgtcagctttggacagtgtcacatccctgatccaagcagccaaaaatttaatgaatgctgtagtgcaaacagtgaaaatgtcttacattgcctcaaccaagatcatccgaatccagagtcctgctgggccccggcacccagttgtgatgtggagaatgaaggctcctgcaaaaaaacccttgattaaaagagagaagccagaggaaacgtgtgcagctgtcagacgaggctcagcaaagaaaaaaatccatccattgcaagtcatgagtgaatttagaggaagacaaatctactgaaaccactattctacatatagtgcctatatgacaaaatcctgcctaaccacactgctttattttacacttaagaagttctgtaatttcactaagttttggtgtttaactcacaaataacataaaatattgggcgctaaatcaacaaaagcaatatatatttgggatcatatcactgtcatttctgtatggtcagcacctaatagttaaggaatatttgcttgttgaatgaatgaaattatcacgtgtcattcagcgtttcccatcatagagattatctactattcgttaccaaataaacacaggagaggcca

SEQ ID NO: 4810 - DNA, 3232 bp, Homo sapiens
caacgctcagcgaaattgactgccccactgtcatctgcctctcaatttggtactctgtaactctgtgaccaccaagaagcctttttccgtcccccacaaagctctttttggaaaattccctacgggagctgaattttaagcccatttactttataggaagaaacagaaaggcagcatgtcagctgaaacaccaatcacattgaatatcgatcctcaggatctgcaggtccaaacattcaccgtggagaagctactggagcctctcataatccaggttaccacacttgtaaactgtccccagaacccttccagcaggaaaaaaggacgttcgaaaagagccagtgtccttctagcttctgtggaggaagcaacttggaatttattagacaagggagagaagattgcccaggaagctacagttttaaaggatgagcttacggcttcacttgaggaagttcgcaaagaaagtgaagctctgaaagtatcagctgagagatttacagatgacccctgttttctcccaaaaagggaggctgtggttcaagctgcccgtgccttgctggctgcggtgacgagactccttatccttgcggacatgattgatgtcatgtgcctcttgcaacatgtgtcagcttttcaaaggacatttgagtctctcaaaaatgttgccaacaaatctgacctccagaaaacctaccagaagcttgggaaggagctggaaaatttggattatttagccttcaaacgtcagcaggacttaaaatctccaaatcagagagatgaaattgcaggagcccgagcttcactgaaggagaactctcccctcttgcattcaatttgttcagcttgtttggagcattctgatgttgcttccctcaaagcaagcaaggacacagtttgtgaagaaattcagaatgctctcaatgtaatttcaaatgcttcacaagggatccagaatatgacaaccccaccagaacctcaggcagcaaccctgggaagtgcccttgatgagctggagaatttaattgtcctgaatccactcacagtaactgaggaggaaatacgaccatcactagagaaacgccttgaagccattatcagtggggctgctctgctggcggattcttcatgtacgagggacttacaccgagagcggattatcgcagaatgcaacgccattcgccaggctcttcaggatctgctttcagagtacatgaacaacgctggaaaaaaagaaaggagtaataccctgaatattgctttagacaacatgtgtaagaagacaagagaccttcgcagacagctccgcaaggctattatagatcatgtgtcagactctttcctggatacgacagtccctcttttggttctcattgaagctgctaagaatggccgggaaaaggaaataaaagaatatgctgcgatatttcatgaacacaccagcaggcttgtagaggtggcaaatcttgcttgttccatgtcaacaaatgaagatggaattaaaattgtcaaaattgcagccaatcatttggaaaccttgtgtccacagattattaatgctgcacttgctttggctgcaagacccaaaagtcaagcggtcaaaaacaccatggaaatgtacaagcgtacatgggagaatcatatacatgtcctcactgaagccgtagatgacattacaagcattgatgacttccttgctgtatctgaaagccatatcttggaagatgtcaacaagtgtatcatagccttaagagaccaggatgctgataatttagaccgtgctgcgggtgctatcagaggccgggcagcaagagttgctcacatcgtcacgggtgaaatggacagttacgagccaggggcttacacggaaggtgtaatgagaaatgttaacttccttacaagtactgtaattcctgaatttgtaacacaagtgaatgttgccttggaagccttaagcaaaagctcattgaatgtgttggatgataatcaatttgtggacatctcaaagaagatctatgatacaattcatgatatcagatgttcagtcatgatgattcggaccccagaggaactggaggatgtttctgaccttgaagaggaacacgaggtccgcagtcacaccagcattcagaccgaagggaaaactgatagggctaagatgactcaactgcctgaggcagaaaaagaaaagattgctgagcaagttgctgatttcaagaaagtaaagagtaagctggatgctgagattgagatatgggatgatacaagcaacgacatcattgttctggccaagaacatgtgtatgatcatgatggagatgacagacttcactaggggcaaaggaccactaaagcatacaactgatgtgatctatgcagcgaaaatgatatcagaatcaggatcaaggatggatgtccttgctcggcagattgctaatcagtgcccagatccatcttgtaaacaggacttgttggcctacctggaacagattaagttctactcccaccaactgaaaatctgcagtcaagttaaagctgagatccagaacctgggaggagagctcatcatgtcagctttggacagtgtcacatccctgatccaagcagccaaaaatttaatgaatgctgtagtgcaaacagtgaaaatgtcttacattgcctcaaccaagatcatccgaatccagagtcctgctgggccccggcacccagttgtgatgtggagaatgaaggctcctgcaaaaaaacccttgattaaaagagagaagccagaggaaacgtgtgcagctgtcagacgaggctcagcaaagaaaaaaatccatccattgcaagtcatgagtgaatttagaggaagacaaatctactgaaaccactattctacatatagtgcctatatgacaaaatcctgcctaaccacactgctttattttacacttaagaagttctgtaatttcactaagttttggtgtttaactcacaaataacataaaatattgggcgctaaatcaacaaaagcaatatatatttgggatcatatcactgtcatttctgtatggtcagcacctaatagttaaggaatatttgcttgttgaatgaatgaaattatcacgtgtcattcagcgtttcccatcatagagattatctactattcgttaccaaataaacacaggagaggccagagagtcctgtttatctgtaatacttcatgtacacttatcatccttatcttgaattaa

SEQ ID NO: 4811 - DNA, 2363 bp, Homo sapiens
agggtgcttgtcaggctgtttgcttacagatgcatcataagccaaattgtgagccatgatagtggcactgaatttctaaatacaagaaattgcttagacaattggtttagtatctgtatatgggcaatactctgtcctgcagtagctgaatcgctgagaaaagagaccatgtttctacttttagaaggagaatgaaatcaacgcaaaggagagagaaacaaggcagcatgtcagctgaaacaccaatcacattgaatatcgatcctcaggatctgcaggtccaaacattcaccgtggagaagctactggagcctctcataatccaggttaccacacttgtaaactgtccccagaacccttccagcaggaaaaaaggacgttcgaaaagagccagtgtccttctagcttctgtggaggaagcaacttggaatttattagacaagggagagaagattgcccaggaagctacagttttaaaggatgagcttacggcttcacttgaggaagttcgcaaagaaagtgaagctctgaaagtatcagctgagagatttacagatgacccctgttttctcccaaaaagggaggctgtggttcaagctgcccgtgccttgctggctgcggtgacgagactccttatccttgcggacatgattgatgtcatgtgcctcttgcaacatgtgtcagcttttcaaaggacatttgagtctctcaaaaatgttgccaacaaatctgacctccagaaaacctaccagaagcttgggaaggagctggaaaatttggattatttagccttcaaacgtcagcaggacttaaaatctccaaatcagagagatgaaattgcaggagcccgagcttcactgaaggagaactctcccctcttgcattcaatttgttcagcttgtttggagcattctgatgttgcttccctcaaagcaagcaaggacacagtttgtgaagaaattcagaatgctctcaatgtaatttcaaatgcttcacaagggatccagaatatgacaaccccaccagaacctcaggcagcaaccctgggaagtgcccttgatgagctggagaatttaattgtcctgaatccactcacagtaactgaggaggaaatacgaccatcactagagaaacgccttgaagccattatcagtggggctgctctgctggcggattcttcatgtacgagggacttacaccgagagcggattatcgcagaatgcaacgccattcgccaggctcttcaggatctgctttcagagtacatgaacaacctctgtaatcaaaagtctgacctgggcctcactggagtaaaaatcaaattgttggaggaatgcattattttctggagtctctagggaagagtccattatttttgccttttccagtttctagaggtcaccctcattccttggctcatggccctctgcctccatcttctaagccagcaacgtcatgtttctctgaccctgcttccaacctcacatctctttctctgaccacaccttggaaagattctcttctttttaggactcatgtgattagtgggagccacccagattatccaggataatcctcccatctgaaggcccttaaccttaattacatctgcaaaatccctcttgccatgtcaggtaacatattcataggttctgggaatttgaatgtggacatctctgggagactcacaacattatatcaatactagtcttccctagtctctttggtggaatcattatcaatcctttcatttcgaatccattatagacagcatccctcatacactttaagctctgtgcaggcagatcacatgtctgttttgtttagttttatcccaagcctcaggcacaatgcatagaatttagaaaaagctgaattgtatttttggatgaaagagtgaatgaaatgattgcatgttgtatatgccatgtaatggagaaacagcctctctgacattaactgaaatgagtttcaagcatctactacatttatacaatggactgcctgttataaaaggtcttattttgcaaagcattaaatctcttctggaaatcaatgtaaatatccagaaataaattcttttttatcttaatctctgcatttggatgtgttagataggtgacatataattattagtaaagttaatattcaggtgatacatgactataggggattattagaactgagtgagagataatgctgctagagtaaacaagtcagatctgagctccatgcaggaactaatttgcatttctggacctctcatccacccacttgtttcttctcttggtgttttatgtggaagcacattgttggttctcattacgtatttgctgagtgaataaagaatcaaatggactggc

SEQ ID NO: 4812 - DNA, 745 bp, Homo sapiens
gtggcactgaatttctaaatacaagaaattgcttagacaattggtttagtatctgtatatgggcaatactctgtcctgcagtagctgaatcgctgagaaaagagaccatgtttctacttttagaaggagaatgaaatcaacgcaaaggagagagaaacaaggcagcatgtcagctgaaacaccaatcacattgaatatcgatcctcaggatctgcaggtccaaacattcaccgtggagaagctactggagcctctcataatccaggttaccacacttgtaaactgtccccagaacccttccagcaggaaaaaaggacgttcgaaaagagccagtgtccttctagcttctgtggaggaagcaacttggaatttattagacaagggagagaagattgcccaggaagctacagttttaaaggatgagcttacggcttcacttgaggaagttcgcaaagaaagtgaagctctgaaagtatcagctgagagatttacagatgacccctgttttctcccaaaaagggaggctgtggttcaagctgcccgtgccttgctggctgcggtgacgagactccttatccttgcggacatgattgatgtcatgtgcctcttgcaacatgtgtcagcttttcaaaggacatttgagtctctcaaaaatgttgccaacaaatctgacctccagaaaacctaccagaagcttgggaaggagctggaaaatttggattatttagccttcaaacgtcagcag

SEQ ID NO: 4813 - DNA, 1131 bp, Homo sapiens
atgtcagctgaaacaccaatcacattgaatatcgatcctcaggatctgcaggtccaaacattcaccgtggagaagctactggagcctctcataatccaggttaccacacttgtaaactgtccccagaacccttccagcaggaaaaaaggacgttcgaaaagagccagtgtccttctagcttctgtggaggaagcaacttggaatttattagacaagggagagaagattgcccaggaagctacagttttaaaggatgagcttacggcttcacttgaggaagttcgcaaagaaagtgaagctctgaaagtatcagctgagagatttacagatgacccctgttttctcccaaaaagggaggctgtggttcaagctgcccgtgccttgctggctgcggtgacgagactccttatccttgcggacatgattgatgtcatgtgcctcttgcaacatgtgtcagcttttcaaaggacatttgagtctctcaaaaatgttgccaacaaatctgacctccagaaaacctaccagaagcttgggaaggagctggaaaatttggattatttagccttcaaacgtcagcaggacttaaaatctccaaatcagagagatgaaattgcaggagcccgagcttcactgaaggagaactctcccctcttgcattcaatttgttcagcttgtttggagcattctgatgttgcttccctcaaagcaagcaaggacacagtttgtgaagaaattcagaatgctctcaatgtaatttcaaatgcttcacaagggatccagaatatgacaaccccaccagaacctcaggcagcaaccctgggaagtgcccttgatgagctggagaatttaattgtcctgaatccactcacagtaactgaggaggaaatacgaccatcactagagaaacgccttgaagccattatcagtggggctgctctgctggcggattcttcatgtacgagggacttacaccgagagcggattatcgcagaatgcaacgccattcgccaggctcttcaggatctgctttcagagtacatgaacaacctctgtaatcaaaagtctgacctgggcctcactggagtaaaaatcaaattgttggaggaatgcattattttctggagtctctag

SEQ ID NO: 4814 - DNA, 2490 bp, Homo sapiens
cctgtcgccgccgcctcgggcgggtgggctgactggcggcaggctcgccgcggcgcggagtcccggctgcgggatagaccgagggccatggccgcctctcccggacccgccggcgttggcggcgccggagcagtctacggctccggctcttcgggcttcgccctcgactcgggactggagatcaaaactcgctcggtggagcagacgctactcccgctggtttctcagatcaccacgcttattaatcataaagataataccaaaaagtctgataaaactctgcaagcaattcagcgtgtaggacaagctgtcaacttggcagttggaagatttgttaaagtaggagaagctatagccaatgaaaactgggatttgaaagaagaaataaatattgcttgtattgaagctaaacaagcaggagaaacaattgcagcacttacagacataaccaacttgaaccatctggaatctgatgggcagatcacaatttttacagacaaaacaggagtgataaaggctgcaagattacttctttcttcagtgacaaaagtgttgttgctggcagaccgagtagtcattaaacagataataacatcaagaaataaggttctcgcaactatggaaagactagagaaagtgaatagctttcaagagtttgtccaaatattcagtcaatttggaaatgaaatggtggagtttgcacatctgagtggagatagacaaaatgatttgaaagatgaaaagaaaaaggcaaaaatggcagcagctagggcagttcttgaaaagtgtacaatgatgcttctcacagcttcaaagacatgtctgaggcatcctaactgcgaatcagcccataaaaacaaagaaggagtatttgaccgtatgaaagtggcattggataaggtcattgaaattgtgactgactgtaaaccgaatggagagactgacatttcatctatcagtatttttactggaattaaggaattcaagatgaatattgaagctcttcgggagaatctttattttcagtccaaagagaacctttctgtgacattggaagtcatcttggagcgtatggaggactttactgattctgcctacaccagccatgagcacagagaacgcatcttggaactgtcaactcaggcgagaatggaactgcagcagttaatttctgtgtggattcaagctcaaagcaagaaaacaaaaagcatcgctgaagaactggaactcagtattttgaaaatcagtcacagtcttaatgaacttaagaaagaacttcatagtacagcgacacagctggcagcagatctattaaaataccatgctgatcatgtggttctaaaagcattaaaacttactggagtagaaggaaatttagaagctttggctgaatatgcctgtaaactctctgaacagaaagagcagcttgttgagacctgtcgattgttacgacacatatctgggacagaacctctggaaataacctgtatacatgcagaggagacatttcaggtgactggccaacagataatttctgctgctgaaacattgacattgcatccatctagtaaaattgctaaagaaaacctagatgtattttgtgaagcttgggaatcccaaattagtgacatgtcaacactgctgagagaaatcaatgacgtgtttgaaggaagacgaggagagaagtatggctacctttcacttccaaagccaatgaagaataatgcaaacctgaaatcattaaagccagacaagcctgactctgaggagcaagccaagatagcaaagcttggacttaagctgggtttgctcacctctgacgctgactgcgaaattgagaagtgggaagatcaggagaatgagattgttcaatatggacggaacatgtccagtatggcctattctctgtatttatttactagaggagaggggccactgaaaacttcccaggatttaattcatcaactagaggtttttgctgcagagggtttaaagcttacttccagtgttcaagctttttcaaaacagctgaaagacgatgacaagcttatgcttctcctggaaataaacaagctaattcctctatgccaccagctccagacagtaactaagacttctttgcagaataaagtatttctaaaggttgacaagtgtattacgaagacaagatccatgatggctctcttagtccaacttctttcactttgttataaactgctgaagaagcttcagatggaaaataacggatgggtctcagttacaaataaggacactatggatagtaaaacttgagaagcttttggggtcagatctctggaacatcatgtgatgaagctgacatttttaaaaatcaaatgatcctttatcttttcagaaattcatcaattttataaagaaaacaatattgaaattttgctctattttctgatcatgaaactgattgtaaagctttttgacaactaataaatgtcttggtaattgctagattct

SEQ ID NO: 4815 - DNA, 2201 bp, Homo sapiens
gactggcggcaggctcgccgcggcgcggagtcccggctgcgggatagaccgagggccatggccgcctctcccggacccgccggcgttggcggcgccggagcagtctacggctccggctcttcgggcttcgccctcgactcgggactggagatcaaaactcgctcggtggagcagacgctactcccgctggtttctcagatcaccacgcttattaatcataaagataataccaaaaagtctgataaaactctgcaagcaattcagcgtgtaggacaagctgtcaacttggcagttggaagatttgttaaagtaggagaagctatagccaatgaaaactgggatttgaaagaagaaataaatattgcttgtattgaagctaaacaagcaggagaaacaattgcagcacttacagacataaccaacttgaaccatctggaatctgatgggcagatcacaatttttacagacaaaacaggagtgataaaggctgcaagattacttctttcttcagtgacaaaagtgttgttgctggcagaccgagtagtcattaaacagataataacatcaagaaataaggttctcgcaactatggaaagactagagaaagtgaatagctttcaagagtttgtccaaatattcagtcaatttggaaatgaaatggtggagtttgcacatctgagtggagatagacaaaatgatttgaaagatgaaaagaaaaaggcaaaaatggcagcagctagggcagttcttgaaaagtgtacaatgatgcttctcacagcttcaaagacatgtctgaggcatcctaactgcgaatcagcccataaaaacaaagaaggagtatttgaccgtatgaaagtggcattggataaggtcattgaaattgtgactgactgtaaaccgaatggagagactgacatttcatctatcagtatttttactggaattaaggaattcaagatgaatattgaagctcttcgggagaatctttattttcagtccaaagagaacctttctgtgacattggaagtcatcttggagcgtatggaggactttactgattctgcctacaccagccatgagcacagagaacgcatcttggaactgtcaactcaggcgagaatggaactgcagcagttaatttctgtgtggattcaagctcaaagcaagaaaacaaaaagcatcgctgaagaactggaactcagtattttgaaaatcagtcacagtcttaatgaacttaagaaagaaataatttctgctgctgaaacattgacattgcatccatctagtaaaattgctaaagaaaacctagatgtattttgtgaagcttgggaatcccaaattagtgacatgtcaacactgctgagagaaatcaatgacgtgtttgaaggaagacgaggagagaagtatggctacctttcacttccaaagccaatgaagaataatgcaaacctgaaatcattaaagccagacaagcctgactctgaggagcaagccaagatagcaaagcttggacttaagctgggtttgctcacctctgacgctgactgcgaaattgagaagtgggaagatcaggagaatgagattgttcaatatggacggaacatgtccagtatggcctattctctgtatttatttactagaggagaggggccactgaaaacttcccaggatttaattcatcaactagaggtttttgctgcagagggtttaaagcttacttccagtgttcaagctttttcaaaacagctgaaagacgatgacaagcttatgcttctcctggaaataaacaagctaattcctctatgccaccagctccagacagtaactaagacttctttgcagaataaagtatttctaaaggttgacaagtgtattacgaagacaagatccatgatggctctcttagtccaacttctttcactttgttataaactgctgaagaagcttcagatggaaaataacggatgggtctcagttacaaataaggacactatggatagtaaaacttgagaagcttttggggtcagatctctggaacatcatgtgatgaagctgacatttttaaaaatcaaatgatcctttatcttttcagaaattcatcaattttataaagaaaacaatattgaaattttgctctattttctgatcatgaaactgattgtaaagctttttgacaactaataaatgtcttggtaattgct

SEQ ID NO: 4816 - DNA, 761 bp, Homo sapiens
gggcgggtgggctgactggcggcaggctcgccgcggcgcggagtcccggctgcgggatagaccgagggccatggccgcctctcccggacccgccggcgttggcggcgccggagcagtctacggctccggctcttcgggcttcgccctcgactcgggactggagatcaaaactcgctcggtggagcagacgctactcccgctggtttctcagatcaccacgcttattaatcataaagataataccaaaaagtctgataaaactctgcaagcaattcagcgtgtaggacaagctgtcaacttggcagttggaagatttgttaaagtaggagaagctatagccaatgaaaactgggatttgaaagaagaaataaatattgcttgtattgaagctaaacaagcaggagaaacaattgcagcacttacagacataaccaacttgaaccatctggaatctgatgggcagatcacaatttttacagacaaaacaggagtgataaaggctgcaagattacttctttcttcagtgacaaaagtgttgttgctggcagaccgagtagtcattaaacagataataacatcaagaaataagagactaacaatatataacttaagacacagttaaatcagtggaaatgataattatccacaactacaaaatttctgtactcagagtccctaaatgttactgaataatctcaaaacttacagaacagatttaaactcttccagtccagaagttaatctctcagatgatggtcatg

SEQ ID NO: 4817 - DNA, 824 bp, Homo sapiens
catcaatcctggccagctgattctcctctttaccagaacaccattgagcttagtacagaagaataatgcaaacctgaaatcattaaagccagacaagcctgactctgaggagcaagccaagatagcaaagcttggacttaagctgggtttgctcacctctgacgctgactgcgaaattgagaagtgggaagatcaggagaatgagattgttcaatatggacggaacatgtccagtatggcctattctctgtatttatttactagaggagaggggccactgaaaacttcccaggatttaattcatcaactagaggtttttgctgcagagggtttaaagcttacttccagtgttcaagctttttcaaaacagctgaaagacgatgacaagcttatgcttctcctggaaataaacaagctaattcctctatgccaccagctccagacagtaactaagacttctttgcagaataaagtatttctaaaggttgacaagtgtattacgaagacaagatccatgatggctctcttagtccaacttctttcactttgttataaactgctgaagaagcttcagatggaaaataacggatgggtctcagttacaaataaggacactatggatagtaaaacttgagaagcttttggggtcagatctctggaacatcatgtgatgaagctgacatttttaaaaatcaaatgatcctttatcttttcagaaattcatcaattttataaagaaaacaatattgaaattttgctctattttctgatcatgaaactgattgtaaagctttttgacaactaataaatgtcttggtaattgc

SEQ ID NO: 4818 - DNA, 2520 bp, Homo sapiens
ccgccgcctcgggcgggtgggctgactggcggcaggctcgccgcggcgcggagtcccggctgcgggatagaccgagggccatggccgcctctcccggacccgccggcgttggcggcgccggagcagtctacggctccggctcttcgggcttcgccctcgactcgggactggagatcaaaactcgctcggtggagcagacgctactcccgctggtttctcagatcaccacgcttattaatcataaagataataccaaaaagtctgataaaactctgcaagcaattcagcgtgtaggacaagctgtcaacttggcagttggaagatttgttaaagtaggagaagctatagccaatgaaaactgggatttgaaagaagaaataaatattgcttgtattgaagctaaacaagcaggagaaacaattgcagcacttacagacataaccaacttgaaccatctggaatctgatgggcagatcacaatttttacagacaaaacaggagtgataaaggctgcaagattacttctttcttcagtgacaaaagtgttgttgctggcagaccgagtagtcattaaacagataataacatcaagaaataaggttctcgcaactatggaaagactagagaaagtgaatagctttcaagagtttgtccaaatattcagtcaatttggaaatgaaatggtggagtttgcacatctgagtggagatagacaaaatgatttgaaagatgaaaagaaaaaggcaaaaatggcagcagctagggcagttcttgaaaagtgtacaatgatgcttctcacagcttcaaagacatgtctgaggcatcctaactgcgaatcagcccataaaaacaaagaaggagtatttgaccgtatgaaagtggcattggataaggtcattgaaattgtgactgactgtaaaccgaatggagagactgacatttcatctatcagtatttttactggaattaaggaattcaagatgaatattgaagctcttcgggagaatctttattttcagtccaaagagaacctttctgtgacattggaagtcatcttggagcgtatggaggactttactgattctgcctacaccagccatgagcacagagaacgcatcttggaactgtcaactcaggcgagaatggaactgcagcagttaatttctgtgtggattcaagctcaaagcaagaaaacaaaaagcatcgctgaagaactggaactcagtattttgaaaatcagtcacagtcttaatgaacttaagaaagaacttcatagtacagcgacacagctggcagcagatctattaaaataccatgctgatcatgtggttctaaaagcattaaaacttactggagtagaaggaaatttagaagctttggctgaatatgcctgtaaactctctgaacagaaagagcagcttgttgagacctgtcgattgttacgacacatatctgggacagaacctctggaaataacctgtatacatgcagaggagacatttcaggtgactggccaacagataatttctgctgctgaaacattgacattgcatccatctagtaaaattgctaaagaaaacctagatgtattttgtgaagcttgggaatcccaaattagtgacatgtcaacactgctgagagaaatcaatgacgtgtttgaaggaagacgaggagagaagtatggctacctttcacttccaaagccaatgaagaataatgcaaacctgaaatcattaaagccagacaagcctgactctgaggagcaagccaagatagcaaagcttggacttaagctgggtttgctcacctctgacgctgactgcgaaattgagaagtgggaagatcaggagaatgagattgttcaatatggacggaacatgtccagtatggcctattctctgtatttatttactagaggagaggggccactgaaaacttcccaggatttaattcatcaactagaggtttttgctgcagagggtttaaagcttacttccagtgttcaagctttttcaaaacagctgaaagacgatgacaagcttatgcttctcctggaaataaacaagctaattcctctatgccaccagctccagacagtaactaagacttctttgcagaataaagtatttctaaaggttgacaagtgtattacgaagacaagatccatgatggctctcttagtccaacttctttcactttgttataaactgctgaagaagagtgaaaccagatactaattgtcttaactctttccagcttcagatggaaaataacggatgggtctcagttacaaataaggacactatggatagtaaaacttgagaagcttttggggtcagatctctggaacatcatgtgatgaagctgacatttttaaaaatcaaatgatcctttatcttttcagaaattcatcaattttataaagaaaacaatattgaaattttgctctattttctgatcatgaaactgattgtaaagctttttgacaactaataaatgtcttggtaattgctagattct

SEQ ID NO: 4819 - DNA, 6135 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 4820 - DNA, 6286 bp, Homo sapiens
ggctgacatcacttaggaaagcgaagggggtagggctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggtgtgtggcttttgaagaaaatgtatgtactgacgggaaaaggaggataagcaagtcgaatttttgtcttacgctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagatgagtggttctccagagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataacaactattccacaccaaatgagagaggagaccacaatagaacactggatcgatcgggggatctaggcgacatggagccattgaagggaacaacacccttgatgcaggacgaggggcaggaatctctggaggaagagttggatgtgttggttttggatgatgaggggggccaagtgtcttacccctccatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcctg

SEQ ID NO: 4821 - DNA, 6295 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggtgtgtggcttttgaagaaaatgtatgtactgacgggaaaaggaggataagcaagtcgaatttttgtcttacgctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcaggacgaggggcaggaatctctggaggaagagttggatgtgttggttttggatgatgaggggggccaagtgtcttacccctccatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 4822 - DNA, 6232 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggtgtgtggcttttgaagaaaatgtatgtactgacgggaaaaggaggataagcaagtcgaatttttgtcttacgctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataacaactattccacaccaaatgagagaggagaccacaatagaacactggatcgatcgggggatctaggcgacatggagccattgaagggaacaacacccttgatgcaggacgaggggcaggaatctctggaggaagagttggatgtgttggttttggatgatgaggggggccaagtgtcttacccctccatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 4823 - DNA, 6244 bp, Homo sapiens
ggctgacatcacttaggaaagcgaagggggtagggctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggtgtgtggcttttgaagaaaatgtatgtactgacgggaaaaggaggataagcaagtcgaatttttgtcttacgctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcctg

SEQ ID NO: 4824 - DNA, 5188 bp, Homo sapiens
gagggctgagggaagatggctgggctgcaagaggcagggggatgggcccgtcagggaggaattcttgtgaaagccgtcgtctgcctcagcacttgatgaaaacacaccgaaaaagaggctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagatgagtggttctccagagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtg

SEQ ID NO: 4825 - DNA, 6313 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggtgtgtggcttttgaagaaaatgtatgtactgacgggaaaaggaggataagcaagtcgaatttttgtcttacgctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagatgagtggttctccagagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcaggacgaggggcaggaatctctggaggaagagttggatgtgttggttttggatgatgaggggggccaagtgtcttacccctccatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 4826 - DNA, 5832 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagatgagtggttctccagagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcaggacgaggggcaggaatctctggaggaagagttggatgtgttggttttggatgatgaggggggccaagtgtcttacccctccatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 4827 - DNA, 5800 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggtgtgtggcttttgaagaaaatgtatgtactgacgggaaaaggaggataagcaagtcgaatttttgtcttacgaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 4828 - DNA, 6016 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 4829 - DNA, 505 bp, Homo sapiens
agtggtggtgatttgggtctagctttaaatagtgggctttgtgtagctgaagtgagcatcctagttaacctagtgtccaggactatttccacgaactaagggttgttttgactggtgtgtagtacagagcctttggggtgataagatggaagatttgtcttttacctcacctccactggttctttcaggaattataagggatgcagataagtaaatcttttattttttaaattttttgttttgctcattgtcttggttttggggtaaaaaatgatgatagctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactca

SEQ ID NO: 4830 - DNA, 6553 bp, Homo sapiens
agaacaggaggagcgctttgggcgggaggctaagtctcgagggacttgagggctgagggaagatggctgggctgcaagaggcagggggatgggcccgtcagggaggaattcttgtgaaagccgtcgtctgcctcagcacttgatgaaaacacaccgaaaaagagggtagggatgctgtagtagagcaggcgccaaggcggttaagggtcatgtccgtcttccctttgaagaggcagtagatgcccttggctctgcctggagcgctccatgtttcgtgatggaagtctctggatggctctgctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcctgatgatggtcctgtcttgttttattgaactaggacttgggtatgaaaactttcatgggctagtgagaccaggaaatcaactagcttttaaagcttgatttgtgtctaacaattgtagtgttagattagaggttgaagtacaaagccaaaaagctattaagagtttactttccaaagagttttgatagccctgcttgagatgatttttatctaaatagaaaagcctggctgcttgtcagcaacactttatttccctgttatgttcttatcctttggcattgagctagatacaaaccctactcttctctcttccttctggattggtccatttgtttatctcattcaataaatatttgccaagcacctcct

SEQ ID NO: 4831 - DNA, 4984 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagatgagtggttctccagagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 4832 - DNA, 5994 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcaggacgaggggcaggaatctctggaggaagagttggatgtgttggttttggatgatgaggggggccaagtgtcttacccctccatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 4833 - DNA, 4966 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 4834 - DNA, 5071 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagatgagtggttctccagagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcaggacgaggggcaggaatctctggaggaagagttggatgtgttggttttggatgatgaggggggccaagtgtcttacccctccatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 4835 - DNA, 5745 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagatgagtggttctccagagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 4836 - DNA, 5907 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 4837 - DNA, 6099 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggtgtgtggcttttgaagaaaatgtatgtactgacgggaaaaggaggataagcaagtcgaatttttgtcttacgctctctccttcctgcttcctccttgctgtggtggctgggatgcttcttccatgattttttgaatctagactgggctgttctctgtgttaaaccaatcagttgcgaccttctcttaacaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 4838 - DNA, 5727 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 4839 - DNA, 579 bp, Homo sapiens
aaggctaggtgaggtgtctttggcaaggttgcacagggatccagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccg

SEQ ID NO: 4840 - DNA, 5814 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcaggacgaggggcaggaatctctggaggaagagttggatgtgttggttttggatgatgaggggggccaagtgtcttacccctccatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 4841 - DNA, 5925 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagatgagtggttctccagagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 4842 - DNA, 5053 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcaggacgaggggcaggaatctctggaggaagagttggatgtgttggttttggatgatgaggggggccaagtgtcttacccctccatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 4843 - DNA, 5655 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 4844 - DNA, 5749 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggtgtgtggcttttgaagaaaataacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 4845 - DNA, 6026 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagctctctccttcctgcttcctccttgctgtggtggctgggatgcttcttccatgattttttgaatctagactgggctgttctctgtgttaaaccaatcagttgcgaccttctcttaacaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 4846 - DNA, 5751 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataacaactattccacaccaaatgagagaggagaccacaatagaacactggatcgatcgggggatctaggcgacatggagccattgaagggaacaacacccttgatgcaggacgaggggcaggaatctctggaggaagagttggatgtgttggttttggatgatgaggggggccaagtgtcttacccctccatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 4847 - DNA, 6012 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagatgagtggttctccagagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcaggacgaggggcaggaatctctggaggaagagttggatgtgttggttttggatgatgaggggggccaagtgtcttacccctccatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 4848 - DNA, 498 bp, Homo sapiens
aagatggctgggctgcaagaggcagggggatgggcccgtcagggaggaattcttgtgaaagccgtcgtctgcctcagcacttgatgaaaacacaccgaaaaagagggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaact

SEQ ID NO: 4849 - DNA, 6024 bp, Homo sapiens
cagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagctctctccttcctgcttcctccttgctgtggtggctgggatgcttcttccatgattttttgaatctagactgggctgttctctgtgttaaaccaatcagttgcgaccttctcttaacagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 4850 - DNA, 5481 bp, Homo sapiens
gcgtcgggagccgcctctcgcccgcggcgctcgcccctgccgcccgccagcatcccttgtcccgcggccgcgctcagacaacaaaagcggaagatgctgcagttgggcaaggtcaggaccttgccctgaagccgggcggcgccgcgcacgcctcttcccggactgaggagctgtcgccggcggagggtgcatgtttgcgaggaagccgccgggcgccgcgcctttgggagctatgcctgttccagaccagccttcatcagcctcagagaagacgagttccctgagccccggcttaaacacctccaacggggatggctctgaaacagaaaccacctctgccatcctcgcctcagtcaaagaacaggaattacagtttgaaaggctgacccgagagctggaggctgaacggcagatcgtagccagccagctggagcgatgcaagctcggatccgagactggcagcatgagcagcatgagttcagcagaagagcagtttcagtggcagtcacaagatggtcaaaaagatatcgaagatgagcttacaacaggtctcgagctggtggactcctgtattaggtcactacaggaatcaggaatacttgacccacaggattattctacaggtgaaaggcccagcctgctctcccagagtgcacttcagctcaattccaaacctgaagggtctttccagtatccggccagctaccatagcaaccagaccctggccctgggggaaaccaccccttcacagctcccggcccgaggcacacaagcccgagctacgggccagagcttcagccagggcacgaccagccgcgccggccacctggcggggcccgagcccgcgccgccgccgccgccgccgccgcgggagccgttcgcgcccagcctgggcagcgccttccacctgcccgacgcgccgcccgccgccgccgccgccgcgctctactactccagctccacgctgcccgcgccgccgcgcgggggctccccgctggccgcgccccagggcggttcgcccaccaagctgcagcgcggcggctcggcccccgagggcgccacctacgccgcgccgcgcggctcctcgcccaagcagtcgcccagccgcctggccaagtcctacagcaccagctcgcccatcaacatcgtcgtgtcctcggccggcctgtccccgatccgcgtgacctcgccccccaccgtgcagtccaccatctcctcctcgcccatccaccagctgagctccaccatcggcacgtacgccaccctgtcgcccaccaagcgcctggtccacgcgtccgagcagtacagcaagcactcgcaggagctgtatgccacggccaccctccagaggccgggcagcctggcagctggttcccgagcctcatacagcagccagcatgggcacctgggcccagagttgcgggccctgcagtccccagaacaccacatagatcccatctatgaagaccgcgtctatcagaagccccctatgaggagtctcagccagagccagggggaccctctgccgccagcacacaccggcacctaccgcacgagcacagccccatcttcccctggtgtcgactccgtccccttgcagcgcacaggcagccagcacggcccacagaatgccgccgcggccaccttccagagggccagctatgccgccggcccagcctccaattacgcggacccctaccgacagctgcagtattgtccctctgttgagtctccatacagcaaatccggccctgctctcccgcctgaaggcaccttggccaggtccccgtccattgatagcattcagaaagatcccagagaatttggatggagagacccggaactgccggaagtgattcagatgttgcagcaccagtttccctcggtccagtctaacgcggcagcctacttgcaacacctctgttttggagacaacaaaattaaagccgagataaggagacaaggaggcatccagctcctggtggacctgttggatcatcggatgaccgaagtccaccgtagtgcctgtggagctctgagaaacctggtgtatgggaaggccaacgatgataacaaaattgccctgaaaaactgtggtggcatcccagcactggtgaggttactccgcaagacgactgacctggagatccgggagctggtcacaggagtcctttggaacctctcctcatgcgatgcactcaaaatgccaatcatccaggatgccctagcagtactgaccaacgcggtgattatcccccactcaggctgggaaaattcgcctcttcaggatgatcggaaaatacagctgcattcatcacaggtgctgcgtaacgccaccgggtgcctaaggaatgttagttcggccggagaggaggcccgcagaaggatgagagagtgtgatgggcttacggatgccttgctgtacgtgatccagtctgcgctggggagcagtgagatcgatagcaagaccgttgaaaactgtgtgtgcattttaaggaacctctcgtaccggctggcggcagaaacgtctcagggacagcacatgggcacggacgagctggacgggctactctgtggcgaggccaatggcaaggatgctgagagctctgggtgctggggcaagaagaagaagaaaaagaaatcccaagatcagtgggatggagtaggacctcttccagactgtgctgaaccaccaaaagggatccagatgctgtggcacccatcaatagtcaaaccctacctcacactgctctctgagtgctcaaatccagacacgctggaaggggcggcaggcgccctgcagaacttggctgcagggagctggaagtggtcagtatatatccgagccgctgtccgaaaagagaaaggcctgcccatcctcgtggagctgctccgaatagacaatgaccgtgtggtgtgcgcggtggccactgcgctgcggaacatggccttggacgtcagaaataaggagctcatcggcaaatacgccatgcgagacctagtccacaggcttccaggagggaacaacagcaacaacactgcaagcaaggccatgtcggatgacacagtgacagctgtctgctgcacactgcacgaagtgattaccaagaacatggagaacgccaaggccttacgggatgccggtggcatcgagaagttggtcggcatctccaaaagcaaaggagataaacactctccaaaagtggtcaaggctgcatctcaggtcctcaacagcatgtggcagtaccgagatctgaggagtctctacaaaaaggatggatggtcacaataccactttgtagcctcgtcttcaaccatcgagagggaccggcaaaggccctactcctcctcccgcacgccctccatctcccctgtgcgcgtgtctcccaacaaccgctcagcaagtgccccagcttcacctcgggaaatgatcagcctcaaagaaaggaaaacagactacgagtgcaccggcagcaacgccacctaccacggagctaaaggcgaacacacttccaggaaagatgccatgacagctcaaaacactggaatttcaactttgtataggaattcttatggtgcgcccgctgaagacatcaaacacaaccaggtttcagcacagccagtcccacaggagcccagcagaaaagattacgagacctaccagccatttcagaattccacaagaaattacgatgagtccttcttcgaggaccaggtccaccatcgccctcccgccagcgagtacaccatgcacctgggtctcaagtccaccggcaactacgttgacttctactcagctgcccgtccctacagtgaactgaactatgaaacgagccactacccggcctcccccgactcctgggtgtgaggagcagggcacaggcgctccgggaacagtgcatgtgcatgcataccacaagacatttctttctgttttgtttttttctcctgcaaatttagtttgttaaagcctgttccataggaaggctgtgataaccagtaaggaaatattaagagctattttagaaagctaaatgaatcgcaagttaacttggaaatcagtagaaagctaaagtgatcctaaatatgacagtgggcagcacctttctagcgtgagctgtagagtaacgagaagtgctttatactgaacgtggttgatgggaggagagacgaggcattcgggccggtggggcgtaagggttatcgttaagcacaagacacagaatagtttacacactgtgtgggggacggcttctcacgctttgtttactctcttcatccgttgtgactctaggcttcaggttgcattggggttcctctgtacagcaagatgtttcttgccttttgttaatgcattgttgtaaagtatttgatgtacattacagattaaagaagaaaagcgcgttgtgtatattacaccaatgccgccgtgtttcctcatctatggttctaaatattgcttcaatttcaaacttttgaaagatgtatggatttccagtttttctttactttctcccagtatgttttaacaaaaaaaaaaaaaagcaggaaaaaaggaatatttagcagtattgttcgttctgatatgtgaatttgtttgtgacaactaaacaaggcattcagcagtttctgacaattaacatacatcattccacactccttgtcaacaaagtgctttttcactgcctaaaattttagatgtagatatttgaaatagattttttcatttataccagttttctttatgatgatacagtgttaaaagaaaataaattacaattgatctgtcatccatatttgctaagaatgtctatttccaagaacctatatcttacaaaatacacattcttgcttgtgtgtctgtgtgtgtgggtgtatgtatgtccacgtactagaaaaattacctgtgtgagattttattttgacagaagctatttcatttgctgttcatcttgtacaaactttgtttttggttttttagtataaatgtacatcagtttgttccttttgtactgtatctattcttctgaccatctagtgactcaggatattaggccagttgaagtggagttataggattttcacacattcacgcatacttggatatcaaccctctctacaggtccgtttccttacacattttatcccctcagaacacgataaaccatggccaattcagtttcactttggggccaattacttgaagtatccacagaaaatgtaaactgctcgccttattcccccaaactttttgttcatgtggcagggagcagtacacaactatggaatagattattaaaactgaacttgaagctaacgttagaatagtggttaacagagctaagaaataaggctaaccatcgaaaagaacatgggccgcgggtaaactagctttgctctttagatgcaagtggctgaggccaataggtgcctagtaaatgttaactgttcttggaaaaaataaaaacatcagtaacaaaa

SEQ ID NO: 4851 - DNA, 5236 bp, Homo sapiens
gccagcatcccttgtcccgcggccgcgctcagacaacaaaagcggaagatgctgcagttgggcaaggtcaggaccttgccctgaagccgggcggcgccgcgcacgcctcttcccggactgaggagctgtcgccggcggagggtgcatgtttgcgaggaagccgccgggcgccgcgcctttgggagctatgcctgttccagaccagccttcatcagcctcagagaagacgagttccctgagccccggcttaaacacctccaacggggatggctctgaaacagaaaccacctctgccatcctcgcctcagtcaaagaacaggaattacagtttgaaaggctgacccgagagctggaggctgaacggcagatcgtagccagccagctggagcgatgcaagctcggatccgagactggcagcatgagcagcatgagttcagcagaagagcagtttcagtggcagtcacaagatggtcaaaaagatatcgaagatgagcttacaacaggtctcgagctggtggactcctgtattaggtcactacaggaatcaggaatacttgacccacaggattattctacaggtgaaaggcccagcctgctctcccagagtgcacttcagctcaattccaaacctgaagggtctttccagtatccggccagctaccatagcaaccagaccctggccctgggggaaaccaccccttcacagctcccggcccgaggcacacaagcccgagctacgggccagagcttcagccagggcacgaccagccgcgccggccacctggcggggcccgagcccgcgccgccgccgccgccgccgccgcgggagccgttcgcgcccagcctgggcagcgccttccacctgcccgacgcgccgcccgccgccgccgccgccgcgctctactactccagctccacgctgcccgcgccgccgcgcgggggctccccgctggccgcgccccagggcggttcgcccaccaagctgcagcgcggcggctcggcccccgagggcgccacctacgccgcgccgcgcggctcctcgcccaagcagtcgcccagccgcctggccaagtcctacagcaccagctcgcccatcaacatcgtcgtgtcctcggccggcctgtccccgatccgcgtgacctcgccccccaccgtgcagtccaccatctcctcctcgcccatccaccagctgagctccaccatcggcacgtacgccaccctgtcgcccaccaagcgcctggtccacgcgtccgagcagtacagcaagcactcgcaggagctgtatgccacggccaccctccagaggccgggcagcctggcagctggttcccgagcctcatacagcagccagcatgggcacctgggcccagagttgcgggccctgcagtccccagaacaccacatagatcccatctatgaagaccgcgtctatcagaagccccctatgaggagtctcagccagagccagggggaccctctgccgccagcacacaccggcacctaccgcacgagcacagccccatcttcccctggtgtcgactccgtccccttgcagcgcacaggcagccagcacggcccacagaatgccgccgcggccaccttccagagggccagctatgccgccggcccagcctccaattacgcggacccctaccgacagctgcagtattgtccctctgttgagtctccatacagcaaatccggccctgctctcccgcctgaaggcaccttggccaggtccccgtccattgatagcattcagaaagatcccagagaatttggatggagagacccggaactgccggaagtgattcagatgttgcagcaccagtttccctcggtccagtctaacgcggcagcctacttgcaacacctctgttttggagacaacaaaattaaagccgagataaggagacaaggaggcatccagctcctggtggacctgttggatcatcggatgaccgaagtccaccgtagtgcctgtggagctctgagaaacctggtgtatgggaaggccaacgatgataacaaaattgccctgaaaaactgtggtggcatcccagcactggtgaggttactccgcaagacgactgacctggagatccgggagctggtcacaggagtcctttggaacctctcctcatgcgatgcactcaaaatgccaatcatccaggatgccctagcagtactgaccaacgcggtgattatcccccactcaggctgggaaaattcgcctcttcaggatgatcggaaaatacagctgcattcatcacaggtgctgcgtaacgccaccgggtgcctaaggaatgttagttcggccggagaggaggcccgcagaaggatgagagagtgtgatgggcttacggatgccttgctgtacgtgatccagtctgcgctggggagcagtgagatcgatagcaagaccgttgaaaactgtgtgtgcattttaaggaacctctcgtaccggctggcggcagaaacgtctcagggacagcacatgggcacggacgagctggacgggctactctgtggcgaggccaatggcaaggatgctgagagctctgggtgctggggcaagaagaagaagaaaaagaaatcccaagatcagtggtcagtatatatccgagccgctgtccgaaaagagaaaggcctgcccatcctcgtggagctgctccgaatagacaatgaccgtgtggtgtgcgcggtggccactgcgctgcggaacatggccttggacgtcagaaataaggagctcatcggcaaatacgccatgcgagacctagtccacaggcttccaggagggaacaacagcaacaacactgcaagcaaggccatgtcggatgacacagtgacagctgtctgctgcacactgcacgaagtgattaccaagaacatggagaacgccaaggccttacgggatgccggtggcatcgagaagttggtcggcatctccaaaagcaaaggagataaacactctccaaaagtggtcaaggctgcatctcaggtcctcaacagcatgtggcagtaccgagatctgaggagtctctacaaaaaggatggatggtcacaataccactttgtagcctcgtcttcaaccatcgagagggaccggcaaaggccctactcctcctcccgcacgccctccatctcccctgtgcgcgtgtctcccaacaaccgctcagcaagtgccccagcttcacctcgggaaatgatcagcctcaaagaaaggaaaacagactacgagtgcaccggcagcaacgccacctaccacggagctaaaggcgaacacacttccaggaaagatgccatgacagctcaaaacactggaatttcaactttgtataggaattcttatggtgcgcccgctgaagacatcaaacacaaccaggtttcagcacagccagtcccacaggagcccagcagaaaagattacgagacctaccagccatttcagaattccacaagaaattacgatgagtccttcttcgaggaccaggtccaccatcgccctcccgccagcgagtacaccatgcacctgggtctcaagtccaccggcaactacgttgacttctactcagctgcccgtccctacagtgaactgaactatgaaacgagccactacccggcctcccccgactcctgggtgtgaggagcagggcacaggcgctccgggaacagtgcatgtgcatgcataccacaagacatttctttctgttttgtttttttctcctgcaaatttagtttgttaaagcctgttccataggaaggctgtgataaccagtaaggaaatattaagagctattttagaaagctaaatgaatcgcaagttaacttggaaatcagtagaaagctaaagtgatcctaaatatgacagtgggcagcacctttctagcgtgagctgtagagtaacgagaagtgctttatactgaacgtggttgatgggaggagagacgaggcattcgggccggtggggcgtaagggttatcgttaagcacaagacacagaatagtttacacactgtgtgggggacggcttctcacgctttgtttactctcttcatccgttgtgactctaggcttcaggttgcattggggttcctctgtacagcaagatgtttcttgccttttgttaatgcattgttgtaaagtatttgatgtacattacagattaaagaagaaaagcgcgttgtgtatattacaccaatgccgccgtgtttcctcatctatggttctaaatattgcttcaatttcaaacttttgaaagatgtatggatttccagtttttctttactttctcccagtatgttttaacaaaaaaaaaaaaaagcaggaaaaaaggaatatttagcagtattgttcgttctgatatgtgaatttgtttgtgacaactaaacaaggcattcagcagtttctgacaattaacatacatcattccacactccttgtcaacaaagtgctttttcactgcctaaaattttagatgtagatatttgaaatagattttttcatttataccagttttctttatgatgatacagtgttaaaagaaaataaattacaattgatctgtcatccatatttgctaagaatgtctatttccaagaacctatatcttacaaaatacacattcttgcttgtgtgtctgtgtgtgtgggtgtatgtatgtccacgtactagaaaaattacctgtgtgagattttattttgacagaagctatttcatttgctgttcatcttgtacaaactttgtttttggttttttagtataaatgtacatcagtttgttccttttgtactgtatctattcttctgaccatctagtgactcaggatattaggccagttgaagtggagttataggattttcacacattcacgcatacttggatatcaaccctctctacaggtccgtttccttacacattttatcccctcagaacacgataaaccatggccaattcagtttcactttggggccaattacttgaagtatccacagaaaatgtaaactgctcgccttattcccccaaactttttgttcatgtggcagggagcagtacacaactatggaatagattattaaaactgaacttgaagctaacgttagaatagtggttaacagagctaagaaataaggctaaccatcgaaaagaacatgggccgcgggtaaactagctttgctctttagatgcaagtggctgaggccaataggtgcctagtaaatgttaactgttcttgg

SEQ ID NO: 4852 - DNA, 3567 bp, Homo sapiens
gcgtcgggagccgcctctcgcccgcggcgctcgcccctgccgcccgccagcatcccttgtcccgcggccgcgctcagacaacaaaagcggaagatgctgcagttgggcaaggtcaggaccttgccctgaagccgggcggcgccgcgcacgcctcttcccggactgaggagctgtcgccggcggagggtgcatgtttgcgaggaagccgccgggcgccgcgcctttgggagctatgcctgttccagaccagccttcatcagcctcagagaagacgagttccctgagccccggcttaaacacctccaacggggatggctctgaaacagaaaccacctctgccatcctcgcctcagtcaaagaacaggaattacagtttgaaaggctgacccgagagctggaggctgaacggcagatcgtagccagccagctggagcgatgcaagctcggatccgagactggcagcatgagcagcatgagttcagcagaagagcagtttcagtggcagtcacaagatggtcaaaaagatatcgaagatgagcttacaacaggtctcgagctggtggactcctgtattaggtcactacaggaatcaggaatacttgacccacaggattattctacaggtgaaaggcccagcctgctctcccagagtgcacttcagctcaattccaaacctgaagggtctttccagtatccggccagctaccatagcaaccagaccctggccctgggggaaaccaccccttcacagctcccggcccgaggcacacaagcccgagctacgggccagagcttcagccagctggttcccgagcctcatacagcagccagcatgggcacctgggcccagagttgcgggccctgcagtccccagaacaccacatagatcccatctatgaagaccgcgtctatcagaagccccctatgaggagtctcagccagagccagggggaccctctgccgccagcacacaccggcacctaccgcacgagcacagccccatcttcccctggtgtcgactccgtccccttgcagcgcacaggcagccagcacggcccacagaatgccgccgcggccaccttccagagggccagctatgccgccggcccagcctccaattacgcggacccctaccgacagctgcagtattgtccctctgttgagtctccatacagcaaatccggccctgctctcccgcctgaaggcaccttggccaggtccccgtccattgatagcattcagaaagatcccagagaatttggatggagagacccggaactgccggaagtgattcagatgttgcagcaccagtttccctcggtccagtctaacgcggcagcctacttgcaacacctctgttttggagacaacaaaattaaagccgagataaggagacaaggaggcatccagctcctggtggacctgttggatcatcggatgaccgaagtccaccgtagtgcctgtggagctctgagaaacctggtgtatgggaaggccaacgatgataacaaaattgccctgaaaaactgtggtggcatcccagcactggtgaggttactccgcaagacgactgacctggagatccgggagctggtcacaggagtcctttggaacctctcctcatgcgatgcactcaaaatgccaatcatccaggatgccctagcagtactgaccaacgcggtgattatcccccactcaggctgggaaaattcgcctcttcaggatgatcggaaaatacagctgcattcatcacaggtgctgcgtaacgccaccgggtgcctaaggaatgttagttcggccggagaggaggcccgcagaaggatgagagagtgtgatgggcttacggatgccttgctgtacgtgatccagtctgcgctggggagcagtgagatcgatagcaagaccgttgaaaactgtgtgtgcattttaaggaacctctcgtaccggctggcggcagaaacgtctcagggacagcacatgggcacggacgagctggacgggctactctgtggcgaggccaatggcaaggatgctgagagctctgggtgctggggcaagaagaagaagaaaaagaaatcccaagatcagtgggatggagtaggacctcttccagactgtgctgaaccaccaaaagggatccagatgctgtggcacccatcaatagtcaaaccctacctcacactgctctctgagtgctcaaatccagacacgctggaaggggcggcaggcgccctgcagaacttggctgcagggagctggaagtggtcagtatatatccgagccgctgtccgaaaagagaaaggcctgcccatcctcgtggagctgctccgaatagacaatgaccgtgtggtgtgcgcggtggccactgcgctgcggaacatggccttggacgtcagaaataaggagctcatcggcaaatacgccatgcgagacctagtccacaggcttccaggagggaacaacagcaacaacactgcaagcaaggccatgtcggatgacacagtgacagctgtctgctgcacactgcacgaagtgattaccaagaacatggagaacgccaaggccttacgggatgccggtggcatcgagaagttggtcggcatctccaaaagcaaaggagataaacactctccaaaagtggtcaaggctgcatctcaggtcctcaacagcatgtggcagtaccgagatctgaggagtctctacaaaaaggatggatggtcacaataccactttgtagcctcgtcttcaaccatcgagagggaccggcaaaggccctactcctcctcccgcacgccctccatctcccctgtgcgcgtgtctcccaacaaccgctcagcaagtgccccagcttcacctcgggaaatgatcagcctcaaagaaaggaaaacagactacgagtgcaccggcagcaacgccacctaccacggagctaaaggcgaacacacttccaggaaagatgccatgacagctcaaaacactggaatttcaactttgtataggaattcttatggtgcgcccgctgaagacatcaaacacaaccaggtttcagcacagccagtcccacaggagcccagcagaaaagattacgagacctaccagccatttcagaattccacaagaaattacgatgagtccttcttcgaggaccaggtccaccatcgccctcccgccagcgagtacaccatgcacctgggtctcaagtccaccggcaactacgttgacttctactcagctgcccgtccctacagtgaactgaactatgaaacgagccactacccggcctcccccgactcctgggtgtgaggagcagggcacaggcgctccgggaacagtgcatgtgcatgcataccacaagacatttctttctgttttgtttttttctcctgcaaatttagtttgttaaagcctgttccataggaaggctgtgataaccagtaaggaaatattaagagctattttagaaagctaaatgaatcgcaagttaacttggaaatcagtagaaagctaaagtgatcctaaatatgacagtgggcagcacctttctagcgtgagctgtagagtaacgag

SEQ ID NO: 4853 - DNA, 2982 bp, Homo sapiens
agcctggggaaggagggaagagtaacccttcatctttgggactagtcgtcttgtttgcctagactacagttttcaagtatttaaggaccatttatttcaaaaggaattacagtttgaaaggctgacccgagagctggaggctgaacggcagatcgtagccagccagctggagcgatgcaagctcggatccgagactggcagcatgagcagcatgagttcagcagaagagcagtttcagtggcagtcacaagatggtcaaaaagatatcgaagatgagcttacaacaggtctcgagctggtggactcctgtattaggtcactacaggaatcaggaatacttgacccacaggattattctacaggtgaaactggttcccgagcctcatacagcagccagcatgggcacctgggcccagagttgcgggccctgcagtccccagaacaccacatagatcccatctatgaagaccgcgtctatcagaagccccctatgaggagtctcagccagagccagggggaccctctgccgccagcacacaccggcacctaccgcacgagcacagccccatcttcccctggtgtcgactccgtccccttgcagcgcacaggcagccagcacggcccacagaatgccgccgcggccaccttccagagggccagctatgccgccggcccagcctccaattacgcggacccctaccgacagctgcagtattgtccctctgttgagtctccatacagcaaatccggccctgctctcccgcctgaaggcaccttggccaggtccccgtccattgatagcattcagaaagatcccagagaatttggatggagagacccggaactgccggaagtgattcagatgttgcagcaccagtttccctcggtccagtctaacgcggcagcctacttgcaacacctctgttttggagacaacaaaattaaagccgagataaggagacaaggaggcatccagctcctggtggacctgttggatcatcggatgaccgaagtccaccgtagtgcctgtggagctctgagaaacctggtgtatgggaaggccaacgatgataacaaaattgccctgaaaaactgtggtggcatcccagcactggtgaggttactccgcaagacgactgacctggagatccgggagctggtcacaggagtcctttggaacctctcctcatgcgatgcactcaaaatgccaatcatccaggatgccctagcagtactgaccaacgcggtgattatcccccactcaggctgggaaaattcgcctcttcaggatgatcggaaaatacagctgcattcatcacaggtgctgcgtaacgccaccgggtgcctaaggaatgttagttcggccggagaggaggcccgcagaaggatgagagagtgtgatgggcttacggatgccttgctgtacgtgatccagtctgcgctggggagcagtgagatcgatagcaagaccgttgaaaactgtgtgtgcattttaaggaacctctcgtaccggctggcggcagaaacgtctcagggacagcacatgggcacggacgagctggacgggctactctgtggcgaggccaatggcaaggatgctgagagctctgggtgctggggcaagaagaagaagaaaaagaaatcccaagatcagtgggatggagtaggacctcttccagactgtgctgaaccaccaaaagggatccagatgctgtggcacccatcaatagtcaaaccctacctcacactgctctctgagtgctcaaatccagacacgctggaaggggcggcaggcgccctgcagaacttggctgcagggagctggaagtggtcagtatatatccgagccgctgtccgaaaagagaaaggcctgcccatcctcgtggagctgctccgaatagacaatgaccgtgtggtgtgcgcggtggccactgcgctgcggaacatggccttggacgtcagaaataaggagctcatcggcaaatacgccatgcgagacctagtccacaggcttccaggagggaacaacagcaacaacactgcaagcaaggccatgtcggatgacacagtgacagctgtctgctgcacactgcacgaagtgattaccaagaacatggagaacgccaaggccttacgggatgccggtggcatcgagaagttggtcggcatctccaaaagcaaaggagataaacactctccaaaagtggtcaaggctgcatctcaggtcctcaacagcatgtggcagtaccgagatctgaggagtctctacaaaaaggatggatggtcacaataccactttgtagcctcgtcttcaaccatcgagagggaccggcaaaggccctactcctcctcccgcacgccctccatctcccctgtgcgcgtgtctcccaacaaccgctcagcaagtgccccagcttcacctcgggaaatgatcagcctcaaagaaaggaaaacagactacgagtgcaccggcagcaacgccacctaccacggagctaaaggcgaacacacttccaggaaagatgccatgacagctcaaaacactggaatttcaactttgtataggaattcttatggtgcgcccgctgaagacatcaaacacaaccaggtttcagcacagccagtcccacaggagcccagcagaaaagattacgagacctaccagccatttcagaattccacaagaaattacgatgagtccttcttcgaggaccaggtccaccatcgccctcccgccagcgagtacaccatgcacctgggtctcaagtccaccggcaactacgttgacttctactcagctgcccgtccctacagtgaactgaactatgaaacgagccactacccggcctcccccgactcctgggtgtgaggagcagggcacaggcgctccgggaacagtgcatgtgcatgcataccacaagacatttctttctgttttgtttttttctcctgcaaatttagtttgttaaagcctgttccata

SEQ ID NO: 4854 - DNA, 720 bp, Homo sapiens
gggactagtcgtcttgtttgcctagactacagttttcaagtatttaaggaccatttatttcaaaaggtacagtaaaggaattacagtttgaaaggctgacccgagagctggaggctgaacggcagatcgtagccagccagctggagcgatgcaagctcggatccgagactggcagcatgagcagcatgagttcagcagaagagcagtttcagtggcagtcacaagatggtcaaaaagatatcgaagatgagcttacaacaggtctcgagctggtggactcctgtattaggtcactacaggaatcaggaatacttgacccacaggattattctacaggtgaaaggcccagcctgctctcccagagtgcacttcagctcaattccaaacctgaagggtctttccagtatccggccagctaccatagcaaccagaccctggccctgggggaaaccaccccttcacagctcccggcccgaggcacacaagcccgagctacgggccagagcttcagccagggcacgaccagccgcgccggccacctggcggggcccgagcccgcgccgccgccgccgccgccgccgcgggagccgttcgcgcccagcctgggcagcgccttccacctgcccgacgcgccgcccgccgccgccgccgccgcgctctactactccagctccacgctgcccgcgccgccgcgcgggggctccccgctggccgcgcccc

SEQ ID NO: 4855 - DNA, 1962 bp, Homo sapiens
cgtgatccagtctgcgctggggagcagtgagatcgatagcaagaccgttgaaaactgtgtgtgcattttaaggaacctctcgtaccggctggcggcagaaacgtctcagggacagcacatgggcacggacgagctggacgggctactctgtggcgaggccaatggcaaggatgctgagagctctgggtgctggggcaagaagaagaagaaaaagaaatcccaagatcagtgggatggagtaggacctcttccagactgtgctgaaccaccaaaagggatccagatgctgtggcacccatcaatagtcaaaccctacctcacactgctctctgagtgctcaaatccagacacgctggaaggggcggcaggcgccctgcagaacttggctgcagggagctggaagtggtcagtatatatccgagccgctgtccgaaaagagaaaggcctgcccatcctcgtggagctgctccgaatagacaatgaccgtgtggtgtgcggtggccactgcgctgcggaacatggccttggacgtcagaaataaggagctcatcggcaaatacgccatgcgagacctagtccacaggcttccaggagggaacaacagcaacaacactgcaagcaaggccatgtcggatgacacagtgacagctgtctgctgcacactgcacgaagtgattaccaagaacatggagaacgccaaggccttacgggatgccggtggcatcgagaagttggtcggcatctccaaaagcaaaggagataaacactctccaaaagtggtcaaggctgcatctcaggtcctcaacagcatgtggcagtaccgagatctgaggagtctctacaaaaaggatggatggtcacaataccactttgtagcctcgtcttcaaccatcgagagggaccggcaaaggccctactcctcctcccgcacgccctccatctcccctgtgcgcgtgtctcccaacaaccgctcagcaagtgccccagcttcacctcgggaaatgatcagcctcaaagaaaggaaaacagactacgagtgcaccggcagcaacgccacctaccacggagctaaaggcgaacacacttccaggaaagatgccatgacagctcaaaacactggaatttcaactttgtataggaattcttatggtgcgcccgctgaagacatcaaacacaaccaggtttcagcacagccagtcccacaggagcccagcagaaaagattacgagacctaccagccatttcagaattccacaagaaattacgatgagtccttcttcgaggaccaggtccaccatcgccctcccgccagcgagtacaccatgcacctgggtctcaagtccaccggcaactacgttgacttctactcagctgcccgtccctacagtgaactgaactatgaaacgagccactacccggcctcccccgactcctgggtgtgaggagcagggcacaggcgctccgggaacagtgcatgtgcatgcataccacaagacatttctttctgttttgtttttttctcctgcaaatttagtttgttaaagcctgttccataggaaggctgtgataaccagtaaggaaatattaagagctattttagaaagctaaatgaatcgcaagttaacttggaaatcagtagaaagctaaagtgatcctaaatatgacagtgggcagcacctttctagcgtgagctgtagagtaacgagaagtgctttatactgaacgtggttgatgggaggagagacgaggcattcgggccggtggggcgtaagggttatcgttaagcacaagacacagaatagtttacacactgtgtgggggacggcttctcacgctttgtttactctcttcatccgttgtgactctaggcttcaggttgcattggggttcctctgtacagcaagatgtttcttgccttttgttaatgcattgttgtaaagtatttgatgtacattacagatt

SEQ ID NO: 4856 - DNA, 451 bp, Homo sapiens
tgtgggtgcaggtttcctgggcttgccagacacacagggcggcaccttcctacttctgcccagccacagccctcccctcacagttgagcacctgtttgcctgaagttaatttccagaagcaggagtccccagagccaggcagggggatgaaccgcgagggagctcccgggaagagtccggaggagatgtacattcagcagaaggtccgagtgctgctcatgctgcggaagatgggatcaaacctgacagccagcgaggaggagttcctgcgcacctatgcaggggtggtcaacagccagctcagccagctgcctccgcactccatcgaccagggtgcagaggacgtggtgatggcgttttccaggtcggagacggaagaccggaggcagtagctgcaaagcccttggaacaccctggatgctgttgagggccaagagatctgtgtggctcc

SEQ ID NO: 4857 - DNA, 852 bp, Homo sapiens
gtggctactctcctgagcttgtctgtggtggctttaaccttgaacaaaccctccagggtttgtgggtggattcctattgtatcaggtgctgtattttcccctcttctggagcaagtgcgtcttttctgatcttccttcccttcagctccagctgccactgtccttgccttcagactggacaaggccttgtgacccatcaggagtttttgtcccgataccgtttcccacaggcggcaccttcctacttctgcccagccacagccctcccctcacagttgagcacctgtttgcctgaagttaatttccagaagcaggagtccccagagccaggcagggggatgaaccgcgagggagctcccgggaagagtccggaggagatgtacattcagcagaaggtccgagtgctgctcatgctgcggaagatgggatcaaacctgacagccagcgaggaggagttcctgcgcacctatgcaggggtggtcaacagccagctcagccagctgcctccgcactccatcgaccagggtgcagaggacgtggtgatggcgttttccaggtcggagacggaagaccggaggcagtagctgcaaagcccttggaacaccctggatgctgttgagggccaagagatctgtgtggctcctgggccggctgagtggcagcagccccccttgccccacctcccccttcccctacccaaccctgccctgccccaccccacctcacagctactcagtggggctggcatcaagggagacaccagtggtgcgtttataattggcttaaagggatggacttgtgattggctgcaggaagaaacttttttattttttaaatcttgaccaacagaaa

SEQ ID NO: 4858 - DNA, 3000 bp, Homo sapiens
accgcggtgactctcggagcgggaggcggaggctgaggcggccgctcctgctgctgctactgccgccgccgcagcggctgctcgggctgagcacgccccggaacaggccgccgcgcgctgcgcgccggacccgctgcccctgccggcccggccgggtcgggcggcccagggaccgacagacttgacaacggtgacagcactggggcggcaccttcctacttctgcccagccacagccctcccctcacagttgagcacctgtttgcctgaagttaatttccagaagcaggagtccccagagccaggcagggggatgaaccgcgagggagctcccgggaagagtccggaggagatgtacattcagcagaaggtccgagtgctgctcatgctgcggaagatgggatcaaacctgacagccagcgaggaggagttcctgcgcacctatgcaggggtggtcaacagccagctcagccagctgcctccgcactccatcgaccagggtgcagaggacgtggtgatggcgttttccaggtcggagacggaagaccggaggcagtagctgcaaagcccttggaacaccctggatgctgttgagggccaagagatctgtgtggctcctgggccggctgagtggcagcagccccccttgccccacctcccccttcccctacccaaccctgccctgccccaccccacctcacagctactcagtggggctggcatcaagggagacaccagtggtgcgtttataattggcttaaagggatggacttgtgattggctgcaggaagaaacttttttattttttaaatcttgaccaacagaaaccttttatttttatttctgactcttattttttaaaaaatttgcgcctcggtatctggcttccctggaagctctccgagctctggtgctttagttaggtcatttttttagaaatgtgaagaggtctgattggctgcttaaactggaaaggatctgtgattggctggttaatgggaaacggtttttttctttggctgcaggtgttctgctgatatcaacagcttccctattttgaatgcagaaaacagggtctgggacattagtcgttatatttgacttgaaaagaaagaaaccaagtgcgctttgcaatatttattacacaaagaacttgctgctgccttcacatttggggtttgtgtttgattggctttcgatgcgtgtgtttggtttcccattggttcacctgtgactcctgttgccatggattcacccccctctgctgccggctctgggcctgagggtccacctggagagtacatttgctttaatgagtgcacctgcctccaccagcaaggggaccccgagaaccctgagcagggtccacagctggaaagttgggcccctgaggagctttgtgtcgtcttgaacgagcagcccagggcctagaggtaaccgttaggcgggatttatgtgcactgcctgcatgagctggcaaccagccagcgtcccttggtgagaaagggattgctgaggcaccgtccaggccccaccggccaggccgcgcccagcagaggcgtactacccagctctgtcctcttggccatccttctgtgtaccacttcctgaggcctcattttgggggtcatcttggaaaggggaggagcttctcccagtgtgagaccccaaagactctggaggtcatctggcggaggtctctgggagcccagaacccacataaaagccccagcttggctcacaaggcccaggagacctccagctaaacaccaacccctgacctaccccagccaggctcctacctgtctgctgccagcacagtaggtcccggccagctctggagttctctcatcggaggcccatgccctccactccactgcctttggaagggtctctctccaggtcagcctggaagggacagtatcgtttgtttatgaaatgccactgggacagctggctgggccttcaccaagcaagtcccttcagactggcccttaagccaaactcaggcccagaattgcagttcagaatggcagtcctggaggcagggggtgaggggcaggtctagtgttcctgcaccaaacctaagtccttccacctgccacccccttccctgggagggaggtggtcctcctatctccctggctcactggcaggtgtgggatctggggagagcggctggagaaagatgcagtcctcaggaagggggccgccaccctcccctatgctggtagatgctgaggcccctaggtgcccagggccagtgggaccctctcagaaccaaatctttcccctttctcggggcttggggctcgggccgtaggggctcctgagtgtcatgaagtgcacaggagccaaatgaccgagccctggagagccccatggtgggtaggtggttcgtgctgtgctctggcaccatcagcctgttccagaaggaggattcgagcatcaggctaagaccctgtgtcctccaccatgcactcacccctagccctggttagctgacagtcagctgtggggaacacagctacaaccctaccctggcagggacctgagagcatctcaggaggggcagcgcatgtgtgcatgtgctgtgtgagtgagcacacccgtgtgcacactcatacacatgtgcacacacacgcactctccccgctcaggggcctggaggtctggctgagcccctggggaaaggtgagttctttcatctccctcctccaggtcggagtgcctggagtcaggtgtcgaggccacattgctggctgccccctctttgtagctcctataaagggcccacacctggtggatacctggttgagtgtgtggtctctgccccagcctgtccttgtcacgatcacaggccttgcttttgtaacaatgatgaccccggcctgtctcatcttctgaagaggaaaagtcaaagtgttgctgtggctccatatttcaactaaaaatatatctgttggagaaagaaattaacaataaagaattttcataggtt

SEQ ID NO: 4859 - DNA, 1206 bp, Homo sapiens
agcccgcgcggagccagatgccgccccctccgccggtccctcccccggcggcctggcgcctccctccctccccaccgcggtgactctcggagcgggaggcggaggctgaggcggccgctcctgctgctgctactgccgccgccgcagcggctgctcgggctgagcacgccccggaacaggccgccgcgcgctgcgcgccggacccgctgcccctgccggcccggccgggtcgggcggcccagggcggcaccttcctacttctgcccagccacagccctcccctcacagttgagcacctgtttgcctgaagttaatttccagaagcaggagtccccagagccaggcagggggatgaaccgcgagggagctcccgggaagagtccggaggagatgtacattcagcagaaggtccgagtgctgctcatgctgcggaagatgggatcaaacctgacagccagcgaggaggagttcctgcgcacctatgcaggggtggtcaacagccagctcagccagctgcctccgcactccatcgaccagggtgcagaggacgtggtgatggcgttttccaggtcggagacggaagaccggaggcagtagctgcaaagcccttggaacaccctggatgctgttgagggccaagagatctgtgtggctcctgggccggctgagtggcagcagccccccttgccccacctcccccttcccctacccaaccctgccctgccccaccccacctcacagctactcagtggggctggcatcaagggagacaccagtggtgcgtttataattggcttaaagggatggacttgtgattggctgcaggaagaaacttttttattttttaaatcttgaccaacagaaaccttttatttttatttctgactcttattttttaaaaaatttgcgcctcggtatctggcttccctggaagctctccgagctctggtgctttagttaggtcatttttttagaaatgtgaagaggtctgattggctgcttaaactggaaaggatctgtgattggctggttaatgggaaacggtttttttctttggctgcaggtgttctgctgatatcaacagcttccctattttgaatgcagaaaacagggtctgggacattagtcgttatatttgacttgaaaagaaagaaaccaagtgcgctttgcaatatttattacacaaagaacttgctgctgccttca

SEQ ID NO: 4860 - DNA, 1412 bp, Homo sapiens
gcaggagtccccagagccaggcagggggatgaaccgcgagggagctcccgggaagagtccggaggagatgtacattcagcagaaggtccgagtgctgctcatgctgcggaagatgggatcaaacctgacagccagcgaggaggagttcctgcgcacctatgcaggggtggtcaacagccagctcagccagctgcctccgcactccatcgaccagggtgcagaggacgtggtgatggcgttttccaggtcggagacggaagaccggaggcagtagctgcaaagcccttggaacaccctggatgctgttgagggccaagagatctgtgtggctcctgggccggctgagtggcagcagccccccttgccccacctcacagctactcagtggggctggcatcaagggagacaccagtggtgcgtttataattggcttaaagggatggacttgtgattggctgcaggaagaaacttttttattttttaaatcttgaccaacagaaaccttttatttttatttctgactcttattttttaaaaaatttgcgcctcggtatctggcttccctggaagctctccgagctctggtgctttagttaggtcatttttttagaaatgtgaagaggtctgattggctgcttaaactggaaaggatctgtgattggctggttaatgggaaacggtttttttctttggctgcaggtgttctgctgatatcaacagcttccctattttgaatgcagaaaacagggtctgggacattagtcgttatatttgacttgaaaagaaagaaaccaagtgcgctttgcaatatttattacacaaagaacttgctgctgccttcacatttggggtttgtgtttgattggctttcgatgcgtgtgtttggtttcccattggttcacctgtgactcctgttgccatggattcacccccctctgctgccggctctgggcctgagggtccacctggagagtacatttgctttaatgagtgcacctgcctccaccagcaaggggaccccgagaaccctgagcagggtccacagctggaaagttgggcccctgaggagctttgtgtcgtcttgaacgagcagcccagggcctagaggtaaccgttaggcgggatttatgtgcactgcctgcatgagctggcaaccagccagcgtcccttggtgagaaagggattgctgaggcaccgtccaggccccaccggccaggccgcgcccagcagaggcgtactacccagctctgtcctcttggccatccttctgtgtaccacttcctgaggcctcattttgggggtcatcttggaaaggggaggagcttctcccagtgtgagaccccaaagactctggaggtcatctggcggaggtctctgggagcccagaacccacataaaagccccagcttggc

SEQ ID NO: 4861 - DNA, 1925 bp, Homo sapiens
attggctctgcggctccgctcgccgcactttacggcagtgtggctggagccgcggctgacgggcccgcggtctgggcgtgagtgcagggaagtggagtatttgctgggccgggtaccatggacgtgggcgaacttctgagctaccagcccaataggggcacaaaacgtccccgggatgatgaagaggaggagcagaagatgcgtcggaaacaaactggtactcgagaacgcggccgctatcgggaagaagaaatgactgtggtggaggaagcggatgatgacaaaaaaaggctgctgcagattattgacagagatggggaagaggaagaggaagaggaggagccattggatgaaagctcagtgaagaaaatgatcctcacatttgaaaagagatcatataaaaaccaagaattgcggattaagtttccagacaatccagagaagttcatggaatccgagctggacctaaatgacatcattcaggagatgcacgtggtggccaccatgccagacctgtaccaccttctggtggagctgaatgctgtacagtcgcttctcggcttgctcggacacgataatacagatgtgtccatagctgtggtcgatttgcttcaggaattaacagatatagacaccctccatgagagtgaagagggagcagaagtgctcatcgatgctctggtggatgggcaggtggtagcactgctggtacagaatctggagcgcctggatgagtctgtgaaagaggaggcagatggcgtccacaacactctggctattgtggaaaacatggctgagttccggcctgagatgtgtacagagggtgcccagcagggtcttctacagtggctgttgaagaggctgaaggcaaagatgccttttgatgccaacaaactgtattgcagtgaagtgctggccatattgctccaggacaatgatgaaaacagggaattgcttggggagctggatggaatcgatgtgcttcttcagcagttatccgtgtttaaaagacacaatcccagcacggctgaggagcaggagatgatggagaatctgtttgattccctctgctcctgtctaatgcttagttccaatcgtgagcgcttcctgaagggcgagggtcttcagctgatgaatctcatgctcagggaaaagaagatctcccggagcagtgccctgaaagtgctggaccatgccatgattggccccgaaggcacagacaactgccataagtttgttgacattcttggcttacgaaccatctttcccctctttatgaaatctcccaggaagatcaagaaagtgggaaccactgagaaggaacatgaagagcatgtctgttcgatcctggcttccctcctgcggaacctgagagggcagcagcggacccggcttctgaataaattcactgaaaatgacagtgagaaggttgacagactaatggagttgcattttaaatatctgggtgcaatgcaggtggcggacaagaagattgaaggggaaaaacacgacatggtccggcgaggagagatcatcgacaatgacaccgaggaggagttctacctccggcgcctggatgcggggctctttgttctccagcacatctgctacatcatggccgagatctgcaatgccaatgtcccccagattcgccagagggttcaccagatcctaaacatgcgaggaagctccatcaaaattgtcaggcatatcatcaaggagtatgcagagaacatcggggacggccggagcccggagttccgggagaacgagcaaaagcgcatcctgggcttgctggagaacttctagaggcaccttggccctgcgcatcatggactctctcagcttccctcccaggatcagtttctacacaactctgtgtggcttttggacaaattaaagctagttttggtatccccgggcca

SEQ ID NO: 4862 - DNA, 1958 bp, Homo sapiens
tgacgggcccgcggtctgggcgtgagtgcagggaagtggagtatttgctgggccgggtaccatggacgtgggcgaacttctgagctaccaggggcatggatggagacacgcacacacacaggcaataggcctcaagattattggcgagtaaaggcatctatctattatcgtgaagcctactctgagctttgacccaataggggcacaaaacgtccccgggatgatgaagaggaggagcagaagatgcgtcggaaacaaactggtactcgagaacgcggccgctatcgggaagaagaaatgactgtggtggaggaagcggatgatgacaaaaaaaggctgctgcagattattgacagagatggggaagaggaagaggaagaggaggagccattggatgaaagctcagtgaagaaaatgatcctcacatttgaaaagagatcatataaaaaccaagaattgcggattaagtttccagacaatccagagaagttcatggaatccgagctggacctaaatgacatcattcaggagatgcacgtggtggccaccatgccagacctgtaccaccttctggtggagctgaatgctgtacagtcgcttctcggcttgctcggacacgataatacagatgtgtccatagctgtggtcgatttgcttcaggaattaacagatatagacaccctccatgagagtgaagagggagcagaagtgctcatcgatgctctggtggatgggcaggtggtagcactgctggtacagaatctggagcgcctggatgagtctgtgaaagaggaggcagatggcgtccacaacactctggctattgtggaaaacatggctgagttccggcctgagatgtgtacagagggtgcccagcagggtcttctacagtggctgttgaagaggctgaaggcaaagatgccttttgatgccaacaaactgtattgcagtgaagtgctggccatattgctccaggacaatgatgaaaacagggaattgcttggggagctggatggaatcgatgtgcttcttcagcagttatccgtgtttaaaagacacaatcccagcacggctgaggagcaggagatgatggagaatctgtttgattccctctgctcctgtctaatgcttagttccaatcgtgagcgcttcctgaagggcgagggtcttcagctgatgaatctcatgctcagggaaaagaagatctcccggagcagtgccctgaaagtgctggaccatgccatgattggccccgaaggcacagacaactgccataagtttgttgacattcttggcttacgaaccatctttcccctctttatgaaatctcccaggaagatcaagaaagtgggaaccactgagaaggaacatgaagagcatgtctgttcgatcctggcttccctcctgcggaacctgagagggcagcagcggacccggcttctgaataaattcactgaaaatgacagtgagaaggttgacagactaatggagttgcattttaaatatctgggtgcaatgcaggtggcggacaagaagattgaaggggaaaaacacgacatggtccggcgaggagagatcatcgacaatgacaccgaggaggagttctacctccggcgcctggatgcggggctctttgttctccagcacatctgctacatcatggccgagatctgcaatgccaatgtcccccagattcgccagagggttcaccagatcctaaacatgcgaggaagctccatcaaaattgtcaggcatatcatcaaggagtatgcagagaacatcggggacggccggagcccggagttccgggagaacgagcaaaagcgcatcctgggcttgctggagaacttctagaggcaccttggccctgcgcatcatggactctctcagcttccctcccaggatcagtttctacacaactctgtgtggcttttggacaaattaaagctagttttggt

SEQ ID NO: 4863 - DNA, 778 bp, Homo sapiens
actttacggcagtgtggctggagccgcggctgacgggcccgcggtctgggcgtgagtgcagggaagtggagtatttgctgggccgggtaccatggacgtgggcgaacttctgagctaccaggagggtcattgcgaggagcagtagagctgcactgccgaatgtcgtagccactagccacataggctgttgattgcttgaaatgtgactagtctgaattgagaaatactcccaataggggcacaaaacgtccccgggatgatgaagaggaggagcagaagatgcgtcggaaacaaactggtactcgagaacgcggccgctatcgggaagaagaaatgactgtggtggaggaagcggatgatgacaaaaaaaggctgctgcagattattgacagagatggggaagaggaagaggaagaggaggagccattggatgaaagctcagtgaagaaaatgatcctcacatttgaaaagagatcatataaaaaccaagaattgcggattaagtttccagacaatccagagaagttcatggaatccgagctggacctaaatgacatcattcaggagatgcacgtggtggccaccatgccagacctgtaccaccttctggtggagctgaatgctgtacagtcgcttctcggcttgctcggacacgataatacagatgtgtccatagctgtggtcgatttgcttcaggaattaacagatatagacaccctccatgagagtgaagagggagcagaagtgctcatcgatgctctggtggatgggcaggtgg

SEQ ID NO: 4864 - DNA, 1898 bp, Homo sapiens
cgggcgcctcctggagagcaaggacgcgggggagcagaggtgagctggcaccggaggctggaggggatccccgagcccgggatcgatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaggctccggctccaagcacctccactactggtttgtggagtcccagaaggatcccgagaacagccctgtggtgctttggctcaatgggggtcccggctgcagctcactagatgggctcctcacagagcatggccccttcctggtccagccagatggtgtcaccctggagtacaacccctattcttggaatctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttaggtatgagaaggacactgttgtggtccaggatttgggcaacatcttcactcgcctgccactcaagcggatgtggcatcaggcactgctgcgctcaggggataaagtgcgcatggaccccccctgcaccaacacaacagctgcttccacctacctcaacaacccgtacgtgcggaaggccctcaacatcccggagcagctgccacaatgggacatgtgcaactttctggtaaacttacagtaccgccgtctctaccgaagcatgaactcccagtatctgaagctgcttagctcacagaaataccagatcctattatataatggagatgtagacatggcctgcaatttcatgggggatgagtggtttgtggattccctcaaccagaagatggaggtgcagcgccggccctggttagtgaagtacggggacagcggggagcagattgccggcttcgtgaaggagttctcccacatcgcctttctcacgatcaagggcgccggccacatggttcccaccgacaagcccctcgctgccttcaccatgttctcccgcttcctgaacaagcagccatactgatgaccacagcaaccagctccacggcctgatgcagcccctcccagcctctcccgctaggagagtcctcttctaagcaaagtgcccctgcaggccgggttctgccgccaggactgcccccttcccagagccctgtacatcccagactgggcccagggtctcccatagacagcctgggggcaagttagcactttattcccgcagcagttcctgaatggggtggcctggccccttctctgcttaaagaatgccctttatgatgcactgattccatcccaggaacccaacagagctcaggacagcccacagggaggtggtggacggactgtaattgatagattgattatggaattaaattgggtacagcttcaaa

SEQ ID NO: 4865 - DNA, 2187 bp, Homo sapiens
agagtgcacccgaatccacgggctcggaggcagcagccatctctcggccatagggcaggccagctggcgccgggggctattttgggcggcgggcaatgatggtgaccgcaaggcgaccttgtaaggcatttcccccctgactcccttccccgagcctctgcccgggggtcctagcgccgctttctcagccatcccgcctacaacttagccgtccacaacaggatcatctgatcgcgtgcgcccgggctacgatctgcgaggcccgcggaccttgacccggcattgaccgccaccgccccccaggtccgtagggaccaaagaaggggcgggaggaagactgtcacgtggcgccggagttcacgtgactcgtacacatgacttccagtccccgggcgcctcctggagagcaaggacgcgggggagcagagatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaggctccggctccaagcacctccactactggtttgtggagtcccagaaggatcccgagaacagccctgtggtgctttggctcaatgggggtcccggctgcagctcactagatgggctcctcacagagcatggccccttcctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttaggtatgagaaggacactgttgtggtccaggatttgggcaacatcttcactcgcctgccactcaagcggatgtggcatcaggcactgctgcgctcaggggataaagtgcgcatggaccccccctgcaccaacacaacagctgcttccacctacctcaacaacccgtacgtgcggaaggccctcaacatcccggagcagctgccacaatgggacatgtgcaactttctggtaaacttacagtaccgccgtctctaccgaagcatgaactcccagtatctgaagctgcttagctcacagaaataccagatcctattatataatggagatgtagacatggcctgcaatttcatgggggatgagtggtttgtggattccctcaaccagaagatggaggtgcagcgccggccctggttagtgaagtacggggacagcggggagcagattgccggcttcgtgaaggagttctcccacatcgcctttctcacgatcaagggcgccggccacatggttcccaccgacaagcccctcgctgccttcaccatgttctcccgcttcctgaacaagcagccatactgatgaccacagcaaccagctccacggcctgatgcagcccctcccagcctctcccgctaggagagtcctcttctaagcaaagtgcccctgcaggccgggttctgccgccaggactgcccccttcccagagccctgtacatcccagactgggcccagggtctcccatagacagcctgggggcaagttagcactttattcccgcagcagttcctgaatggggtggcctggccccttctctgcttaaagaatgccctttatgatgcactgattccatcccaggaacccaacagagctcaggacagcccacagggaggtggtggacggactgtaattgatagattgattatggaattaaattgggtacagcttc

SEQ ID NO: 4866 - DNA, 1024 bp, Homo sapiens
agcccgggatcggtgcgcggcagaggaggctcgcgggtgggagctggcgctggggccggggcttccctcgcggaggcgccgccagcaactccccgggggctgctgcacggaagcgctgaggagcgagtcaacagcccctctgctgcctcccgtagatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaggctccggctccaagcacctccactactggtttgtggagtcccagaaggatcccgagaacagccctgtggtgctttggctcaatgggggtcccggctgcagctcactagatgggctcctcacagagcatggccccttcctggtccagccagatggtgtcaccctggagtacaacccctattcttggaatctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttag

SEQ ID NO: 4867 - DNA, 2149 bp, Homo sapiens
gcaatgatggtgaccgcaaggcgaccttgtaaggcatttcccccctgactcccttccccgagcctctgcccgggggtcctagcgccgctttctcagccatcccgcctacaacttagccgtccacaacaggatcatctgatcgcgtgcgcccgggctacgatctgcgaggcccgcggaccttgacccggcattgaccgccaccgccccccaggtccgtagggaccaaagaaggggcgggaggaagactgtcacgtggcgccggagttcacgtgactcgtacacatgacttccagtccccgggcgcctcctggagagcaaggacgcgggggagcagagatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaggctccggctccaagcacctccactactggtttgtggagtcccagaaggatcccgagaacagccctgtggtgctttggctcaatgggggtcccggctgcagctcactagatgggctcctcacagagcatggccccttcctggtccagccagatggtgtcaccctggagtacaacccctattcttggaatctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttaggtatgagaaggacactgttgtggtccaggatttgggcaacatcttcactcgcctgccactcaagcggatgtggcatcaggcactgctgcgctcaggggataaagtgcgcatggaccccccctgcaccaacacaacagctgcttccacctacctcaacaacccgtacgtgcggaaggccctcaacatcccggagcagctgccacaatgggacatgtgcaactttctggtaaacttacagtaccgccgtctctaccgaagcatgaactcccagtatctgaagctgcttagctcacagaaataccagatcctattatataatggagatgtagacatggcctgcaatttcatgggggatgagtggtttgtggattccctcaaccagaagatggaggtgcagcgccggccctggttagtgaagtacggggacagcggggagcagattgccggcttcgtgaaggagttctcccacatcgcctttctcacgatcaagggcgccggccacatggttcccaccgacaagcccctcgctgccttcaccatgttctcccgcttcctgaacaagcagccatactgatgaccacagcaaccagctccacggcctgatgcagcccctcccagcctctcccgctaggagagtcctcttctaagcaaagtgcccctgcaggccgggttctgccgccaggactgcccccttcccagagccctgtacatcccagactgggcccagggtctcccatagacagcctgggggcaagttagcactttattcccgcagcagttcctgaatggggtggcctggccccttctctgcttaaagaatgccctttatgatgcactgattccatcccaggaacccaacagagctcaggacagcccacagggaggtggtggacggactgtaattgatagattgattatggaattaaattgggtacagcttcaaa

SEQ ID NO: 4868 - DNA, 1075 bp, Homo sapiens
gggcgcctcctggagagcaaggacgcgggggagcagagatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaggctccggctccaagcacctccactactggtttgtggagtcccagaaggatcccgagaacagccctgtggtgctttggctcaatgggggtcccggctgcagctcactagatgggctcctcacagagcatggccccttcctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttaggtatgagaaggacactgttgtggtccaggatttgggcaacatcttcactcgcctgccactcaagcggatgtggcatcaggcactgctgcgctcaggggataaagtgcgcatggaccccccctgcaccaacacaacagctgcttccacctacctcaacaacccgtacgtgcggaaggccctcaacatcccggagcagctgccacaatgggacatgtgcaa

SEQ ID NO: 4869 - DNA, 1903 bp, Homo sapiens
ggtttccgggccggcgtagctatttcaaggcgcgcgcctcgtggtggactcaccgctagcccgcagcgctcggcttcctggtaattcttcacctcttttctcagctccctgcagcatgggtgctgggccctccttgctgctcgccgccctcctgctgcttctctccggcgacggcgccgtgcgctgcgacacacctgccaactgcacctatcttgacctgctgggcacctgggtcttccaggtgggctccagcggttcccagcgcgatgtcaactgctcggttatgggaccacaagaaaaaaaagtagtggtgtaccttcagaagctggatacagcatatgatgaccttggcaattctggccatttcaccatcatttacaaccaaggctttgagattgtgttgaatgactacaagtggtttgccttttttaagtataaagaagagggcagcaaggtgaccacttactgcaacgagacaatgactgggtgggtgcatgatgtgttgggccggaactgggcttgtttcaccggaaagaaggtgggaactgcctctgagaatgtgtatgtcaacatagcacaccttaagaattctcaggaaaagtattctaataggctctacaagtatgatcacaactttgtgaaagctatcaatgccattcagaagtcttggactgcaactacatacatggaatatgagactcttaccctgggagatatgattaggagaagtggtggccacagtcgaaaaatcccaaggcccaaacctgcaccactgactgctgaaatacagcaaaagattttgcatttgccaacatcttgggactggagaaatgttcatggtatcaattttgtcagtcctgttcgaaaccaagcatcctgtggcagctgctactcatttgcttctatgggtatgctagaagcgagaatccgtatactaaccaacaattctcagaccccaatcctaagccctcaggaggttgtgtcttgtagccagtatgctcaaggctgtgaaggcggcttcccataccttattgcaggaaagtacgcccaagattttgggctggtggaagaagcttgcttcccctacacaggcactgattctccatgcaaaatgaaggaagactgctttcgttattactcctctgagtaccactatgtaggaggtttctatggaggctgcaatgaagccctgatgaagcttgagttggtccatcatgggcccatggcagttgcttttgaagtatatgatgacttcctccactacaaaaaggggatctaccaccacactggtctaagagaccctttcaacccctttgagctgactaatcatgctgttctgcttgtgggctatggcactgactcagcctctgggatggattactggattgttaaaaacagctggggcaccggctggggtgagaatggctacttccggatccgcagaggaactgatgagtgtgcaattgagagcatagcagtggcagccacaccaattcctaaattgtagggtatgccttccagtatttcataatgatctgcatcagttgtaaaggggaattggtatattcacagactgtagactttcagcagcaatctcagaagcttacaaatagatttccatgaagatatttgtcttcagaattaaaactgcccttaattttaatatacctttcaatcggccactggccatttttttctaagtattcaattaagtgggaattttctggaagatggtcagctatgaagtaatagagtttgcttaatcatttgtaattcaaacatgctatattttttaaaatcaatgtgaaaacatagacttatttttaaattgtaccaatcacaagaaaataatggcaataattatcaaaacttttaaaatagatgctcatatttttaaaataaa

SEQ ID NO: 4870 - DNA, 1742 bp, Homo sapiens
atgggtgctgggccctcctgcgacacacctgccaactgcacctatcttgacctgctgggcacctgggtcttccaggtgggctccagcggttcccagcgcgatgtcaactgctcggttatgggaccacaagaaaaaaaagtagtggtgtaccttcagaagctggatacagcatatgatgaccttggcaattctggccatttcaccatcatttacaaccaaggctttgagattgtgttgaatgactacaagtggtttgccttttttaagtataaagaagagggcagcaaggtgaccacttactgcaacgagacaatgactgggtgggtgcatgatgtgttgggccggaactgggcttgtttcaccggaaagaaggtgggaactgcctctgagaatgtgtatgtcaacatagcacaccttaagaattctcaggaaaagtattctaataggctctacaagtatgatcacaactttgtgaaagctatcaatgccattcagaagtcttggactgcaactacatacatggaatatgagactcttaccctgggagatatgattaggagaagtggtggccacagtcgaaaaatcccaaggcccaaacctgcaccactgactgctgaaatacagcaaaagattttgcatttgccaacatcttgggactggagaaatgttcatggtatcaattttgtcagtcctgttcgaaaccaagcatcctgtggcagctgctactcatttgcttctatgggtatgctagaagcgagaatccgtatactaaccaacaattctcagaccccaatcctaagccctcaggaggttgtgtcttgtagccagtatgctcaaggctgtgaaggcggcttcccataccttattgcaggaaagtacgcccaagattttgggctggtggaagaagcttgcttcccctacacaggcactgattctccatgcaaaatgaaggaagactgctttcgttattactcctctgagtaccactatgtaggaggtttctatggaggctgcaatgaagccctgatgaagcttgagttggtccatcatgggcccatggcagttgcttttgaagtatatgatgacttcctccactacaaaaaggggatctaccaccacactggtctaagagaccctttcaacccctttgagctgactaatcatgctgttctgcttgtgggctatggcactgactcagcctctgggatggattactggattgttaaaaacagctggggcaccggctggggtgagaatggctacttccggatccgcagaggaactgatgagtgtgcaattgagagcatagcagtggcagccacaccaattcctaaattgtagggtatgccttccagtatttcataatgatctgcatcagttgtaaaggggaattggtatattcacagactgtagactttcagcagcaatctcagaagcttacaaatagatttccatgaagatatttgtcttcagaattaaaactgcccttaattttaatatacctttcaatcggccactggccatttttttctaagtattcaattaagtgggaattttctggaagatggtcagctatgaagtaatagagtttgcttaatcatttgtaattcaaacatgctatattttttaaaatcaatgtgaaaacatagacttatttttaaattgtaccaatcacaagaaaataatggcaataattatcaaaacttttaaaatagatgctcatatttttaaaataaagtttt

SEQ ID NO: 4871 - DNA, 6125 bp, Homo sapiens
aaggcgcgcgcctcgtggtggactcaccgctagcccgcagcgctcggcttcctggtaattcttcacctcttttctcagctccctgcagcatgggtgctgggccctccttgctgctcgccgccctcctgctgcttctctccggcgacggcgccgtgcgctgcgacacacctgccaactgcacctatcttgacctgctgggcacctgggtcttccaggtgggctccagcggttcccagcgcgatgtcaactgctcggttatgggaccacaagaaaaaaaagtagtggtgtaccttcagaagctggatacagcatatgatgaccttggcaattctggccatttcaccatcatttacaaccaaggctttgagattgtgttgaatgactacaagtggtttgccttttttaaggatgtcactgattttatcagtcatttgttcatgcagctgggaactgtggggatatatgatttgccacatctgaggaacaaactggttattaaatagagcatctgttgagggactcttttaaaaccacagccatgaacagacgttggggctaagagacagagcagcctgcgacagtgtggacctacctgtagcagctagcaaaggcctctagcagctacagtcccttctggagtctttatttgcatgcaaaatgcaaaggagtcctggtgacctacctccaaggcagctgccctcctgaacactcccttggaaaacagtaaacatcattttggaatgtgaacaaccagagactacacaggagaaaggaaaaaaaaattctgaagatgcaaaatcttgggtggcttcaccgttcagttttttaataaaaggaacaatatacaacacgttgttctttttctcttttgaaatcccttctattacagtgatttttttctaagattgtcaggatttgaagtgtatgttttgttttattcacagcgtaaattttattcacagtttaactgtctgcctgagtgtctttcctttctctaattaccttgaggaacccaagagcctgttgtaaggagaaaataaggcccttggatctcttgagattcacagatataagttattgaagggaagatggtcctatggaggacatatttaaagaagggaaaaaagaggctttctcagatatgtcagactgctatagtatacttctacagattatagacctccagtacctctggccagaaagatggtatcgtaaacaccctattttttttcttttcttttttcattaggtacaagctttgtgctaagaagttgacatactataagctacaaaagttctgtaaagtagatataactagtttcattttatagatagagaaaattaatctcttacagtgctaagctcacagagtttctaactgtaaaatgctagaacttgtctttcaagcctaaagacttccttggggctaaatagtgaaaaaagccatttcacaaataagtaaatggtatttagaggcatatttggatttcctggtaaattccagtctgtgagcatcatgaatattagtttaatgttgcatgggctcatgttgaagttttaagagaagaactgccttgaagcttaggtttccttagctattaggctactgactttcttgcctaaaccagggttttttcattgaagaccaaaacttaccttctccttcagtttgtagtttggaaattggtagaagagctttgtaaacttcaaattaagtacaaactaagtgtcatagtcaaatttactaatcttaattacagtattgttcaactgattgctatcttctagctctttcctgccgaataatggtcttgtttcctgctctgttggtttagagctgacttctttcagctttggtaagcctgaaattatggggttatgtttaattcatattgtctgggtggactttcctctcttgcatttctgcttgaatagaagaatttttctctagagagtagtttgtcatccttactctgttgattcagatgactctttgtatgatctgagaggtatactgttctgctattctgagaagaagtatttcagaaagatgaattaagagtacagtggactgctcccacctggaaacttttatctatctcacctctggacctgataaattctttatcactcaggaccttgatgacgctgctctctgaaaccctccccagctctctctattaccgtgagaaacatcagaactttggttcccattgcatatcgcaggtacctctgctttcatgccatgctgtaatggagtgattgggtagcatgttttcatctctttccagattgaaaatctgtatttctccctgtatatcttcaacacctaatgcacatagaactttgtaggtacctggaaaatgcaccacagttttcttttctttttgcagacttttcacaagtattaccaacttacaaagaattaattttgtaggattctagaaagacaaatcaggaatggtgccatatacatcttttttgattccctgctctaaagaatattatcaggttaccttcctgcagagttttaaaagaattgcatatttcaagctgactttcaggatgtaaatataaccaaagcaactgatatgtaaaaaatatattcaatggcattcctagattttcttctagggtgttttattgttttgggttttacatttaagtctttaatccatcttgagttaatttttgtataggtataagaaaggggtccagttttaattttctgcgtatggctagccagttctcccagcaccatttattaaatagggaatcctttccctattgtttgtttttgtacggtttgtcaaagattagatggttgtagatgtgtggtcttatttctgagatcttcattctcttccactggtctatgtgtctgtttttgtaccatgcttttttggttactgtagccttgtagtatagtatgaaagatagcatgatgcctccaggtttgttctttttgcttaggattgtcttggctatacgagcttttttttggttctatatgaattttaaaatagtttcttctaattgtgtgaagaatgttaatggtagtttaatgggaatagcattgaatctgtgaattgctttgggcagtatggccattttcatgatattgattcttcctatccatgagcatgtaacgtttttcccttcgtttgtgtcctctctcatttccttgagtagtggtttgtagttctccttgaagagatccttcacttcttctgtattcctagatattttattctctctgtagctattgggaatgggagttcattcatgattttgctctctgcttgccttttgttggtgtatagggatcctggtgacttctgcacattgattttgtatcctgagactttaccgaagttgcttatcagcttaagaagcttttgggctgagatgatggggttttctagatataggatcatgttatcttcaaacaaagacaatttgacttcctctcttcctatttgagtacgctttatttctttctcttgcctgattgccctggccagaactcccaatactatattgaataagaatggtgagagagggcatccttgtcttgtgccagttttcacggggaatgcttccagcttttgcccattcagtatgatattatctgtgggtttctcataaaaagctcttattatttgagatacgttccttcaatacctagtttattgagagtttttaacatgaagcgatgttgaattgtatcgaaggccttttctgtgtctattgagataatcatgtggtttttgtctttagttctgtttatgtgatgaatgacgtttattgatttgcatatgttgaaccggccttgcatcctggggatgaagccaacttgactgtggtagataagcttttggatgtgctgctggatttggtttatcagtatttcattgagattttttgcgtcgaagttcatcagggatattggactgaagttttctttttgttgtcgtatctctgccaggttttggtatcaggatgatgctggcctcataaaatgagttagggaggagtccctccttttcaattgtttggaatagtttcagaagaaagggtatcagctcctctttgtacctctggtagaattcaactgtaaatccatctggtcctggactttttttcattagtaggctatttattactgcctcactttcataacttgttattgatctattcagggatccaacttcttcctgattcagtcttgggagtgtgtatgcatccaggaatttatccatttcttctagattttctagtttctttgcatagaggtgtttgtagtatttgctgttggttgtttgtacttctgtgagatcagtggtggtatcctgtttatcattttttattgtgtctgtttgattcttctcttatttttgacaaagctgacaaaaagaagcaatagggaaaggactctctattcaattaatcctactgtatatctggctagccatatgcagaaaattgaaactgttcctgtttcttaatccatatacgaaaatcaacttacgatggattaaagacttaaatgtaaaacccaaaattataaaaccctggaatagaatataggcaatatcattctggacataggaatgggcaaagattttatgagaaagacaccaaaagcaattacaacaaaagcaaaaattggcaaatgagatctaattaaactaaagagctctgcacagcaaaagaaactactgtcagagtgaacaggcaaccaacagaatgggagaaaattttttcaatctatccatatgacaaaggtctaacatccagaatctacaaggaacttaacaaatttacaagaaaaaaggagccccattaaaaagttggcaaagaacatgaacagacacttcccagaagatattcatgtggccaataaacatgaagaaaagctcaacatcactgaccattagagacgtgcatatcaaaatcacaatgagataccatctcatgtcacaatggtgattattaaaaagtcaaacaacatgctagtgaggttgtagagaaataagaacgcttttacactgttggtgggaatgtcaactaattcaaccactgtggaagacagtgtggtgattcctcaaggatttagaaccagaaatatcattactgcatatagacccaaaggaatagaaatcattctattacaaagatacatgcacatgtatgtttattacagcactattcacaatagcaaagacatggaatcaacccaaatgctcatcagtgatagactggaaaaagagaatgtggaacataaacaccatggaatactatgcagcaataaaaaggaatgagatcctgtccttttcagggacatggatggagttggaagctgttatcctcagcaaactaatgcaggaacagaaaaccaaccaccacatgttctcacttataagtgggagctgaacaatagaacacatgggcacagggaggggaataacacacactggggccagtcagggggtggggggtcaagctgagggagagcattagaaaaaatagctaatgcattctgggcttaacccatttatgcctagtgttccatttctggaatgctaagcatgtggaagttctttatatcctgctcaaggtcattgccaaggtctgatttttcacattcaacaaattgcaacctctggcataaatgggttaatacctaggtgatgagttgataggtgcaggaaaccaccatggcacatgtttatctatgtaagaaacctgcacatcctacacatgtaccctggaacttaaaaaatttaaaatatatatgtatatatatttaatatggaattttaaaaattactaatgagttcttttatctgagtaattttgcatcaacatgcttttattatggaagagaagattcagtgagtacaaaattgcagatacatgtgtcagaagatccctgaatataataaggcttagtattctgtgtcataattgcctgtttgtattcctctctggtctttaaacttcattagggcaaggatcaactccatcttactaaccatttgattccctatgtattacacgatatatgaccaataataagccttcaataaatacttgtaaaataaagaatgttatgtaatata

SEQ ID NO: 4872 - DNA, 747 bp, Homo sapiens
gctagcccgcagcgctcggcttcctggtaattcttcacctcttttctcagctccctgcagcatgggtgctgggccctccttgctgctcgccgccctcctgctgcttctctccggcgacggcgccgtgcgctgcgacacacctgccaactgcacctatcttgacctgctgggcacctgggtcttccaggtgggctccagcggttcccagcgcgatgtcaactgctcggttatgggaccacaagaaaaaaaagtagtggtgtaccttcagaagctggatacagcatatgatgaccttggcaattctggccatttcaccatcatttacaaccaaggctttgagattgtgttgaatgactacaagtggtttgccttttttaaggatgtcactgattttatcagtcatttgttcatgcagctgggaactgtggggatatatgatttgccacatctgaggaacaaactggccatgaacagacgttggggctaagagacagagcagcctgcgacagtgtggacctacctgtagcagctagcaaaggcctctagcagctacagtcccttctggagtctttatttgcatgcaaaatgcaaaggagtcctggtgacctacctccaaggcagctgccctcctgaacactcccttggaaaacagtaaacatcattttggaatgtgaacaaccagagactacacaggagaaaggaaaaaaaaattctgaagatgcaaaatcttgggtggcttcaccgttc

SEQ ID NO: 4873 - DNA, 2228 bp, Homo sapiens
atcattcggccctcagactgggctgggcaggtctgagagttagggaaagtccgttcccactgccctcggggagagaagaaaggagggggcaagggagaagctgctggtcggactcacaatgaaaacgctccttcttttgctgctggtgctcctggagctgggagaggcccaaggatcccttcacagggtgcccctcaggaggcatccgtccctcaagaagaagctgcgggcacggagccagctctctgagttctggaaatcccataatttggacatgatccagttcaccgagtcctgctcaatggaccagagtgccaaggaacccctcatcaactacttggatatggaatacttcggcactatctccattggctccccaccacagaacttcactgtcatcttcgacactggctcctccaacctctgggtcccctctgtgtactgcactagcccagcctgcaagacgcacagcaggttccagccttcccagtccagcacatacagccagccaggtcaatctttctccattcagtatggaaccgggagcttgtccgggatcattggagccgaccaagtctctgtggaaggactaaccgtggttggccagcagtttggagaaagtgtcacagagccaggccagacctttgtggatgcagagtttgatggaattctgggcctgggatacccctccttggctgtgggaggagtgactccagtatttgacaacatgatggctcagaacctggtggacttgccgatgttttctgtctacatgagcagtaacccagaaggtggtgcggggagcgagctgatttttggaggctacgaccactcccatttctctgggagcctgaattgggtcccagtcaccaagcaagcttactggcagattgcactggataacatccaggtgggaggcactgttatgttctgctccgagggctgccaggccattgtggacacagggacttccctcatcactggcccttccgacaagattaagcagctgcaaaacgccattggggcagcccccgtggatggagaatatgctgtggagtgtgccaaccttaacgtcatgccggatgtcaccttcaccattaacggagtcccctataccctcagcccaactgcctacaccctactggacttcgtggatggaatgcagttctgcagcagtggctttcaaggacttgacatccaccctccagctgggcccctctggatcctgggggatgtcttcattcgacagttttactcagtctttgaccgtgggaataaccgtgtgggactggccccagcagtcccctaaggaggggccttgtgtctgtgcctgcctgtctgacagaccttgaatatgttaggctggggcattctttacacctacaaaaagttattttccagagaatgtagctgtttccagggttgcaacttgaattaagaccaaacagaacatgagaatacacacacacacacacatatacacacacacacacttcacacatacacaccactcccaccaccgtcatgatggaggaattacgttatacattcatattttgtattgatttttgattatgaaaatcaaaaattttcacatttgattatgaaaatctccaaacatatgcacaagcagagatcatggtataataaatccctttgcaactccactcagccctgacaacccatccacacacggccaggcctgtttatctacactgctgcccactcctctctccagctccacatgctgtacctggatcattctgaagcaaattccgagcattacatcattttgtccataaatatttctaacatccttaaatatacaatcggaattcaagcatctcccattgtcccacaaatgtttggctgtttttgtagttggattgtttgtattaggattcaagcaaggcccatatattgcatttatttgaaatgtctgtaagtctctttccatctacagagtttagcacatttgaacgttgctggttgaaatcccgaggtgtcatttgacatggttctctgaacttatctttcctataaaatggtagttagatctggaggtctgattttgtggcaaaaatacttcctaggtggtgctgggtacttcttgttgcatcctgtcaggaggcagataatgctggtgcctctctattggtaatgttaagactgctgggtgggtttggagttcttggctttaatcattcattacaaagttcagcatttta

SEQ ID NO: 4874 - DNA, 2071 bp, Homo sapiens
agactgggctgggcaggtctgagagttagggaaagtccgttcccactgccctcggggagagaagaaaggagggggcaagggagaagctgctggtcggactcacaatgaaaacgctccttcttttgctgctggtgctcctggagctgggagaggcccaaggatcccttcacagggtgcccctcaggaggcatccgtccctcaagaagaagctgcgggcacggagccagctctctgagttctggaaatcccataatttggacatgatccagttcaccgagtcctgctcaatggaccagagtgccaaggaacccctcatcaactacttggatatggaatacttcggcactatctccattggctccccaccacagaacttcactgtcatcttcgacactggctcctccaacctctgggtcccctctgtgtactgcactagcccagcctgcaagacgcacagcaggttccagccttcccagtccagcacatacagccagccaggtcaatctttctccattcagtatggaaccgggagcttgtccgggatcattggagccgaccaagtctctgtggaaggactaaccgtggttggccagcagtttggagaaagtgtcacagagccaggccagacctttgtggatgcagagtttgatggaattctgggcctgggatacccctccttggctgtgggaggagtgactccagtatttgacaacatgatggctcagaacctggtggacttgccgatgttttctgtctacatgagcagtaacccagaaggtggtgcggggagcgagctgatttttggaggctacgaccactcccatttctctgggagcctgaattgggtcccagtcaccaagcaagcttactggcagattgcactggataatatgctgtggagtgtgccaaccttaacgtcatgccggatgtcaccttcaccattaacggagtcccctataccctcagcccaactgcctacaccctactggacttcgtggatggaatgcagttctgcagcagtggctttcaaggacttgacatccaccctccagctgggcccctctggatcctgggggatgtcttcattcgacagttttactcagtctttgaccgtgggaataaccgtgtgggactggccccagcagtcccctaaggaggggccttgtgtctgtgcctgcctgtctgacagaccttgaatatgttaggctggggcattctttacacctacaaaaagttattttccagagaatgtagctgtttccagggttgcaacttgaattaagaccaaacagaacatgagaatacacacacacacacacatatacacacacacacacttcacacatacacaccactcccaccaccgtcatgatggaggaattacgttatacattcatattttgtattgatttttgattatgaaaatcaaaaattttcacatttgattatgaaaatctccaaacatatgcacaagcagagatcatggtataataaatccctttgcaactccactcagccctgacaacccatccacacacggccaggcctgtttatctacactgctgcccactcctctctccagctccacatgctgtacctggatcattctgaagcaaattccgagcattacatcattttgtccataaatatttctaacatccttaaatatacaatcggaattcaagcatctcccattgtcccacaaatgtttggctgtttttgtagttggattgtttgtattaggattcaagcaaggcccatatattgcatttatttgaaatgtctgtaagtctctttccatctacagagtttagcacatttgaacgttgctggttgaaatcccgaggtgtcatttgacatggttctctgaacttatctttcctataaaatggtagttagatctggaggtctgattttgtggcaaaaatacttcctaggtggtgctgggtacttcttgttgcatcctgtcaggaggcagataatgctggtgcctctctattggtaatgttaagactgctgggtgggtttggagttcttggctttaatcattcattacaaagttcagcatttt

SEQ ID NO: 4875 - DNA, 2243 bp, Homo sapiens
atcattcggccctcagactgggctgggcaggtctgagagttagggaaagtccgttcccactgccctcggggagagaagaaaggagggggcaagggagaagctgctggtcggactcacaatgaaaacgctccttcttttgctgctggtgctcctggagctgggagaggcccaaggatcccttcacagggtgcccctcaggaggcatccgtccctcaagaagaagctgcgggcacggagccagctctctgagttctggaaatcccataatttggacatgatccagttcaccgagtcctgctcaatggaccagagtgccaaggaacccctcatcaactacttggatatggaatacttcggcactatctccattggctccccaccacagaacttcactgtcatcttcgacactggctcctccaacctctgggtcccctctgtgtactgcactagcccagcctgcaagacgcacagcaggttccagccttcccagtccagcacatacagccagccaggtcaatctttctccattcagtatggaaccgggagcttgtccgggatcattggagccgaccaagtctctgctttctcctaccaggtggaaggactaaccgtggttggccagcagtttggagaaagtgtcacagagccaggccagacctttgtggatgcagagtttgatggaattctgggcctgggatacccctccttggctgtgggaggagtgactccagtatttgacaacatgatggctcagaacctggtggacttgccgatgttttctgtctacatgagcagtaacccagaaggtggtgcggggagcgagctgatttttggaggctacgaccactcccatttctctgggagcctgaattgggtcccagtcaccaagcaagcttactggcagattgcactggataacatccaggtgggaggcactgttatgttctgctccgagggctgccaggccattgtggacacagggacttccctcatcactggcccttccgacaagattaagcagctgcaaaacgccattggggcagcccccgtggatggagaatatgctgtggagtgtgccaaccttaacgtcatgccggatgtcaccttcaccattaacggagtcccctataccctcagcccaactgcctacaccctactggacttcgtggatggaatgcagttctgcagcagtggctttcaaggacttgacatccaccctccagctgggcccctctggatcctgggggatgtcttcattcgacagttttactcagtctttgaccgtgggaataaccgtgtgggactggccccagcagtcccctaaggaggggccttgtgtctgtgcctgcctgtctgacagaccttgaatatgttaggctggggcattctttacacctacaaaaagttattttccagagaatgtagctgtttccagggttgcaacttgaattaagaccaaacagaacatgagaatacacacacacacacacatatacacacacacacacttcacacatacacaccactcccaccaccgtcatgatggaggaattacgttatacattcatattttgtattgatttttgattatgaaaatcaaaaattttcacatttgattatgaaaatctccaaacatatgcacaagcagagatcatggtataataaatccctttgcaactccactcagccctgacaacccatccacacacggccaggcctgtttatctacactgctgcccactcctctctccagctccacatgctgtacctggatcattctgaagcaaattccgagcattacatcattttgtccataaatatttctaacatccttaaatatacaatcggaattcaagcatctcccattgtcccacaaatgtttggctgtttttgtagttggattgtttgtattaggattcaagcaaggcccatatattgcatttatttgaaatgtctgtaagtctctttccatctacagagtttagcacatttgaacgttgctggttgaaatcccgaggtgtcatttgacatggttctctgaacttatctttcctataaaatggtagttagatctggaggtctgattttgtggcaaaaatacttcctaggtggtgctgggtacttcttgttgcatcctgtcaggaggcagataatgctggtgcctctctattggtaatgttaagactgctgggtgggtttggagttcttggctttaatcattcattacaaagttcagcatttta

SEQ ID NO: 4876 - DNA, 1238 bp, Homo sapiens
gctcctggagctgggagaggcccaaggatcccttcacagatggaatacttcggcactatctccattggctccccaccacagaacttcactgtcatcttcgacactggctcctccaacctctgggtcccctctgtgtactgcactagcccagcctgcaagacgcacagcaggttccagccttcccagtccagcacatacagccagccaggtcaatctttctccattcagtatggaaccgggagcttgtccgggatcattggagccgaccaagtctctgtggaaggactaaccgtggttggccagcagtttggagaaagtgtcacagagccaggccagacctttgtggatgcagagtttgatggaattctgggcctgggatacccctccttggctgtgggaggagtgactccagtatttgacaacatgatggctcagaacctggtggacttgccgatgttttctgtctacatgagcagtaacccagaaggtggtgcggggagcgagctgatttttggaggctacgaccactcccatttctctgggagcctgaattgggtcccagtcaccaagcaagcttactggcagattgcactggataatatgctgtggagtgtgccaaccttaacgtcatgccggatgtcaccttcaccattaacggagtcccctataccctcagcccaactgcctacaccctactggacttcgtggatggaatgcagttctgcagcagtggctttcaaggacttgacatccaccctccagctgggcccctctggatcctgggggatgtcttcattcgacagttttactcagtctttgaccgtgggaataaccgtgtgggactggccccagcagtcccctaaggaggggccttgtgtctgtgcctgcctgtctgacagaccttgaatatgttaggctggggcattctttacacctacaaaaagttattttccagagaatgtagctgtttccagggttgcaacttgaattaagaccaaacagaacatgagaatacacacacacacacacatatacacacacacacacttcacacatacacaccactcccaccaccgtcatgatggaggaattacgttatacattcatattttgtattgatttttgattatgaaaatcaaaaattttcacatttgattatgaaaatctccaaacatatgcacaagcagagatcatggtataataaatccctttgcaactccactcagccctgacaaccc

SEQ ID NO: 4877 - DNA, 2035 bp, Homo sapiens
gtgccgtcgccccgctggagggaggactcaggccccgctggccgcgggctcggtacccggtgggtcggtggagcgtctgttgggtccgggccgccggcttcgccctcgccatggcgccctggctgcagctcctgtcgctgctggggctgctcccgggcgcagtggccgcccccgcccagccccgagccgccagctttcaggcctgggggccgccgtccccggagctgctggcgcccacccgcttcgcgctggagatgttcaaccgcggccgggctgcggggacgcgggccgtgctgggccttgtgcgcggccgcgtccgccgggcgggtcaggggtcgctgtactccctggaggccaccctggaggagccaccctgcaacgaccccatggtgtgccggctccccgtgtccaagaaaaccctgctctgcagcttccaagtcctggatgagctcggaagacacgtgctgctgcggaaggactgtggcccagtggacaccaaggttccaggtgctggggagcccaagtcagccttcactcagggctcagccatgatttcttctctgtcccaaaaccatccagacaacagaaacgagactttcagctcagtcatttccctgttgaatgaggatcccctgtcccaggacttgcctgtgaagatggcttcaatcttcaagaactttgtcattacctataaccggacatatgagtcaaaggaagaagcccggtggcgcctgtccgtctttgtcaataacatggtgcgagcacagaagatccaggccctggaccgtggcacagctcagtatggagtcaccaagttcagtgatctcacagaggaggagttccgcactatctacctgaatactctcctgaggaaagagcctggcaacaagatgaagcaagccaagtctgtgggtgacctcgccccacctgaatgggactggaggagtaagggggctgtcacaaaagtcaaagaccagggcatgtgtggctcctgctgggccttctcagtcacaggcaatgtggagggccagtggtttctcaaccaggggaccctgctctccctctctgaacaggagctcttggactgtgacaagatggacaaggcctgcatgggcggcttgccctccaatgcctactcggccataaagaatttgggagggctggagacagaggatgactacagctaccagggtcacatgcagtcctgcaacttctcagcagagaaggccaaggtctacatcaatgactccgtggagctgagccagaacgagcagaagctggcagcctggctggccaagagaggcccaatctccgtggccatcaatgcctttggcatgcagttttaccgccacgggatctcccgccctctccggcccctctgcagcccttggctcattgaccatgcggtgttgcttgtgggctacggcaaccgctctgacgttcccttttgggccatcaagaacagctggggcactgactggggtgagaagggttactactacttgcatcgtgggtccggggcctgtggcgtgaacaccatggccagctcggcggtggtggactgaagaggggcccccagctcgggacctggtgctgatcagagtggctgctgccccagcctgacatgtgtccaggcccctccccgggaggtacagctggcagagggaaaggcactgggtacctcagggtgagcagagggcactgggctggggcacagcccctgcttccctgcaccccattcccaccctgaagttctgcacctgcacctttgttgaattgtggtagcttaggaggatgtcggggtgaagggtggtatcttggcagttgaagctggggcaagaactctgggcttgggtaatgagcaggaagaaaattttctgatcttaagcccagctctgttctgcccccgctttcctctgtttgatactataaattttctggttcccttggatttagggatagtgtccctctccatgtccaggaaacttgtaaccacccttttctaacagcaataaagaggtgtccttgtcccgag

SEQ ID NO: 4878 - DNA, 886 bp, Homo sapiens
gcacagcagcaactgactgggcagcctttcaggaaagatgcagccactcctgcttctgctggcctttctcctacccactggggctgaggcaggggagatcatcggaggccgggagagcaggccccactcccgcccctacatggcgtatcttcagatccagagtccagcaggtcagagcagatgtggagggttcctggtgcgagaagactttgtgctgacagcagctcattgctggggaagcaatataaatgtcaccctgggcgcccacaatatccagagacgggaaaacacccagcaacacatcactgcgcgcagagccatccgccaccctcaatataatcagcggaccatccagaatgacatcatgttattgcagctgagcagaagagtcagacggaatcgaaacgtgaacccagtggctctgcctagagcccaggagggactgagacccgggacgctgtgcactgtggccggctggggcagggtcagcatgaggaggggaacagatacactccgagaggtgcagctgagagtgcagagggataggcagtgcctccgcatcttcggttcctacgacccccgaaggcagatttgtgtgggggaccggcgggaacggaaggctgccttcaagggggattccggaggccccctgctgtgtaacaatgtggcccacggcatcgtctcctatggaaagtcgtcaggggttcctccagaagtcttcaccagggtctcaagtttcctgccctggataaggacaacaatgagaagcttcaaactgctggatcagatggagacccccctgtgactgactcttcttctcggggacacaggccagctccacagtgttgccagagccttaataaacgtccacagagtataaataacc

SEQ ID NO: 4879 - DNA, 2190 bp, Homo sapiens
tcccgccgctcctccacgctcgtgccgctccccccccgcgctcccagttgacgctctgggccgccacctccgcggaccctgagcgcaagagccaagccgccagcgctgcgatgtgggccacgctgccgctgctctgcgccggggcctggctcctgggagtccccgtctgcggtgccgccgaactgtgcgtgaactccttagagaagtttcacttcaagtcatggatgtctaagcaccgtaagacctacagtacggaggagtaccaccacaggctgcagacgtttgccagcaactggaggaagataaacgcccacaacaatgggaaccacacatttaaaatggcactgaaccaattttcagacatgagctttgctgaaataaaacacaagtatctctggtcagagcctcagaattgctcagccaccaaaagtaactaccttcgaggtactggtccctacccaccttccgtggactggcggaaaaaaggaaattttgtctcacctgtgaaaaatcagggtgcctgcggcagttgctggactttctccaccactggggccctggagtctgcgatcgccatcgcaaccggaaagatgctgtccttggcggaacagcagctggtggactgcgcccaggacttcaataatcacggctgccaagggggtctccccagccaggctttcgagtatatcctgtacaacaaggggatcatgggtgaagacacctacccctaccagggcaaggatggttattgcaagttccaacctggaaaggccatcggctttgtcaaggatgtagccaacatcacaatctatgacgaggaagcgatggtggaggctgtggccctctacaaccctgtgagctttgcctttgaggtgactcaggacttcatgatgtatagaaccggcatctactccagtacttcctgccataaaactccagataaagtaaaccatgcagtactggctgttgggtatggagaaaaaaatgggatcccttactggatcgtgaaaaactcttggggtccccagtggggaatgaacgggtacttcctcatcgagcgcggaaagaacatgtgtggcctggctgcctgcgcctcctaccccatccctctggtgtgagccgtggcagccgcagcgcagactggcggagaaggagaggaacgggcagcctgggcctgggtggaaatcctgccctggaggaagttgtggggagatccactgggacccccaacattctgccctcacctctgtgcccagcctggaaacctacagacaaggaggagttccaccatgagctcacccgtgtctatgacgcaaagatcaccagccatgtgccttagtgtccttcttaacagactcaaaccacatggaccacgaatattctttctgtccagaagggctactttccacatatagagctccagggactgtcttttctgtattcgctgttcaataaacattgagtgagcacctccccagatggagcatgctggtcctgggccatgactcaaaccaggtctgtcctcgccactcagtctcccaggagggaggcatcagggggtgtccaggctctggctgggaggatggtgggggtgctggcggtattatccaccagatggggtatccaggatgaagagcaggcttaatttgagatcttgactatttgtcccaaacctgagtggagaggtggggaggaaggagaaaaacgggccaagctgcggcagaggcaggattcaaacccacaatgtcagcccagaagcctgtacttctctgtgtggcctccccagtctcagctgcctactcctactcagactctgccccccacctccacatgagactgcccaccccttcctcaccaaccccttatttatttcaaacgtgcccagatgctcctgtcgtttccacaccatcccttcccttatcttgccttttgagaaatcttgatctctgtttagagggcggccatgaagttgctgctgcttcctgaagcctccgggctctgggatgtctgtagaacaagctggagtccaccagctctttgtcctatggctcacagactttcttaatgataaaagctgtcatcttatttgggcttcctgaaaagctaaaggcttgagaatatttgaaaaatatatatgttcatgataaggcttatttagataatgcaaatatagtttaatttattagaaaa

SEQ ID NO: 4880 - DNA, 972 bp, Homo sapiens
atgtgggccacgctgccgctgctctgcgccgccgaactgtgcgtgaactccttagagaagtttcacttcaagtcatggatgtctaagcaccgtaagacctacagtacggaggagtaccaccacaggctgcagacgtttgccagcaactggaggaagataaacgcccacaacaatgggaaccacacatttaaaatggcactgaaccaattttcagacatgagctttgctgaaataaaacacaagtatctctggtcagagcctcagaattgctcagccaccaaaagtaactaccttcgaggtactggtccctacccaccttccgtggactggcggaaaaaaggaaattttgtctcacctgtgaaaaatcagggtgcctgcggcagttgctggactttctccaccactggggccctggagtctgcgatcgccatcgcaaccggaaagatgctgtccttggcggaacagcagctggtggactgcgcccaggacttcaataatcacggctgccaagggggtctccccagccaggctttcgagtatatcctgtacaacaaggggatcatgggtgaagacacctacccctaccagggcaaggatggttattgcaagttccaacctggaaaggccatcggctttgtcaaggatgtagccaacatcacaatctatgacgaggaagcgatggtggaggctgtggccctctacaaccctgtgagctttgcctttgaggtgactcaggacttcatgatgtatagaaccggcatctactccagtacttcctgccataaaactccagataaagtaaaccatgcagtactggctgttgggtatggagaaaaaaatgggatcccttactggatcgtgaaaaactcttggggtccccagtggggaatgaacgggtacttcctcatcgagcgcggaaagaacatgtgtggcctggctgcctgcgcctcctaccccatccctctggtgtga

SEQ ID NO: 4881 - DNA, 718 bp, Homo sapiens
ccacgctcgtgccgctccccccccgcgctcccagttgacgctctgggccgccacctccgcggaccctgagcgcaagagccaagccgccagcgctgcgatgtgggccacgctgccgctgctctgcgccggggcctggctcctgggagtccccgtctgcggtgccgccgaactgtgcgtgaactccttagagaagtttcacttcaagtcatggatgtctaagcaccgtaagacctacagtacggaggagtaccaccacaggctgcagacgtttgccagcaactggaggaagataaacgcccacaacaatgggaaccacacatttaaaatggcactgaaccaattttcagacatgagctttgctgaaataaaacacaagtatctctggtcagagcctcagaattgctcagccaccaaaagtaactaccttcgaggtactggtccctacccaccttccgtggactggcggaaaaaaggaaattttgtctcacctgtgaaaaatcaggtatgcctggcaatctccatcctctccctgcaaaacggccacactcccagacaatacaccaggaagaacaactcaaaaggtccacaaaaccaccacaagcacatccctgcctctgtttcctctcggcatctctcaccaggccgtccctccctcccccagctgagagagatatgtgaagggaagagattgggtgaggccagtgtcaacctagggtga

SEQ ID NO: 4882 - DNA, 1692 bp, Homo sapiens
gatcactggagctgacttccgcaatcccgatggaataaatctagcacccctgatggtgtgcccacactttgctgccgaaacgaagccagacaacagatttccatcagcaggatgtgggggctcaaggttctgctgctacctgtggtgagctttgctctgtaccctgaggagatactggacacccactgggagctatggaagaagacccacaggaagcaatataacaacaaggtggatgaaatctctcggcgtttaatttgggaaaaaaacctgaagtatatttccatccataaccttgaggcttctcttggtgtccatacatatgaactggctatgaaccacctgggggacatgaccagtgaagaggtggttcagaagatgactggactcaaagtacccctgtctcattcccgcagtaatgacaccctttatatcccagaatgggaaggtagagccccagactctgtcgactatcgaaagaaaggatatgttactcctgtcaaaaatcagggtcagtgtggttcctgttgggcttttagctctgtgggtgccctggagggccaactcaagaagaaaactggcaaactcttaaatctgagtccccagaacctagtggattgtgtgtctgagaatgatggctgtggagggggctacatgaccaatgccttccaatatgtgcagaagaaccggggtattgactctgaagatgcctacccatatgtgggacaggaagagagttgtatgtacaacccaacaggcaaggcagctaaatgcagagggtacagagagatccccgaggggaatgagaaagccctgaagagggcagtggcccgagtgggacctgtctctgtggccattgatgcaagcctgacctccttccagttttacagcaaaggtgtgtattatgatgaaagctgcaatagcgataatctgaaccatgcagttttggcagtgggatatggaatccagaagggaaacaagcactggataattaaaaacagctggggagaaaactggggaaacaaaggatatatcctcatggctcgaaataagaacaacgcctgtggcattgccaacctggccagcttccccaagatgtgactccagccagccaaatccatcctgctcttccatttcttccacgatggtgcagtgtaacgatgcactttggaagggagttggtgtgctatttttgaagcagatgtggtgatactgagattgtctgttcagtttccccatttgtttgtgcttcaaatgatccttcctactttgcttctctccacccatgacctttttcactgtggccatcaggactttccctgacagctgtgtactcttaggctaagagatgtgactacagcctgcccctgactgtgttgtcccagggctgatgctgtacaggtacaggctggagattttcacataggttagattctcattcacgggactagttagctttaagcaccctagaggactagggtaatctgacttctcacttcctaagttcccttctatatcctcaaggtagaaatgtctatgttttctactccaattcataaatctattcataagtctttggtacaagtttacatgataaaaagaaatgtgatttgtcttcccttctttgcacttttgaaataaagtatttatctcctgtctacagtttaataaatagcatctagtacacattca

SEQ ID NO: 4883 - DNA, 785 bp, Homo sapiens
ggaagaagaaatgcataaggagaatgaggagatatacaatgtctcagaaaacaggaaacattgtcctattttcccttgtcctcttctgacaagatctgggaaagtaccagaatttaggcacgaaagagaagaacgcctcgaagaaatgatcaggaggcaaaacttagacggaaatctctcctttgtgatgtgggggctcaaggttctgctgctacctgtggtgagctttgctctgtaccctgaggagatactggacacccactgggagctatggaagaagacccacaggaagcaatataacaacaaggtggatgaaatctctcggcgtttaatttgggaaaaaaacctgaagtatatttccatccataaccttgaggcttctcttggtgtccatacatatgaactggctatgaaccacctgggggacatgaccagtgaagaggtggttcagaagatgactggactcaaagtacccctgtctcattcccgcagtaatgacaccctttatatcccagaatgggaaggtagagccccagactctgtcgactatcgaaagaaaggatatgttactcctgtcaaaaatcagggtcagtgtggttcctgttgggcttttagctctgtgggtgccctggagggccaactcaagaagaaaactggcaaactcttaaatctgagtccccagaacctagtggattgtgtgtctgagaatgatggctgtggagggggctacatgaccaatgccttccaatatgtgcagaagaaccggggtattgactctgaagatg

SEQ ID NO: 4884 - DNA, 1546 bp, Homo sapiens
ggtaggcgcgcccagacctgagacgggttgggactgggctgcgtcacgcgcgggctctaagcgcccggggccccgcccagtggccggcacagccaatcgcagcgcgggaaggcggtgggggcggggaaggccgcctggaaacttaaatcccgaggcgggcgaacctgcaccagaccgcggacgtctgtaatctcagaggcttgtttgctgagggtgcctgcgcagctgcgacggctgctggttttgaaacatgaatctttcgctcgtcctggctgccttttgcttgggaatagcctccgctgttccaaaatttgaccaaaatttggatacaaagtggtaccagtggaaggcaacacacagaagattatatggcgcgaatgaagaaggatggaggagagcagtgtgggaaaagaatatgaaaatgattgaactgcacaatggggaatacagccaagggaaacatggcttcacaatggccatgaatgcttttggtgacatgaccaatgaagaattcaggcagatgatgggttgctttcgaaaccagaaattcaggaaggggaaagtgttccgtgagcctctgtttcttgatcttcccaaatctgtggattggagaaagaaaggctacgtgacgccagtgaagaatcagaaacagtgtggttcttgttgggcttttagtgcgactggtgctcttgaaggacagatgttccggaaaactgggaaacttgtctcactgagcgagcagaatctggtggactgttcgcgtcctcaaggcaatcagggctgcaatggtggcttcatggctagggccttccagtatgtcaaggagaacggaggcctggactctgaggaatcctatccatatgtagcagtggatgaaatctgtaagtacagacctgagaattctgttgctaatgacactggcttcacagtggtcgcacctggaaaggagaaggccctgatgaaagcagtcgcaactgtggggcccatctccgttgctatggatgcaggccattcgtccttccagttctacaaatcaggcatttattttgaaccagactgcagcagcaaaaacctggatcatggtgttctggtggttggctacggctttgaaggagcaaattcgaataacagcaagtattggctcgtcaaaaacagctggggtccagaatggggctcgaatggctatgtaaaaatagccaaagacaagaacaaccactgtggaatcgccacagcagccagctaccccaatgtgtgagctgatggatggtgaggaggaaggacttaaggacagcatgtctggggaaattttatcttgaaactgaccaaacgcttattgtgtaagataaaccagttgaatcattgaggatccaagttgagattttaattctgtgacatttttacaagggtaaaatgttaccactactttaattattgttatacacagctttatgatatcaaagactcattgcttaattctaagacttttgaattttcattttttaaaaagatgtacaaaacagtttgaaataaattttaattcgtatat

SEQ ID NO: 4885 - DNA, 1052 bp, Homo sapiens
cttctaaagccctgatgcacccacccttaagtggaaggttttgaaacatgaatctttcgctcgtcctggctgccttttgcttgggaatagcctccgctgttccaaaatttgaccaaaatttggatacaaagtggtaccagtggaaggcaacacacagaagattatatggcgcgaatgaagaaggatggaggagagcagtgtgggaaaagaatatgaaaatgattgaactgcacaatggggaatacagccaagggaaacatggcttcacaatggccatgaatgcttttggtgacatgaccaatgaagaattcaggcagatgatgggttgctttcgaaaccagaaattcaggaaggggaaagtgttccgtgagcctctgtttcttgatcttcccaaatctgtggattggagaaagaaaggctacgtgacgccagtgaagaatcagaaacagtgtggttcttgttgggcttttagtgcgactggtgctcttgaaggacagatgttccggaaaactgggaaacttgtctcactgagcgagcagaatctggtggactgttcgcgtcctcaaggcaatcagggctgcaatggtggcttcatggctagggccttccagtatgtcaaggagaacggaggcctggactctgaggaatcctatccatatgtagcagtggatgaaatctgtaagtacagacctgagaattctgttgctaatgacactggcttcacagtggtcgcacctggaaaggagaaggccctgatgaaagcagtcgcaactgtggggcccatctccgttgctatggatgcaggccattcgtccttccagttctacaaatcaggcatttattttgaaccagactgcagcagcaaaaacctggatcatggtgttctggtggttggctacggctttgaaggagcaaattcgaataacagcaagtattggctcgtcaaaaacagctggggtccagaatggggctcgaatggctatgtaaaaatagccaaagacaagaacaaccactgtggaatcgccacagcagccagctaccccaatgtgtga

SEQ ID NO: 4886 - DNA, 4107 bp, Homo sapiens
gacaagggctcttcttgatggcttactgtatccactttgtccccaagaccatagggaaatgactagaggtgactgtactagctagattttaaatgaaactgaaatgaaagttcacttcctcattttgagtacctcatgtgacaagttccaatttcttttcaagtcaattgaactgaaatctccttgttgctttgaaatcttagaagagagcccactaattcaaggactcttactgtgggagcaactgctggttctatcacaatgaaacggctggtttgtgtgctcttggtgtgctcctctgcagtggcacagttgcataaagatcctaccctggatcaccactggcatctctggaagaaaacctatggcaaacaatacaaggaaaagaatgaagaagcagtacgacgtctcatctgggaaaagaatctaaagtttgtgatgcttcacaacctggagcattcaatgggaatgcactcatacgatctgggcatgaaccacctgggagacatgaccagtgaagaagtgatgtctttgatgagttccctgagagttcccagccagtggcagagaaatatcacatataagtcaaaccctaatcggatattgcctgattctgtggactggagagagaaagggtgtgttactgaagtgaaatatcaaggttcttgtggtgcttgctgggctttcagtgctgtgggggccctggaagcacagctgaagctgaaaacaggaaagctggtgtctctcagtgcccagaacctggtggattgctcaactgaaaaatatggaaacaaaggctgcaatggtggcttcatgacaacggctttccagtacatcattgataacaagggcatcgactcagacgcttcctatccctacaaagccatggatcagaaatgtcaatatgactcaaaatatcgtgctgccacatgttcaaagtacactgaacttccttatggcagagaagatgtcctgaaagaagctgtggccaataaaggcccagtgtctgttggtgtagatgcgcgtcatccttctttcttcctctacagaagtggtgtctactatgaaccatcctgtactcagaatgtgaatcatggtgtacttgtggttggctatggtgatcttaatgggaaagaatactggcttgtgaaaaacagctggggccacaactttggtgaagaaggatatattcggatggcaagaaataaaggaaatcattgtgggattgctagctttccctcttacccagaaatctagaggatctctcctttttataacaaatcaagaaatatgaagcactttctcttaacttaatttttcctgctgtatccagaagaaataattgtgtcatgattaatgtgtatttactgtactaattagaaaatatagtttgaggccgggcacggtggctcacgcctgtaatcccagtacttgggaggccaaggcaggcatatcaacttgaggccaggagttaaagagcagcctggctaacatggtgaaaccccatctctactaaaaatacaaaaaattagccgagcacggtggtgcatgcctgtaatcccagctacttgggaggctgaggcacgagattccttgaacccaagaggttgaggctatgttgagctgagatcacaccactgtactccagcctggatgacagagtggagactctgtttcaaaaaaacagaaaagaaaatatagtttgattcttcatttttttaaatttgcaaatctcaggataaagtttgctaagtaaattagtaatgtactatagatataactgtacaaaaattgttcaacctaaaacaatctgtaattgcttattgttttattgtatactctttgtctttttaagacccctaatagccttttgtaacttgatggcttaaaaatacttaataaatctgccatttcaaatttctatcattgccacataccattcttattcctaggcaactattaataatctatcctgagaatattaattgtggtattctggtgatggggtttagcaactttgatggaagaaaatattaggctataaatgtcctaaggactcagattgtatctttgtacagaagaggattcaaaacgccacgtgtagtggctcatgcctgtaatcccaacactttgggaggctgaagtaggaggatcgtcttgagcccaggagttcaagaccagcctggacaacatagtgagaccttgtctccacaaaaataaaaaagaaactatccaggagtggtggtgtgtgcctgtggtccctgctatgcagatgtctaagacaggaggatcacaagagcccaggaggttgagaatgcagtgagcttgtaattgcaccactgcactccagcctgggtgacagagcaagaccctgtcttaaaaaaagaggattcaacacatatttttatattatgttaaagtaaagaaatgcataaaagacaagcactttggaagaattattttaatgatcaacaatttaatgtattagtccaaattatttttacgtagtcatcaacaatttgaccagggcctttatttggcaaataactgagccaaccagaataaaataaccaatactccactgctcatatttttatctaattcagatggatcttccttacaactgctctagattagtagatgcatctaagcaggcagcaggaactttaaattttttaagttcatgtctatgacatgaacaatgtgtgggataatgtcattaatatatcctaaattaacctaaacgtatttcactaactctggctccttctccataaagcacattttaaggaacaagaattgctaaatataaaaacataaataataccataatacatggctatcatcaaaagtgtatagaatattatagtttaaaagtatttagttgattacttttcagttttgttttgttttttgagacggagtctcactctgttgcccaggctggagtgcagtggcaccatctcagttcactgcaacttctgcctcccgagttcaagcgattctcctgcctcagcctcccgagtagctggaattataggcgtgcaccaccacgcccagctaatttttgtatttttagtaaagacagggttttgccacattagccaggctggtctcaaactcctgacctcaggtgatccacccaccccagcctcccaaagtgctaagattacaggcgtgagccactgagcccagcctacttttcagtttttaacataatttttgttttatccacaacttttcaagtattgaaagtagaataaaaacatgggttcttagtctttagctatctgttaaagcctatgaatgccttcttaaaatcatgtttttaaatgcataaaatatataggattacaaaggaatctaattatatcgaaatacagttattaaaatgttaaaagataagtttgttatatattaatatgcatgcttctttataaatgcattaaataagagttaatagctatcctaaatttgaaatagtgataagcataatgaaaatagatgcaaaaaactaatgtgatatgaaaatatctgggtttttcttttgatgatgaagtattgctaatattaccgtggtttatgaactatgttcagaattgaagaaaatcctaactttcagttagaggttagtgacggggttcaggacaccctacacaaaatacagcactttgacatattgaatattttaagctgaaggcatttgaggaaattgcagaagcaggaaggtgactctgaccttctgcctgctgttctccccagaagcagccataaaacctgggaaggattttctgaccttcccctgaagtagatcataagactgtcatgtaagaggtgctctcctggcacccagagaaaaggagcatccttacctccaaaagcacagggacacaaagaggaatctaaacaaacaggcctctcagtttcccccagtttattacatttagcttgttcacactttgccctatgacatttctacatcactggctgctcttcatcaaacctactataaaaaacattcaagttcaactgtttctttgggcctttatttccttatggagcccctcgtgtcgtgtaaaacttatattaaataaatgtgcatgcttt

SEQ ID NO: 4887 - DNA, 3950 bp, Homo sapiens
gtacctcatgtgacaagttccaatttcttttcaagtcaattgaactgaaatctccttgttgctttgaaatcttagaagagagcccactaattcaaggactcttactgtgggagcaactgctggttctatcacaatgaaacggctggtttgtgtgctcttggtgtgctcctctgcagtggcacagttgcataaagatcctaccctggatcaccactggcatctctggaagaaaacctatggcaaacaatacaaggaaaagaatgaagaagcagtacgacgtctcatctgggaaaagaatctaaagtttgtgatgcttcacaacctggagcattcaatgggaatgcactcatacgatctgggcatgaaccacctgggagacatgggttcttgtggtgcttgctgggctttcagtgctgtgggggccctggaagcacagctgaagctgaaaacaggaaagctggtgtctctcagtgcccagaacctggtggattgctcaactgaaaaatatggaaacaaaggctgcaatggtggcttcatgacaacggctttccagtacatcattgataacaagggcatcgactcagacgcttcctatccctacaaagccatggatcagaaatgtcaatatgactcaaaatatcgtgctgccacatgttcaaagtacactgaacttccttatggcagagaagatgtcctgaaagaagctgtggccaataaaggcccagtgtctgttggtgtagatgcgcgtcatccttctttcttcctctacagaagtggtgtctactatgaaccatcctgtactcagaatgtgaatcatggtgtacttgtggttggctatggtgatcttaatgggaaagaatactggcttgtgaaaaacagctggggccacaactttggtgaagaaggatatattcggatggcaagaaataaaggaaatcattgtgggattgctagctttccctcttacccagaaatctagaggatctctcctttttataacaaatcaagaaatatgaagcactttctcttaacttaatttttcctgctgtatccagaagaaataattgtgtcatgattaatgtgtatttactgtactaattagaaaatatagtttgaggccgggcacggtggctcacgcctgtaatcccagtacttgggaggccaaggcaggcatatcaacttgaggccaggagttaaagagcagcctggctaacatggtgaaaccccatctctactaaaaatacaaaaaattagccgagcacggtggtgcatgcctgtaatcccagctacttgggaggctgaggcacgagattccttgaacccaagaggttgaggctatgttgagctgagatcacaccactgtactccagcctggatgacagagtggagactctgtttcaaaaaaacagaaaagaaaatatagtttgattcttcatttttttaaatttgcaaatctcaggataaagtttgctaagtaaattagtaatgtactatagatataactgtacaaaaattgttcaacctaaaacaatctgtaattgcttattgttttattgtatactctttgtctttttaagacccctaatagccttttgtaacttgatggcttaaaaatacttaataaatctgccatttcaaatttctatcattgccacataccattcttattcctaggcaactattaataatctatcctgagaatattaattgtggtattctggtgatggggtttagcaactttgatggaagaaaatattaggctataaatgtcctaaggactcagattgtatctttgtacagaagaggattcaaaacgccacgtgtagtggctcatgcctgtaatcccaacactttgggaggctgaagtaggaggatcgtcttgagcccaggagttcaagaccagcctggacaacatagtgagaccttgtctccacaaaaataaaaaagaaactatccaggagtggtggtgtgtgcctgtggtccctgctatgcagatgtctaagacaggaggatcacaagagcccaggaggttgagaatgcagtgagcttgtaattgcaccactgcactccagcctgggtgacagagcaagaccctgtcttaaaaaaagaggattcaacacatatttttatattatgttaaagtaaagaaatgcataaaagacaagcactttggaagaattattttaatgatcaacaatttaatgtattagtccaaattatttttacgtagtcatcaacaatttgaccagggcctttatttggcaaataactgagccaaccagaataaaataaccaatactccactgctcatatttttatctaattcagatggatcttccttacaactgctctagattagtagatgcatctaagcaggcagcaggaactttaaattttttaagttcatgtctatgacatgaacaatgtgtgggataatgtcattaatatatcctaaattaacctaaacgtatttcactaactctggctccttctccataaagcacattttaaggaacaagaattgctaaatataaaaacataaataataccataatacatggctatcatcaaaagtgtatagaatattatagtttaaaagtatttagttgattacttttcagttttgttttgttttttgagacggagtctcactctgttgcccaggctggagtgcagtggcaccatctcagttcactgcaacttctgcctcccgagttcaagcgattctcctgcctcagcctcccgagtagctggaattataggcgtgcaccaccacgcccagctaatttttgtatttttagtaaagacagggttttgccacattagccaggctggtctcaaactcctgacctcaggtgatccacccaccccagcctcccaaagtgctaagattacaggcgtgagccactgagcccagcctacttttcagtttttaacataatttttgttttatccacaacttttcaagtattgaaagtagaataaaaacatgggttcttagtctttagctatctgttaaagcctatgaatgccttcttaaaatcatgtttttaaatgcataaaatatataggattacaaaggaatctaattatatcgaaatacagttattaaaatgttaaaagataagtttgttatatattaatatgcatgcttctttataaatgcattaaataagagttaatagctatcctaaatttgaaatagtgataagcataatgaaaatagatgcaaaaaactaatgtgatatgaaaatatctgggtttttcttttgatgatgaagtattgctaatattaccgtggtttatgaactatgttcagaattgaagaaaatcctaactttcagttagaggttagtgacggggttcaggacaccctacacaaaatacagcactttgacatattgaatattttaagctgaaggcatttgaggaaattgcagaagcaggaaggtgactctgaccttctgcctgctgttctccccagaagcagccataaaacctgggaaggattttctgaccttcccctgaagtagatcataagactgtcatgtaagaggtgctctcctggcacccagagaaaaggagcatccttacctccaaaagcacagggacacaaagaggaatctaaacaaacaggcctctcagtttcccccagtttattacatttagcttgttcacactttgccctatgacatttctacatcactggctgctcttcatcaaacctactataaaaaacattcaagttcaactgtttctttgggcctttatttccttatggagcccctcgtgtcgtgtaaaacttatattaaataaatgtgcatgcttttctcttgctaatctctcttttgttatagagatctcagccctaaacctaggatggatagaaggaaacatatgttctcccctacattagtaaaaataaaaatggaattttttacccatacaaa

SEQ ID NO: 4888 - DNA, 1300 bp, Homo sapiens
gatctgcgcggcttcctgcctccatgccactccagactgcaccggcatggcactgactgcccacccctcctgcctcctggccctgttggtggcaggcctagcccaaggcatcagaggcccccttagggcccaggacctaggtccccagccgctagagctgaaagaggccttcaagttgttccagatccagttcaaccggagttacctgagcccagaagagcatgctcaccgcctggacatctttgcccacaacctggcccaggctcagaggctgcaggaggaggacttgggcacagctgagtttggggtgactccattcagtgacctcacagaggaggagtttggccagctctatggctatcggagggcagctggaggggtccccagcatgggcagagaaataaggtctgaagagccagaggagtcagtacctttcagctgtgactggcggaaggtggccagcgccatctcacccatcaaggaccagaaaaactgcaactgctgctgggccatggcagcggcaggcaacatagagaccctgtggcgcatcagtttctgggattttgtggatgtctccgtgcaggaactgctggactgtggccgctgtggggatggctgccacggtggcttcgtctgggacgcgttcataactgtcctcaacaacagcggcctggccagtgaaaaggactacccgttccagggcaaagtcagagcccacaggtgccaccccaagaagtaccagaaggtggcctggatccaggacttcatcatgctgcagaacaacgagcacagaattgcgcagtacctggccacttatggccccatcaccgtgaccatcaacatgaagccccttcagctataccggaaaggtgtgatcaaggccacacccaccacctgtgacccccagcttgtggaccactctgtcctgctggtgggttttggcagcgtcaagtcagaggaggggatatgggcagagacagtctcatcgcagtctcagcctcagcctccacaccccaccccatactggatcctgaagaactcctggggggcccaatggggagagaagggctatttccggctgcaccgagggagcaatacctgtggcatcaccaagttcccgctcactgcccgtgtgcagaaaccggatatgaagccccgagtctcctgccctccctgaacccacctggccccctcagctctgtcctgttaggccaactgcctccttgccagccccacccccaggtttttgcccatcctcccaatctcaatacagcctgaataaaccaagacaagacctctg

SEQ ID NO: 4889 - DNA, 1495 bp, Homo sapiens
ggggtcggccgggtgctgggccgaggccgaggccggggcgggatccagagcgggagccggcgcgggatctgggactcggagcgggatccggagcgggacccaggagccggcgcggggccatggcgaggcgcgggccagggtggcggccgcttctgctgctcgtgctgctggcgggcgcggcgcagggcggcctctacttccgccggggacagacctgctaccggcctctgcggggggacgggctggctccgctggggcgcagcacatacccccggcctcatgagtacctgtccccagcggatctgcccaagagctgggactggcgcaatgtggatggtgtcaactatgccagcatcacccggaaccagcacatcccccaatactgcggctcctgctgggcccacgccagcaccagcgctatggcggatcggatcaacatcaagaggaagggagcgtggccctccaccctcctgtccgtgcagaacgtcatcgactgcggtaacgctggctcctgtgaagggggtaatgacctgtccgtgtgggactacgcccaccagcacggcatccctgacgagacctgcaacaactaccaggccaaggaccaggagtgtgacaagtttaaccaatgtgggacatgcaatgaattcaaagagtgccacgccatccggaactacaccctctggagggtgggagactacggctccctctctgggagggagaagatgatggcagaaatctatgcaaatggtcccatcagctgtggaataatggcaacagaaagactggctaactacaccggaggcatctatgccgaataccaggacaccacatatataaaccatgtcgtttctgtggctgggtggggcatcagtgatgggactgagtactggattgtccggaattcatggggtgaaccatggggcgagagaggctggctgaggatcgtgaccagcacctataaggatgggaagggcgccagatacaaccttgccatcgaggagcactgtacatttggggaccccatcgtttaaggccatgtcactagaagcgcagtttaagaaaaggcatggtgacccatgaccagaggggatcctatggttatgtgtgccaggctggctggcaggaactggggtggctatcaatattggatggcgaggacagcgtggcactggctgcgagtgttcctgagagttgaaagtgggatgacttatgacacttgcacagcatggctctgcctcacaatgatgcagtcagccacctggtgaagaagtgacctgcgacacaggaaacgatgggacctcagtcttcttcagcagaggacttgatattttgtatttggcaactgtgggcaataatatggcatttaagaggtgaaagagttcagacttatcaccattcttatgtcactttagaatcaagggtgggggagggagggagggagttggcagtttcaaatcgcccaagtgatgaataaagtatctggctctgcacgaga

SEQ ID NO: 4890 - DNA, 2619 bp, Homo sapiens
acgagaatagtcaggcctttctggaagcccagtgccacagtctgcattgagcttggctcaggaaagaagggaaatccaggcggggcctgttgggcccaggtcttgagctcttttggctccagagttcccagcacagtcatggatcaaaactcagtgcctgaaaaggctcagaatgaggcagacaccaataacgcagataggttctttcgctctcactcatcacccccacaccacaggccaggccacagcagagctctccaccattacgagttgcaccatcacggcgtgccccaccaacgtggtgaatctcaccaccctccggagttccaagacttccacgaccaagccttgtcctcccatgtccaccaatctcaccaccacagcgaggcacggaatcacggcagagcccatggccccacaggctttggtctggctccctctcaaggcgccgtcccctcccaccgttcctacggtgaggactaccatgatgagctccaacgtgatggcaggaggcatcatgatgggtcccaatacggtgggttccatcagcagagtgactcccattaccatagggggtctcaccatggcagaccccaatatctcggtgagaatttatcccactattcctctggcgtgccccaccacggtgaggcttcccaccatggtgggtcctacctcccccatggacccaatccctacagtgagtccttccaccacagcgaggcttcccaccttagcgggctccaacacgatgagtcccagcatcaccaagtcccccaccgtggctggccccaccatcaccaagtccaccaccatggcaggtcccgtcatcatgaagcccaccagcatggaaagtctcctcatcacggagagaccatttcccctcattcctctgtggggtcctaccagcgtgggatatctgactatcacagcgagtaccaccaaggtgatcaccaccccagtgagtaccaccatggcgaccatccccaccacacacagcaccactaccaccagacccaccggcaccgagactaccatcagcaccaagaccaccacggcgcgtatcattccagttacctccatggcgactacgtccagagcacttcccaactctctatcccacacacatcccggagcctgattcacgatgcccccggccctgctgcttctcgtacaggagtcttcccctatcacgtagcacacccacggggctcggctcacagcatgactcggtcctccagcacaatccgctcacgtgtcacccagatgtccaaaaaagtccatacccaggatatctccaccaaacattcagaagactggggcaaagaagaagggcaatttcagaaacgcaaaaccggccggctccagcggacccgcaagaagggacactctaccaatctcttccagtggctgtgggaaaagctaaccttcctcattcagggcttccgggaaatgatccggaacctgacccaatccttggcctttgaaactttcatcttcttcgttgtctgcctcaacaccgtcatgctggtggcccagaccttcgctgaagtcgagatccggggcgagtggtacttcatggccttggactccatattcttctgcatctacgtggtggaagccctgctcaagatcatcgccctgggcctctcgtacttctttgacttctggaacaatttggacttcttcattatggccatggccgtgctggacttcttgctgatgcagacccactccttcgccatctaccaccaaagcctcttccggatcctcaaggtcttcaagagcctgcgggccctgagggcaatccgggtcctgcggaggctcagcttcctgaccagcgtccaggaagtgacagggaccctgggccagtccttgccgtccatcgcagccatcctcatcctcatgtttacctgcctcttcctcttctccgcggtcctccgggcactgttccgcaaatctgaccccaagcgcttccagaacatcttcaccaccatcttcaccctcttcaccttgctcacgctggatgactggtccctcatctacatggacagccgtgcccagggcgcctggtacatcattcccatcctcgtaatttacatcatcatccagtacttcatcttcctcaacctggtgattactgtcctggtggatagcttccagacggcgctgttcaaaggccttgagaaagcgaagcaggagagggccgcccggatccaagagaagctgctggaagactcactgacggagctcagagctgcagagcccaaagaggtggcgagtgaaggcaccatgctgaagcggctcatcgagaaaaagtttgggaccatgactgagaagcagcaggagctcctgttccattacctgcagctggtggcaagcgtggagcaggagcagcagaagttccgctcccaggcagccgtcatcgatgagattgtggacaccacatttgaggctggagaagaggacttcaggaattgaccccaggaggacaccagatacagacttcagcccctggcagtctgcccacctgggtgcactgggacgggtccccagatctgctggaatgattgtccgggccctgcagagcaggggccccaacagagtttttaaacccca

SEQ ID NO: 4891 - DNA, 1362 bp, Homo sapiens
cagaatccagacgctaaggaaaatccctaagcagagattttctgttggatgctaaaagcaaggaataaaagttgaaaatttggaaaatgtctcaacaccgtcaccagcgccactcgagagtcatttctagttcaccagttgacactacatcggtgggattttgcccaacattcaagaaatttaagaggaacgatgatgaatgtcgggcatttgtgaagagagtcataatgagccgtttctttaagataattatgattagcactgtcacatcgaatgcgttttttatggccttgtggaccagttatgacataaggtaccgcttgttcagacttcttgagttctcggagatcttctttgtgtccatctgcacatctgagttgtccatgaaggtctatgtggaccccatcaactactggaagaacggctacaacctgctggatgtgatcattatcatcgttatgtttttaccctatgccctccgccagctcatgggcaaacagttcacttacctgtatatcgctgatggcatgcagtccctgcgcatcctcaagcttatcggctatagccagggcatccggacgctgatcaccgccgtggggcagacagtctacaccgtggcctctgtgctcctcctgctcttcctcctcatgtacatcttcgctatcttgggcttctgcctgtttggatctccagacaatggtgaccatgataactgggggaacctggctgcagcttttttcaccctcttcagcttggccacggttgatggctggacagacctgcagaagcagttggacaatcgggaatttgctttgagccgggcattcaccatcatcttcatcttgctcgcctctttcatcttcctcaacatgttcgtgggtgtgatgatcatgcacacagaggactccatcagaaagtttgagcgagagctgatgttggagcagcaggagatgctcatgggagagaagcaggtgattctgcagcggcagcaggaggagatcagcaggctgatgcacatacagaaaaatgctgactgcacaagtttcagtgagctggtggagaactttaagaagaccttgagccacactgacccaatggtcttggatgattttggcactagcttacccttcatcgatatctacttttccactctggactaccaggacacaactgtccacaagcttcaagagctgtactatgagatcgtgcatgtgctgagcctaatgctggaagacttgccccaggagaagccccagtccttggaaaaggtggatgagaagtagctgggcatggggcacccatgtgccgagagccttgcagaccatgacaggtccctattaaacacaggctttctgagttgtc

SEQ ID NO: 4892 - DNA, 1912 bp, Homo sapiens
accacgagggggagtgagaccacttggagtgaagattctttgaggagaaggaagagactgagcaaacatgagggataatgaaaaggcctggtggcagcaatggacctcccatacaggcctcgaggggtggggcgggactcaggaggaccgtatggggtttggaggggcagtagctgcactgaggggccgcccctctcccctgcagagtaccattcacgagtcctacggtcggccagaggagcaagtgctcatcaaccgccaggaaatcacgaacaaagcggacgcctgggacatgcaggagttcatcactcacatgtacatcaagcagctgctccgacaccccgccttccaactgctgctggccctgctgctggtgatcaatgccatcaccatcgctctccgtaccaactcctacctggaccagaaacactatgagttgttctctaccatagatgacattgtgctgaccatccttctttgtgaggttctccttggctggctcaatggcttctggattttctggaaggacggctggaacatcctcaacttcattatcgtctttatcttgctcttgcggttcttcattaatgaaatcaatattccctccatcaactacactctcagggcgcttcgtctggtgcatgtgtgcatggcggtggagcccctcgcccggatcatccgcgtcatcctgcagtcggtgcctgacatggccaatatcatggtcctcatcctcttcttcatgctggttttttccgtgtttggagtaacactctttggtgcattcgtgcccaagcatttccagaacatacaggttgcgctgtacaccctcttcatctgcatcacccaggacggctgggtggacatctacagtgacttccagacagagaagagggaatatgcaatggagattgggggtgccatctactttaccatcttcatcaccatcggtgccttcattggcatcaacctgttcgtcatcgtggtgaccaccaacctggagcaaatgatgaaggcaggagagcagggacaacagcaacgaataacctttagtgagacaggcgcagaggaagaggaggagaatgaccagctgccactggtgcattgtgtggtcgcccgctcggagaaatctggtctcctccaggaaccccttgcgggaggccccctgtcgaacctctcagaaaacacgtgtgacaacttttgcttggtgcttgaggcaatacaggagaacctgaggcagtacaaggagatccgagatgaactcaacatgattgtggaggaggtgcgcgcaatccgcttcaaccaggagcaggagtcagaggtgttgaacaggcgctcgtcgacgagcgggtcgttggagactacgtcatccaaggacatccgccagatgtctcaacagcaagacttgctcagtgcgctcgttagcatggaaaaggttcatgactctagctcacaaatactccttaaaaaacacaagagcagccactgagaggccaggatgggagccaaggggcctgcacacacacacccagccgctgcgtcttcctgtgtccttagtgtggcttggcagagcctggccagagcccatcctctcccttatacctgggcagaggccaggggctgtgaaggtggcagcacctgcaggtctggtgcctgtgagccccaggtccggtggagcaaggagagaggaggatgctggatgatgagagtgggaaccctagcagcaaggatgagcacagaagggggtgctggccaacgcagccaggatttgacctaaggatggggatccctggccccctgctcttgcccagagctggtggggggcctcagtgggccccagaaccaagaagagaaaggcaaggccagtggggccagacatctgtgtgttgacaataaagttttgtgttggaatcaa

SEQ ID NO: 4893 - DNA, 3623 bp, Homo sapiens
gctgattggctgttaccaaaggtgactagagtgctaagccagtcaacagggaaaacttggctcctgactttgggtctttcttctcagtctatatggaagaaaactgagaaaaaatataaaaaagaagaacacaactagttgcgcatctcctaaagagatggaatcgccacttatatatgtttcagttttgcttttgaacatatttgaattttcatcaggaatagtatataataaagatgatacagagaaacgctttgcatgttctaacaaagggttccctcaagagaatgaaataatcaagttgtatcttttcttagaaaacttgaaaatccagtgtttcttccaaactgaaaatgaaattgcatcaaaagcaatgctaagtgtgttcacatcaggaggacttgctcccagcttgggaatcatgaatagtacatataatggcatcttccactttaatttaacgttgttcagtgatcggattttgtggttggttgatattcctagagaaaacatcacacaaagcacagatattgcagctgtagaagaatggttagtaagaatcactttacatcatggactaaatatttatgctactgaaggaactctattggatgttattcgagaaccgattcttcagtggactcctggggatgtgattccagaaagtgaaatcagtaaattatatccacatgtggtagatctcaaagtgacaaaatgcccctgtgccaatgatgtggcattactaggcttcattgtggatacaatagttgatggtgtttacataggcataacctttggtggattctggcatgattatgataccacatggtttaacatgacacagactatctattcccaacttcaagaagaatatgaagacctttcattggtggatatggttttaacgaatcattttttagttatcctcacctctttgggcctttttgtaagtgaagatcttcgttatccatcacgccacagcttatcgttttccagggcagacttttgtggttttgaaagggttgactatgtgaaaggaaaactgtggtataatgaaagatgttttgctaacagagagcactttgaagttgattatgttacagttacctttgagagaaacagaaccctaagtgagtcaagctcttgtttttatagtcaggaaccatttcttgaatgggtaccctgcttacctcacatttttaaaggaataaaaatttttccaactgtgctaacatttcttgttgaccaagagcgtggtactggagtttacctcttctataacaaggtcaggaaaactgccattgcctctgtgagcaccctgagaaataatgaaccaaattcacaatcaaaatttccaatttttcggtttccttcatcattctcttctcccgttggaatggtatttcatccccgaagccactttttgtatgcttatggcaatcagatatggctttcagttgatggcggcaacacctttcaattaatagctaactttcatgatgatatcataaagaagacttttcatagtttttatacatcagctattacttttgtttctcaacgtggaaaggtttactcgacaaaggcaggaatgggaagatacagtgcagtcggaagtgttactgagagaattttcacattatactatgatcacttgggattcctacataagctgactctgggtcgctttgaagctagtggaccacccacagcctttggaaattctagaaatctttttggacagcctccagatatgggctttgagactgcgcttgccccacagcacacctccttagatgaaattatcttttttgcatatgtacctgagaacgaaccccaggaaacgatctacagcaagaagttcggcaatatacactatggaaaagtgatacactctgggaaaactggaagagcttacataagaaaggtattgcaacatacgactcctaaaggatttttgtcctcagttattgcagaaatgaaagagccctttggattagaagaagtgaatgagagctcttgtttgtctagttcccttttgattaataaagctggaaatgtctataaactcactcttgattcacaagttgttcaggccttgtttgaagatacagatatagagaagactgtagtgcttcccgggtacagcagcttcctcatcacaagcattttagataataagaatgcattagccattgctaccatgcctgaaagtgcacccaacaatatgacctttctaaagagcacatggttcttatacaactttgggcaaaggaatggacgaacatggaaaatatattcaaaaccatgtaattattggtttcaacatgatgattcaccatccctcaacatcgtgaaatacattgatctgggaaactcttatgttttaaaagctaaggtcatacggaatgcaaaaggttttcgaatgcttgaaataccactactgactgtgtttgttggaaaccctaatttgttggaagttacagctgaagtgacttttgatgatactgacagttatgtaataacaatttctgcagctagcaaagttttacatcagggttcaacttcactggcatttattatgtggtcagcctctactgagtgctttgttacgacaatggtgccaacactgaaaagcagctgtagttatctcagatctatgcatcacattcctagcaaatttatcccatttgaagactggattagtggagttcataaagacagtcagggttttaacctcatcaaaactttgccgataaactacaggcctccatctaatatgggaattgctattccactcacagataatttttatcatgcagatcctagcaaacccataccaagaaacatgtttcacatgtcaaagaaaaccggtaaattcaaacagtgtgctaatgtttccactcgggaggagtgtaactgcacaaaggatcagaagttttcacatgctgttgctttctcggattgcagggaaaaagttcctcgctttaagtttccaattacacaatatccagtttctttggaaattatcaacgaggatggacgtgtcccattgcaatctccatatctggttactgtgactgaagtgaacatgaggcacaactggaaactgaaacacactgtgccagaaaatattaaaagaatgaaacaattagtagaaccaattcttggtgctgcagtgtataatccttcaggtctcaacttaagcataaagggctctgaacttttccactttagagtgaccgtcatttcaggagtaactttttgtaacttaattgaagaatttcagatttatgttgatgaggcaccattgccattcccaggacacacgcttattgccgtggcaacagcggtagtgctagggggattaatttttatagcatttatgtttcaactgcaaggcatccatccgtggaggacattccaaagatggattagaagaaaccaagagaagttttcaagtatctctctcagtgagctgattcatagatcaaagtctgaagagtgaacacatggtgatcataatttctctttattttctagttttatcagccaattcctagaacaatatatttaaatgttaaatatgcaagctacataaaatcctaaagaattgtcattat

SEQ ID NO: 4894 - DNA, 430 bp, Homo sapiens
acgcaaggagaaggaaatcataatgatgtcatgtgatcaaaggaaaccatggaagggttcacgctgatagctgatagcttttacagtgctcattcctaacagtggatttactttagagacaggattttgccatgtttgccaggttggccttgaactcctgacctcaggtgatccacctgcctcgacctcccaaagtgcttggattacagatggaatcgccacttatatatgtttcagttttgcttttgaacatatttgaattttcatcaggaatagtatataataaagatgatacagagaaacgctttgcatgttctaacaaagggttccctcaagagaatgaaataatcaagttgtatcttttcttagaaaacttgaaaatccagtgtttcttccaaactgaaaatgaaattgcatcaaaagcaatgct

SEQ ID NO: 4895 - DNA, 432 bp, Homo sapiens
tcttgacctttacccacttacgcaaggagaaggaaatcataatgatgtcatgtgatcaaaggaaaccatggaagggttcacgctgatagctgatagcttttacagtgctcattcctaacagtggatttacttatggaatcgccacttatatatgtttcagttttgcttttgaacatatttgaattttcatcaggaatagtatataataaagatgatacagagaaacgctttgcatgttctaacaaagggttccctcaagagaatgaaataatcaagttgtatcttttcttagaaaacttgaaaatccagtgtttcttccaaactgaaaatgaaattgcatcaaaagcaatgctaagtgtgttcacatcaggaggacttgctcccagcttgggaatcatgaatagtacatataatggcatcttccactttaat

SEQ ID NO: 4896 - DNA, 491 bp, Homo sapiens
acgcaaggagaaggaaatcataatgatgtcatgtgatcaaaggaaaccatggaagggttcacgctgatagctgatagcttttacagtgctcattcctaacagtggatttacttgcagaactccgttagagaagatttaatccggattccaccgctgctccactgctgctgtcctctgttcttttccacacaacctctacctgacttcactttggtgtggactctggagttgatccctctggtttcatatgcttcttttcctacttatatatggaatcgccacttatatatgtttcagttttgcttttgaacatatttgaattttcatcaggaatagtatataataaagatgatacagagaaacgctttgcatgttctaacaaagggttccctcaagagaatgaaataatcaagttgtatcttttcttagaaaacttgaaaatccagtgtttcttccaaactgaaaatgaaattgcatcaaaagcaatgcta

SEQ ID NO: 4897 - DNA, 3504 bp, Homo sapiens
atgggaaggaagagtaagaagtggggcaagaaggtgtcgcggtacgaggggaaggtgagactcaagaaggtgccggctaagaagctggtgccggcgtggaaggagaaggtgctgtgggccctgctggcagtgctcctggcgtcgtggaggctgtgggcgatcaaggatttccaggaatgcacctggcaggttgtcctgaacgagtttaagagggtaggcgagagtggtgtgagcgacagcttctttgagcaagagcccgtggacacagtgagcagcttgtttcacatgctggtggactcacccatcgacccgagcgagaaatacctgggcttcccttactacctgaagatcaactactcctgcgaggaaaagccctctgaggacctggtgcgcatgggccacctgacggggctaaagcccctggtgctggtcaccttccagtccccagtcaacttctaccgctggaagatagagcagctgcagatccagatggaggctgcccccttccgcagcaaaggtgggcctgggggaggcgggagggatcgcaacctggcagggatgaatatcaacggcttcctgaagagagaccgggacaataacatccaattcactgtgggagaggagctcttcaacctgatgccccagtactttgtgggtgtctcatcgaggcccttgtggcacactgtggaccagtcacctgtgcttatcctgggaggcattcccaatgagaagtacgtcctgatgactgacaccagcttcaaggacttctctctcgtggaggtgaacggtgtggggcagatgctgagcattgacagttgctgggtgggctccttctactgcccccattctggcttcacagccaccatctatgacactattgccaccgagagcaccctcttcattcggcagaaccagctggtctactattttacaggcacctataccacactctatgagagaaaccgcggcagtggtgagtgtgctgtggctggacccacgcctggggagggcaccctggtgaacccctccactgaaggcagttggattcgtgtcctggccagcgagtgcatcaagaagctgtgccctgtgtatttccatagcaatggctctgagtacataatggccctcaccacgggcaagcatgagggttatgtacacttcgggaccatcagagttaccacctgctccataatttggtctgaatacatcgcgggtgagtatactctactgctgctggtggagagtggatatggtaatgcaagtaaacgtttccaggtggtcagctacaacacagctagtgatgacctggaacttctctaccacatcccagaattcatccctgaagctcgaggattggagttcctgatgatcctagggacagagtcctacaccagcactgcaatggcccccaagggcatcttctgtaacccgtacaacaatctgatcttcatctggggcaacttcctcctgcagagatctggtacctcctggagggcagctaccgggtctaccagctgttcccttccaagggctggcaggtgcacatcagcttaaagctgatgcaacagtcctctctctacgcatccaatgagaccatgctgaccctcttctacgaagacagcaaactgtaccagctggtgtaccttatgaacaaccagaagggccagctggtcaagaggctcgtgcccgtggagcagcttctgatgtatcaacagcacaccagccactatgacttggagcggaaagggggctacttgatgctctccttcatcgacttctgccccttctcggtgatgcgcctgcggagcctgcccagtccgcagagatacacgcgccaggagcgctaccgggcgcggccgccgcgcgtcctggagcgctcgggcttccacaacgagaactcgctcgccatctaccagggcctggtctactacctgctgtggctgcactccgtgtacgacaagccgtacgcggacccggtgcacgaccccacctggcgctggtgggcgaacaacaaacaagaccaggattactacttcttcttggcgagcaattggcgaagcgcgggcggcgtgtccatagaaatggacagctacgaaaagatctacaacctcgagtccgcgtacgagctgccggagcgcattttcctggacaagggcactgagtacagcttcgccatcttcctgtcggcgcagggccactcgttccggacgcagtcagaactcggcaccgccttccagctgcatagccaggtggacgtgggcgtggtgctggccgaccccggctgcatcgaggcctcggtgaagcaggaggtcctgattaatcgcaactcggtgctattttcgattacgctcaaggataaaaagctttgctatgaccaaggcattagtggacatcaccttatggagacttccatgacggtcaatgtggtgggttcatccgggctctgcttccaggaaacacacctggggccccatatgcaaggcaacctgatggtgccagtgttcattggctgccccccaggcaagcgcctggccttcgacatcacctacacgctggaatacagccgcctgaagaacaaacactactttgactgcgttaacgtgaacccggagatgccctgctttctcttccgggacattttctaccccttcttcttgattcaagatttggtgacaggagactccggcagtttccagggcagctatgttctgctggtggtgggtggcgggcccacactggacagcctcaaggactacagtgaggacgaaatctaccgcttcaacagccccctggacaagaccaacagccttatctggaccacgaggaccacaaggaccaccaaagactcagcctttcacatcatgtcccacgagagcccaggcatcgagtggctctgtctggagaatgccccatgctatgacaatgttccccaaggcatctttgcccctgaattcttcttcaaggtgttggtgagcaatagaggagtggacacgagcacctactgcaactaccagctcaccttcctgctgcacatccacgggctgccactcagtcccaagcgggcccttttcatcatcatggtgtcagctagcgtgtttgtgggcctggtgatcttctacatcgccttctgcctcctgtggcccctcgtggtgaagggctgcacgatgatccggtggaagataaacaacctcattgcctcagaatcctactacacctacgcctccatttccggaatctcgagcatgccgtctctgagacattccaggatgggctccatgttcagctccaggatgacagaggacagggctgaacccaaggaagccgtggagagacagttgatgacctgagtgtcccacctgccccagcccccagttactgtcacgcctctcttatgaggcccatcttgaagatgcaacctgtcacccagcccaggcctctctttctgttttgcttgatgtttacttctcgttcagactcaaataaagccttttttcaggaccagca

SEQ ID NO: 4898 - DNA, 3746 bp, Homo sapiens
gaagtcggctgtggaagtgtgggcggccattttgagaccgggcaagaggggcgggactggtgcggccgagtgacagttgaccggttttaaccaagtgactggttctagccacgttatgtgcggcccagccatgttccctgccggtcctccgtggcccagagtccgagtcgtgcaggtgctgtgggccctgctggcagtgctcctggcgtcgtggaggctgtgggcgatcaaggatttccaggaatgcacctggcaggttgtcctgaacgagtttaagagggtaggcgagagtggtgtgagcgacagcttctttgagcaagagcccgtggacacagtgagcagcttgtttcacatgctggtggactcacccatcgacccgagcgagaaatacctgggcttcccttactacctgaagatcaactactcctgcgaggaaaagccctctgaggacctggtgcgcatgggccacctgacggggctaaagcccctggtgctggtcaccttccagtccccagtcaacttctaccgctggaagatagagcagctgcagatccagatggaggctgcccccttccgcagcaaagagccatgcatggcagaagaagtgtgtagcatgagctggtacacgcccatgcccatcaagaaaggcagtgtggtcatgcgtgtggacatcagcagcaatggcctggggaccttcattccagataaaaggttccagatgaatatcaacggcttcctgaagagagaccgggacaataacatccaattcactgtgggagaggagctcttcaacctgatgccccagtactttgtgggtgtctcatcgaggcccttgtggcacactgtggaccagtcacctgtgcttatcctgggaggcattcccaatgagaagtacgtcctgatgactgacaccagcttcaaggacttctctctcgtggagctgagcattgacagttgctgggtgggctccttctactgcccccattctggcttcacagccaccatctatgacactattgccaccgagagcaccctcttcattcggcagaaccagctggtctactattttacaggcacctataccacactctatgagagaaaccgcggcagtggcagttggattcgtgtcctggccagcgagtgcatcaagaagctgtgccctgtgtatttccatagcaatggctctgagtacataatggccctcaccacgggcaagcatgagggttatgtacacttcgggaccatcagagatggccaggtgtcctttgagatgctgcccaggcagtggtctgtgtgcgagcagataggagttaccacctgctccataatttggtctgaatacatcgcgggtgagtatactctactgctgctggtggagagtggatatggtaatgcaagtaaacgtttccaggtggtcagctacaacacagctagtgatgacctggaacttctctaccacatcccagaattcatccctgaagctcgaggattggagttcctgatgatcctagggacagagtcctacaccagcactgcaatggcccccaagggcatcttctgtaacccgtacaacaatctgatcttcatctggggcaacttcctcctgcagagctctaacaaggaaaacttcatctacctggcagacttccccaaggaactgtccatcaaatacatggccagatcgttccgtggggctgtggctattgtcacagagacggaggagatctggtacctcctggagggcagctaccgggtctaccagctgttcccttccaagggctggcaggtgcacatcagcttaaagctgatgcaacagtcctctctctacgcatccaatgagaccatgctgaccctcttctacgaagacagcaaactgtaccagctggtgtaccttatgaacaaccagaagggccagctggtcaagaggctcgtgcccgtggagcagcttctgatgtatcaacagcacaccagccactatgacttggagcggaaagggggctacttgatgctctccttcatcgacttctgccccttctcggtgatgcgcctgcggagcctgcccagtccgcagagatacacgcgccaggagcgctaccgggcgcggccgccgcgcgtcctggagcgctcgggcttccacaacgagaactcgctcgccatctaccagggcctggtctactacctgctgtggctgcactccgtgtacgacaagccgtacgcggacccggtgcacgaccccacctggcgctggtgggcgaacaacaaacaagaccaggattactacttcttcttggcgagcaattggcgaagcgcgggcggcgtgtccatagaaatggacagctacgaaaagatctacaacctcgagtccgcgtacgagctgccggagcgcattttcctggacaagggcactgagtacagcttcgccatcttcctgtcggcgcagggccactcgttccggacgcagtcagaactcggcaccgccttccagctgcatagccaggtggacgtgggcgtggtgctggccgaccccggctgcatcgaggcctcggtgaagcaggaggtcctgattaatcgcaactcggtgctattttcgattacgctcaaggataaaaagctttgctatgaccaaggcattagtggacatcaccttatggagacttccatgacggtcaatgtggtgggttcatccgggctctgcttccaggaaacacacctggggccccatatgcaaggcaacctgatggtgccagtgttcattggctgccccccaggcaagcgcctggccttcgacatcacctacacgctggaatacagccgcctgaagaacaaacactactttgactgcgttaacgtgaacccggagatgccctgctttctcttccgggacattttctaccccttcttcttgattcaagatttggtgacaggagactccggcagtttccagggcagctatgttctgctggtggtgggtggcgggcccacactggacagcctcaaggactacagtgaggacgaaatctaccgcttcaacagccccctggacaagaccaacagccttatctggaccacgaggaccacaaggaccaccaaagactcagcctttcacatcatgtcccacgagagcccaggcatcgagtggctctgtctggagaatgccccatgctatgacaatgttccccaaggcatctttgcccctgaattcttcttcaaggtgttggtgagcaatagaggagtggacacgagcacctactgcaactaccagctcaccttcctgctgcacatccacgggctgccactcagtcccaagcgggcccttttcatcatcatggtgtcagctagcgtgtttgtgggcctggtgatcttctacatcgccttctgcctcctgtggcccctcgtggtgaagggctgcacgatgatccggtggaagataaacaacctcattgcctcagaatcctactacacctacgcctccatttccggaatctcgagcatgccgtctctgagacattccaggatgggctccatgttcagctccaggatgacagaggacagggctgaacccaaggaagccgtggagagacagttgatgacctgagtgtcccacctgccccagcccccagttactgtcacgcctctcttatgaggcccatcttgaagatgcaacctgtcacccagcccaggcctctctttctgttttgcttgatgtttacttctcgttcagactcaaataaagccttttttcagga

SEQ ID NO: 4899 - DNA, 4333 bp, Homo sapiens
ggaaggggaggggaaggggaaggcgagaaggggagaggcaggggaaagaggggaagagtcgtgggagctgggagaggagggaaagaggggaagagtcgtgggagctggcagaggagggaaagggggagccgaacgtgaagggcgaagggcggggcggggcaggagagtcggggtatagagcaggcaggtgttaatggcatgggaaggaagagtaagaagtggggcaagaaggtgtcgcggtacgaggggaaggtgagactcaagaaggtgccggctaagaagctggtgccggcgtggaaggagaaggtgtggggcgaggaaacaacgaagggcgaggaaagatcccgaggcgaagagacagttttcatcgagaaggggcagggcgaggaggaggggcgttaccagagggcgggacggggcgacgggcccgcgcgggaagaaccaatcgccgagaacccggggaaggaacgggtccataaagaccaagtggaggagtaggggcgcggtcaggagcggaagcagagtgaggagcaagccccgggcgagaaacgggggcccggccgggagcaagagcaggggcggggccgggagcaagagcaggggcggggcccggagacgggcgagaccaggtacagtacccagcccctgggcagaccccgagcgaggagaaagcggcgataccaagagaagttctagccacgttatgtgcggcccagccatgttccctgccggtcctccgtggcccagagtccgagtcgtgcaggtgctgtgggccctgctggcagtgctcctggcgtcgtggaggctgtgggcgatcaaggatttccaggaatgcacctggcaggttgtcctgaacgagtttaagagggtaggcgagagtggtgtgagcgacagcttctttgagcaagagcccgtggacacagtgagcagcttgtttcacatgctggtggactcacccatcgacccgagcgagaaatacctgggcttcccttactacctgaagatcaactactcctgcgaggaaaagccctctgaggacctggtgcgcatgggccacctgacggggctaaagcccctggtgctggtcaccttccagtccccagtcaacttctaccgctggaagatagagcagctgcagatccagatggaggctgcccccttccgcagcaaagagccatgcatggcagaagaagtgtgtagcatgagctggtacacgcccatgcccatcaagaaaggcagtgtggtcatgcgtgtggacatcagcagcaatggcctggggaccttcattccagataaaaggttccagatgaatatcaacggcttcctgaagagagaccgggacaataacatccaattcactgtgggagaggagctcttcaacctgatgccccagtactttgtgggtgtctcatcgaggcccttgtggcacactgtggaccagtcacctgtgcttatcctgggaggcattcccaatgagaagtacgtcctgatgactgacaccagcttcaaggacttctctctcgtggagctgagcattgacagttgctgggtgggctccttctactgcccccattctggcttcacagccaccatctatgacactattgccaccgagagcaccctcttcattcggcagaaccagctggtctactattttacaggcacctataccacactctatgagagaaaccgcggcagtggcagttggattcgtgtcctggccagcgagtgcatcaagaagctgtgccctgtgtatttccatagcaatggctctgagtacataatggccctcaccacgggcaagcatgagggttatgtacacttcgggaccatcagagatggccaggtgtcctttgagatgctgcccaggcagtggtctgtgtgcgagcagataggagttaccacctgctccataatttggtctgaatacatcgcgggtgagtatactctactgctgctggtggagagtggatatggtaatgcaagtaaacgtttccaggtggtcagctacaacacagctagtgatgacctggaacttctctaccacatcccagaattcatccctgaagctcgaggattggagttcctgatgatcctagggacagagtcctacaccagcactgcaatggcccccaagggcatcttctgtaacccgtacaacaatctgatcttcatctggggcaacttcctcctgcagagctctaacaaggaaaacttcatctacctggcagacttccccaaggaactgtccatcaaatacatggccagatcgttccgtggggctgtggctattgtcacagagacggaggagatctggtacctcctggagggcagctaccgggtctaccagctgttcccttccaagggctggcaggtgcacatcagcttaaagctgatgcaacagtcctctctctacgcatccaatgagaccatgctgaccctcttctacgaagacagcaaactgtaccagctggtgtaccttatgaacaaccagaagggccagctggtcaagaggctcgtgcccgtggagcagcttctgatgtatcaacagcacaccagccactatgacttggagcggaaagggggctacttgatgctctccttcatcgacttctgccccttctcggtgatgcgcctgcggagcctgcccagtccgcagagatacacgcgccaggagcgctaccgggcgcggccgccgcgcgtcctggagcgctcgggcttccacaacgagaactcgctcgccatctaccagggcctggtctactacctgctgtggctgcactccgtgtacgacaagccgtacgcggacccggtgcacgaccccacctggcgctggtgggcgaacaacaaacaagaccaggattactacttcttcttggcgagcaattggcgaagcgcgggcggcgtgtccatagaaatggacagctacgaaaagatctacaacctcgagtccgcgtacgagctgccggagcgcattttcctggacaagggcactgagtacagcttcgccatcttcctgtcggcgcagggccactcgttccggacgcagtcagaactcggcaccgccttccagctgcatagccaggtggacgtgggcgtggtgctggccgaccccggctgcatcgaggcctcggtgaagcaggaggtcctgattaatcgcaactcggtgctattttcgattacgctcaaggataaaaagctttgctatgaccaaggcattagtggacatcaccttatggagacttccatgacggtcaatgtggtgggttcatccgggctctgcttccaggaaacacacctggggccccatatgcaaggcaacctgatggtgccagtgttcattggctgccccccaggcaagcgcctggccttcgacatcacctacacgctggaatacagccgcctgaagaacaaacactactttgactgcgttaacgtgaacccggagatgccctgctttctcttccgggacattttctaccccttcttcttgattcaagatttggtgacaggagactccggcagtttccagggcagctatgttctgctggtggtgggtggcgggcccacactggacagcctcaaggactacagtgaggacgaaatctaccgcttcaacagccccctggacaagaccaacagccttatctggaccacgaggaccacaaggaccaccaaagactcagcctttcacatcatgtcccacgagagcccaggcatcgagtggctctgtctggagaatgccccatgctatgacaatgttccccaaggcatctttgcccctgaattcttcttcaaggtgttggtgagcaatagaggagtggacacgagcacctactgcaactaccagctcaccttcctgctgcacatccacgggctgccactcagtcccaagcgggcccttttcatcatcatggtgtcagctagcgtgtttgtgggcctggtgatcttctacatcgccttctgcctcctgtggcccctcgtggtgaagggctgcacgatgatccggtggaagataaacaacctcattgcctcagaatcctactacacctacgcctccatttccggaatctcgagcatgccgtctctgagacattccaggatgggctccatgttcagctccaggatgacagaggacagggctgaacccaaggaagccgtggagagacagttgatgacctgagtgtcccacctgccccagcccccagttactgtcacgcctctcttatgaggcccatcttgaagatgcaacctgtcacccagcccaggcctctctttctgttttgcttgatgtttacttctcgttcagactcaaataaagccttttttcagg

SEQ ID NO: 4900 - DNA, 2743 bp, Homo sapiens
aggtgagcggttgctcgtcgtcggggcggccggcagcggcggctccagggcccagcatgcgcgggggaccccgcggccaccatgtatgtgggctatgtgctggacaaggattcgcccgtgtaccccggcccagccaggccagccagcctcggcctgggcccgcaagcctacggccccccggccccgcccccggcgcccccgcagtaccccgacttctccagctactctcacgtggagccggcccccgcgcccccgacggcctggggggcgcccttccctgcgcccaaggacgactgggccgccgcctacggcccgggccccgcggcccctgccgccagcccagcttcgctggcattcgggccccctccagactttagcccggtgccggcgccccctgggcccggcccgggcctcctggcgcagcccctcgggggcccgggcacaccgtcctcgcccggagcgcagaggccgacgccctacgagtggatgcggcgcagcgtggcggccggaggcggcggtggcagcggtaagactcggaccaaggacaagtaccgcgtggtctacaccgaccaccaacgcctggagctggagaaggagtttcattacagccgttacatcacaatccggcggaaatcagagctggctgccaatctggggctcactgaacggcaggtgaagatctggttccaaaaccggcgggcaaaggagcgcaaagtgaacaagaagaaacagcagcagcaacagcccccacagccgccgatggcccacgacatcacggccaccccagccgggccatccctggggggcctgtgtcccagcaacaccagcctcctggccacctcctctccaatgcctgtgaaagaggagtttctgccatagccccatgcccagcctgtgcgccgggggacctggggactcgggtgctgggagtgtggctcctgtgggcccaggaggtctggtccgagtctcagccctgaccttctgggacatggtggacagtcacctatccaccctctgcatccccttggcccatctgtgcagtaagcctgttggataaagaccttccagctcctgtgttctagacctctgggggataagggagtccagggtggatgatctcaatctcccgtgggcatctcaagccccaaatggttgggggaggggcctagacaaggctccaggccccacctcctcctccatacgttcagaggtgcagctggaggctgctgtggggaccacactgatcctggagaaaagggatggagctgaaaaagatggaatgcttgcagagcatgacctgaggagggaggaacgtggtcaactcacacctgcctcttcctgcagcctcacttctacctgcccccatcataagggcactgagcccttcccaggctggatactaagcacaaagcccatagcactgggctctgatggctgctccactgggttacagaatcacagccctcatgatcattctcagtgagggctctggattgagagggaggccctgggaggagagaagggggcagagtcttccctaccaggtttctacacccccgccaggctgcccatcagggcccagggagcccccagaggactttattcggaccaagcagagctcacagctggacaggtgttgtatatagagtggaatctcttggatgcagcttcaagaataaatttttcttctcttttcaaaaatgtataaaaatcattatacatagcattaaagaaacatttttgagaagtacaaatcatcctcaccttccccagcaattgtgtattcctttcccgtttgtttaggcccacaacaaggtcacctttaaaatacatttgaaagatcaaaacagaacaccattcgtttaggtctatgagactacgtaaaaatgtgagtccattttgtaagcagattcatcagactcaacatatcagtcttttgaatttttcagatatgttcagttcaggtttttctttcaataatgacattcattgctcaccccatgtgctacgcgtggctgggcctgggaagcacacagtccttgtcccctagactggagaaggggtgcgagatcatgtcttgggaagatgtggagggggaaggttacagagaagggcatctccagggtaggagagcaagatctagagggggagaatgcattcagagtccatgtggtctgggcagctggagcaggagagaagccacaaagcccccctcagggtctgacttcaggggtcctgaattgctctgcagaagtccccagtccagtggggaagactgctatgcacacagatgacactaatataacaggataagggccaatctgagcgtcaggggagccagggcatccaacgagagcagagcacatgcctagcttatcctggaaggcttcctggagtaggtaatgtttgaactgagactgaaaaggactagcgagtatggatcaggccaagaagggaataaaggagaaaaggaacttgagcaatatggactgaaagtataattttttttgaactcgggagtctactacccggggccttctctccccgggggctctggtgccagctgcctgcccctctgtttactgttctgggaggtggccaggccataaaaagtgtgcacagcctgcctgacatcgccctttgctcccatgataacagtgcacaaggtggatcctggcctggcacaggcccctgaagtgcagcaggcacttctctctctcctcctaccagtggcctgggagac

SEQ ID NO: 4901 - DNA, 1302 bp, Homo sapiens
gtgagcggttgctcgtcgtcggggcggccggcagcggcggctccagggcccagcatgcgcgggggaccccgcggccaccatgtatgtgggctatgtgctggacaaggattcgcccgggcacaccgtcctcgcccggagcgcagaggccgacgccctacgagtggatgcggcgcagcgtggcggccggaggcggcggtggcagcggtaagactcggaccaaggacaagtaccgcgtggtctacaccgaccaccaacgcctggagctggagaaggagtttcattacagccgttacatcacaatccggcggaaatcagagctggctgccaatctggggctcactgaacggcaggtgaagatctggttccaaaaccggcgggcaaaggagcgcaaagtgaacaagaagaaacagcagcagcaacagcccccacagccgccgatggcccacgacatcacggccaccccagccgggccatccctggggggcctgtgtcccagcaacaccagcctcctggccacctcctctccaatgcctgtgaaagaggagtttctgccatagccccatgcccagcctgtgcgccgggggacctggggactcgggtgctgggagtgtggctcctgtgggcccaggaggtctggtccgagtctcagccctgaccttctgggacatggtggacagtcacctatccaccctctgcatccccttggcccatctgtgcagtaagcctgttggataaagaccttccagctcctgtgttctagacctctgggggataagggagtccagggtggatgatctcaatctcccgtgggcatctcaagccccaaatggttgggggaggggcctagacaaggctccaggccccacctcctcctccatacgttcagaggtgcagctggaggctgctgtggggaccacactgatcctggagaaaagggatggagctgaaaaagatggaatgcttgcagagcatgacctgaggagggaggaacgtggtcaactcacacctgcctcttcctgcagcctcacttctacctgcccccatcataagggcactgagcccttcccaggctggatactaagcacaaagcccatagcactgggctctgatggctgctccactgggttacagaatcacagccctcatgatcattctcagtgagggctctggattgagagggaggccctgggaggagagaagggggcagagtcttccctaccaggtttctacacccccgccaggctgcccatcagggcccagggagcccccagaggactttattcggaccaagcagagctcaca

SEQ ID NO: 4902 - DNA, 982 bp, Homo sapiens
gtgagcggttgctcgtcgtcggggcggccggcagcggcggctccagggcccagcatgcgcgggggaccccgcggccaccatgtatgtgggctatgtgctggacaaggattcgcccgtgtaccccggcccagccaggccagccagcctcggcctgggcccgcaagcctgtgtcccagcaacaccagcctcctggccacctcctctccaatgcctgtgaaagaggagtttctgccatagccccatgcccagcctgtgcgccgggggacctggggactcgggtgctgggagtgtggctcctgtgggcccaggaggtctggtccgagtctcagccctgaccttctgggacatggtggacagtcacctatccaccctctgcatccccttggcccatctgtgcagtaagcctgttggataaagaccttccagctcctgtgttctagacctctgggggataagggagtccagggtggatgatctcaatctcccgtgggcatctcaagccccaaatggttgggggaggggcctagacaaggctccaggccccacctcctcctccatacgttcagaggtgcagctggaggctgctgtggggaccacactgatcctggagaaaagggatggagctgaaaaagatggaatgcttgcagagcatgacctgaggagggaggaacgtggtcaactcacacctgcctcttcctgcagcctcacttctacctgcccccatcataagggcactgagcccttcccaggctggatactaagcacaaagcccatagcactgggctctgatggctgctccactgggttacagaatcacagccctcatgatcattctcagtgagggctctggattgagagggaggccctgggaggagagaagggggcagagtcttccctaccaggtttctacacccccgccaggctgcccatcagggcccagggagcccccagaggactttattcggaccaagcagagctcaca

SEQ ID NO: 4903 - DNA, 4501 bp, Homo sapiens
gcaatttgcttccggttgtatttctcaggaagtccgatgacactcggctgtccaggccaggcgctggaagtcccccaggaggaccagctcggtctcccacctcttgagtgcacagctccttggcccctgagtaccccaccacccccatttccagccttcttccttacaaacacgaagggtgggaggaaccagaaaacaggggatcccgcagccctaggctagttctgatcgctttcaggtgtctgcagaggcaagttgctggttgtcacctgtaaaatggggaggataaaaacacctcccagattttgttctagatcctagggggatgtgaggctcaagggagataaaggacactggagagcaccctagaaatgacaggatgaaggcgatggtgacaaatatccgagcgaaacgcttgacaatgagaacagacaagtgcaggtctccaggagtgccgcgagcgcccgcgggttctgagagcgctcaaagccgccgagtcaggctgcccagcccgccgggcctcgccgcagtgatcctcattcccgaatctggcagcgctgtcaaaggcttgtattaggaggtgaacggcggccgcaggcccactccacgcggttgctgaaaccgagctgggcgcgcgcgggggccgaatctcgccgcctccgcgctcctgtcggggcagctcccgatcccgggctgcgcggcttcggtccccaagacggccacttccagccctaggccccttggccgcagcgcttcccaaaccaagagagatcctttctcaactcagagcttttcattagcagtcgttaataatggccctgagttgccttatcatctcctggaaatgagaaataaatttcttcggagaacgtttccctttgtaaaggacagagagttttaaagatacaggtatgatgtaagacacataaatacctaggtaagcattagcagaaattctcttttccttatatttaagtataataaacatacaagtgtagctcaatgaattttcacaaactgacattctgtgtaaccagcagcctaagaaactgctttaccaacgatcccctagctcgcctccagttatgcacgccaataaccactagcctaacttctaccacatgcccattacttctgtagtttaaaacttctgattcttgaatgtaaacgtttaacaataaatcgcttgaatttaactcaaatttcaaatgtaagatgaagtcagagatgcagcctgaatctaggatcataatttgtcttgtgcggagggcgagtaatttccttgggcaagaaaataactggaggtgacagttgtttggggctgcagtcgtccgggccaggagcacagggcgggaaggaatggcccatctcttagggctctctgcttgtcacctaccaggttggtcagaaacgttctcatcaaagcaatggttctcttttcttttctctttgggacagaaggagtttcttgaccgccctcttccctgcaaatgcataaacaaccactgctcctgtctccaagctcagattcctaccaagatagccttttctcttcccctctcttttgtaagtctcttgatttcattctttgaacctgtgattggaggttaaagtgcaccaggttggaaggaggaagctcttaacaataaaggtttgaatatttagctgtgtcaggtcgctgccctctcacgagcctccctcccctttatcttttaaaatgcaaattatgtttcgaggggttgtgcgtagagtgcgcgctgcgcctcgacgtctccaaccattggtgtctgtgtcattactaatagagtcttgtaaacactcgttaatcacggaaggccgccggcctggggctccgcacgccagcctgtggcgggtcttccccgcctctgcagcctagtgggaaggaggtgggaggaaagaaggaagaaagggagggagggaggaggcaggccagagggagggaccgcctcggaggcagaagagccgcgaggagccagcggagcaccgcgggctggggcgcagccacccgccgctcctcgagtcccctcgcccctttcccttcgtgccccccggcagcctccagcgtcggtccccaggcagcatggtgaggtctgctcccggaccctcgccaccatgtacgtgagctacctcctggacaaggacgtgagcatgtaccctagctccgtgcgccactctggcggcctcaacctggcgccgcagaacttcgtcagccccccgcagtacccggactacggcggttaccacgtggcggccgcagctgcagcggcagcgaacttggacagcgcgcagtccccggggccatcctggccggcagcgtatggcgccccactccgggaggactggaatggctacgcgcccggaggcgccgcggccgccgccaacgccgtggctcacggcctcaacggtggctccccggccgcagccatgggctacagcagccccgcagactaccatccgcaccaccacccgcatcaccacccgcaccacccggccgccgcgccttcctgcgcttctgggctgctgcaaacgctcaaccccggccctcctgggcccgccgccaccgctgccgccgagcagctgtctcccggcggccagcggcggaacctgtgcgagtggatgcggaagccggcgcagcagtccctcggcagccaagtgaaaaccaggacgaaagacaaatatcgagtggtgtacacggaccaccagcggctggagctggagaaggagtttcactacagtcgctacatcaccatccggaggaaagccgagctagccgccacgctggggctctctgagaggcaggttaaaatctggtttcagaaccgcagagcaaaggagaggaaaatcaacaagaagaagttgcagcagcaacagcagcagcagccaccacagccgcctccgccgccaccacagcctccccagcctcagccaggtcctctgagaagtgtcccagagcccttgagtccggtgtcttccctgcaagcctcagtgcctggctctgtccctggggttctggggccaactgggggggtgctaaaccccaccgtcacccagtgacccaccgggttctgcagcggcagagcaattccaggctgagccatgaggagcgtggactctgctagactcctcaggagagacccctcccctcccacccacagccatagacctacagacctggctctcagaggaaaaatgggagccaggagtaagacaagtgggatttggggcctcaagaaatatactctcccagatttttactttttcccatctggctttttctgccactgaggagacagaaagcctccgctgggcttcattccggactggcagaagcattgcctggactgaccacaccaaccaggccttcatcctcctccccagctcttctcttcctagatctgcaggctgcacctctggctagagccgaggggagagagggactcaagggaaaggcaagcttgaggccaagatggctgctgcctgctcatggccctcggaggtccagctgggcctcctgcctccgggcaggcaaggtttacactgcggaagccaaaggcagctaagatagaaagctggactgaccaaagactgcagaacccccaggtggcctgcgtcttttttctcttcccttcccagaccaggaaaggcttggctggtgtatgcacagggtgtggtatgagggggtggttattggactccaggcctgaccagggggcccgaacagggacttgtttagagagcctgtcaccagagcttctctgggctgaatgtatgtcagtgctataaatgccagagccaacctggacttcctgtcattttcacaatcttggggctgatgaagaagggggtggggggagtttgtgttgttgttgctgctgtttgggttgttggtctgtgtaacatccaagccagagtttttaaagccttctggatccatggggggagaagtgatatggtgaagggaagtggggagtatttgaacacagttgaattttttctaaaaagaaaaagagataaatgagctttccagatttcagattctgtatttatcttcagattttgtctgcaactattttttattttttaaagaaatgaaatatcttctctgcttgcaagctgatttggaaaattcagagagggagtggagattatctggacagcctcattttaccccagagcatcagaagcctgaaagagcaggttctgagaccttccctgcccccaagcctgagcccagccttggaatgcgtggctctcctgggggtgcctttgggcaaaatgcacatctgaatggccaggtgcttcccagcagtcagaaattatggggggtgggggtgagagggccccctcatagcatctcaccaaatccacatggaggctttttgcaaacagcaggcagttcccttctgcagtgactccctcctaaggacgccccacaacccagctagttaaacgtgagcattaaattttttttaaaaaaaat

SEQ ID NO: 4904 - DNA, 1517 bp, Homo sapiens
cgatgtacggaagctgtcttttggagaaagaagcaggcatgtacccgggcactctcatgagccctgggggcgacggcacagctgggacaggcggcacagggggcggtgggagtccgatgccagcctccaatttcgctgcggcaccggctttctcgcactatatggggtatcctcatatgcccagcatggatcctcactggccgtctctgggagtctggggctcaccctacagtcccccgcgagaagactggagcgtgtatcctgggccgtctagtacaatgggcacagtgccggtgaacgacgtgacctctagccccgccgctttctgctcgaccgactacagcaacttgggccctgtgggcggtggaactagcggcagcagcctaccaggccaggctggcgggtcgcttgtcccgacggacgcaggcgccgccaaggccagttcccccagcaggagccgccacagcccctatgcatggatgcgcaagacggtgcaggtgacggggaaaaccaggacaaaagaaaagtatcgtgtagtttacactgatcatcaaagattggagctggaaaaggaattccattgcaatagatatatcaccatccagagaaaatcagagctggcagttaacctgggcctttccgagagacaggtgaaaatctggtttcagaatcgcagagccaaggagagaaagatgatcaaaaagaaaatctcccagtttgagaatagtggaggctcggtgcaaagtgactctgactccatcagccctggggaactacctaacacttttttcaccacaccatctgctgttcgtggatttcaacctattgagatacagcaggttatagtctccgaatgaaagaaagcaaagagaaatttaaagtgccctttttttagtgatgtcttttgggtctctaagctatctacaggggagttggagcagggtgtaattccctgtaaggcagtatttggaacagatggatgcacaatgggttgaagataatttaggggactcttacttttagaaactatccccagaaaactcctgtcacgtgctgtgctatatgtcagtcactcaggaatcttagtggtaaggtatataattaaaagctagaatcacaggcccttccaactctgttcacaatttcagaaacttgcttatgaatagactgtaaaatacaattttgccagaaagcacatttgtgtatgtgtacttctgtttgttatttgatgctaggtgttttcttttatgctatctttaaggagtgagaagaaggtaaaccgaagtttatctatctttagctacctttccaagtgtttaattcaaaagctaacagaatttttataataagataaatgttttaaaaatcatcagaaggtgattctgattccattgtcactgcttaacaagaataaccaataaaaaagacaattttggccctcaatcatacttgtctggcatcaattatctcagaactttcaacttgcagtgtcattttaaaatcttgtcaaaacaatg

SEQ ID NO: 4905 - DNA, 1431 bp, Homo sapiens
ctctctgccccaagtattttcagccccagccggccacacagctcggatctcctcctgtggatccccccagctctgcgatgatggcagaagagcacacagatctcgaggcccagatcgtcaaggatatccactgcaaggagattgacctggtgaaccgagaccccaagaacattaacgaggacatagtcaaggtggattttgaagacgtgatcgcagagcctgtgggcacctacagctttgacggcgtgtggaaggtgagctacaccaccttcactgtctccaagtactggtgctaccgtctgttgtccacgctgctgggcgtcccactggccctgctctggggcttcctgttcgcctgcatctccttctgccacatctgggcggtggtgccatgcattaagagctacctgatcgagatccagtgcatcagccacatctactcactctgcatccgcaccttctgcaacccactcttcgcggccctgggccaggtctgcagcagcatcaaggtggtgctgcggaaggaggtctaaagccaggtggggcaacagcggtggcagggcagggggtggtgggccagactggtccccgggggacttcttcacaggggctgctggcgagctctttctctttagggactgctccataccccatgatggagcacacggtgtagggaagccagaaagaaaagacggcccagccacagaagcacaatggcccttcgctctcccccagccccaccatgatgcccccatgcctgggcgtgggggaagatcatttgccaagaggcagctactgcaagtctttgcgttcacttgtactgtaacaacataaaccagcacgcggttcccacccggggccaacctctccacgcgcactcaggaaagtgaccagtgaccactggcgttaggaaggtggctccagtaaagggttttggctgcatttggggaatgctgcattttgttcgtgcctgtaagattggtttgtgtcctgaccagctccaaaaatatacttcactgccctgaaaaacagacacagggagagttggttgtctcttcacttggccaaatgtaagtgaagaacagagtctttttcttcttcggattctattgtttgctggaaccgtacacgttccttggaagatcatgtttaagtgactcctgttgcctgagcacaaaaatgggcaccaatggaggaaaatgacccttgggctggcaggggcagtgacccttccagggtaccactgagggaagggcctgggttcaagcctcccggaacctcccctttggctaaccgagcccctgaaatgcccagtactgccatttgacatgagggtaccttcgccctcaggagatgtgacgaaggaacaaggtctaatttgtgcgtgtgtggactcactatggaaataaaatgcagtagaaagagcatgta

SEQ ID NO: 4906 - DNA, 1260 bp, Homo sapiens
ccagctctgcgatgatggcagaagagcacacagatctcgaggcccagatcgtcaaggatatccactgcaaggagattgacctggtgaaccgagaccccaagaacattaacgaggacatagtcaaggtggattttgaagacgtgatcgcagagcctgtgggcacctacagctttgacggcgtgtggaaggtgagctacaccaccttcactgtctccaagtactggtgctaccgtctgttgtccacgctgctgggcgtcccactggccctgctctggggcttcctgttcgcctgcatctccttctgccacatctgggcggtggtgccatgcattaagagctacctgatcgagatccagtgcatcagccacatctactcactctgcatccgcaccttctgcaacccactcttcgcggccctgggccaggtctgcagcagcatcaaggtggtgctgcggaaggaggtctaaagccagggactgctccataccccatgatggagcacacggtgtagggaagccagaaagaaaagacggcccagccacagaagcacaatggcccttcgctctcccccagccccaccatgatgcccccatgcctgggcgtgggggaagatcatttgccaagaggcagctactgcaagtctttgcgttcacttgtactgtaacaacataaaccagcacgcggttcccacccggggccaacctctccacgcgcactcaggaaagtgaccagtgaccactggcgttaggaaggtggctccagtaaagggttttggctgcatttggggaatgctgcattttgttcgtgcctgtaagattggtttgtgtcctgaccagctccaaaaatatacttcactgccctgaaaaacagacacagggagagttggttgtctcttcacttggccaaatgtaagtgaagaacagagtctttttcttcttcggattctattgtttgctggaaccgtacacgttccttggaagatcatgtttaagtgactcctgttgcctgagcacaaaaatgggcaccaatggaggaaaatgacccttgggctggcaggggcagtgacccttccagggtaccactgagggaagggcctgggttcaagcctcccggaacctcccctttggctaaccgagcccctgaaatgcccagtactgccatttgacatgagggtaccttcgccctcaggagatgtgacgaaggaacaaggtctaatttgtgcgtgtgtggactcactatggaaataaaatgcagtagaaa

SEQ ID NO: 4907 - DNA, 1905 bp, Homo sapiens
gtcctgccgagctgtgagggcaacggaggggaaataaaagggaacggctccgaatctgccccagcggccgctgcgagacctcggcgccgacatcgcgacagcgaagcgctttgcacgccaggaaggtcccctctatgtgctgctgagccggtcctggacgcgacgagcccgccctcggtcttcggagcagaaatcgcaaaaacggaaggactggaaatggcagaccatatgatggccatgaaccacgggcgcttccccgacggcaccaatgggctgcaccatcaccctgcccaccgcatgggcatggggcagttcccgagcccccatcaccaccagcagcagcagccccagcacgccttcaacgccctaatgggcgagcacatacactacggcgcgggcaacatgaatgccacgagcggcatcaggcatgcgatggggccggggactgtgaacggagggcaccccccgagcgcgctggcccccgcggccaggtttaacaactcccagttcatgggtcccccggtggccagccagggaggctccctgccggccagcatgcagctgcagaagctcaacaaccagtatttcaaccatcacccctacccccacaaccactacatgccggatttgcaccctgctgcaggccaccagatgaacgggacaaaccagcacttccgagattgcaaccccaagcacagcggcggcagcagcacccccggcggctcgggcggcagcagcacccccggcggctctggcagcagctcgggcggcggcgcgggcagcagcaacagcggcggcggcagcggcagcggcaacatgcccgcctccgtggcccacgtccccgctgcaatgctgccgcccaatgtcatagacactgatttcatcgacgaggaagttcttatgtccttggtgatagaaatgggtttggaccgcatcaaggagctgcccgaactctggctggggcaaaacgagtttgattttatgacggacttcgtgtgcaaacagcagcccagcagagtgagctgttgactcgatcgaaaccccggcgaaagaaatcaaacccccaacttcttcggcgtgaattaaaagaaacattcccttagacacagtatctcacttttcagatcttgaaaggtttgagaacttggaaacaaagtaaactataaacttgtacaaattggttttaaaaaaaattgctgccacttttttttcctgtttttgtttcgtttttgtagccttgacattcacccacctcccttatgtagttgaaatatctagctaacttggtctttttcgttgtttgtttttactcctttccctcactttctccagtgctcaactgttagatattaatcttggcaaactgcttaatcttgtggattttgtagatggtttcaaatgactgaactgcattcagatttacgagtgaaaggaaaaattgcattagttggttgcatgaacttcgaagggcagatattactgcacaaactgccatctcgcttcatttttttaactatgcatttgagtacagactaatttttaaaatatgctaaactggaagattaaacagatgtgggccaaactgttctggatcaggaaagtcatactgttcactttcaagttggctgtcccccccgccgccccccccacccccatatgtacagatgataatagggtgtggaatgtcgtcagtggcaaacatttcacagatttttattttgtttctgtcttcaacatttttgacactgtgctaatagttatattcagtacatgaaaagatactactgtgttgaaagctttttaggaaattttgacagtatttttgtacaaaacatttttttgaaaaaatacttgttaatttattctattttaatttgccaatgtcaataaaaagttaagaaataa

SEQ ID NO: 4908 - DNA, 645 bp, Homo sapiens
atggcagaccatatgatggccatgaaccacgggcgcttccccgacggcaccaatgggctgcaccatcaccctgcccaccgcatgggcatggggcagttcccgagcccccatcaccaccagcagcagcagccccagcacgccttcaacgccctaatgggcgagcacatacactacggcgcgggcaacatgaatgccacgagcggcatcaggcatgcgatggggccggggactgtgaacggagggcaccccccgagcgcgctggcccccgcggccaggtttaacaactcccagttcatgggtcccccggtggccagccagggaggctccctgccggccagcatgcagctgcagaagctcaacaaccagtatttcaaccatcacccctacccccacaaccactacatgccggatttgcaccctgctgcaggccaccagatgaacgggacaaaccagcacttccgagattgcaacccccccaatgtcatagacactgatttcatcgacgaggaagttcttatgtccttggtgatagaaatgggtttggaccgcatcaaggagctgcccgaactctggctggggcaaaacgagtttgattttatgacggacttcgtgtgcaaacagcagcccagcagagtgagctgttga

SEQ ID NO: 4909 - DNA, 1793 bp, Homo sapiens
gagggcagggtttgcccggaggaagagcgtgaggcgaagctggggaataacaacaggatgtgcaacaacaggatgaggagggctgatttaatgcctgaagactggaaatggcagaccatatgatggccatgaaccacgggcgcttccccgacggcaccaatgggctgcaccatcaccctgcccaccgcatgggcatggggcagttcccgagcccccatcaccaccagcagcagcagccccagcacgccttcaacgccctaatgggcgagcacatacactacggcgcgggcaacatgaatgccacgagcggcatcaggcatgcgatggggccggggactgtgaacggagggcaccccccgagcgcgctggcccccgcggccaggtttaacaactcccagttcatgggtcccccggtggccagccagggaggctccctgccggccagcatgcagctgcagaagctcaacaaccagtatttcaaccatcacccctacccccacaaccactacatgccggatttgcaccctgctgcaggccaccagatgaacgggacaaaccagcacttccgagattgcaaccccaagcacagcggcggcagcagcacccccggcggctcgggcggcagcagcacccccggcggctctggcagcagctcgggcggcggcgcgggcagcagcaacagcggcggcggcagcggcagcggcaacatgcccgcctccgtggcccacgtccccgctgcaatgctgccgcccaatgtcatagacactgatttcatcgacgaggaagttcttatgtccttggtgatagaaatgggtttggaccgcatcaaggagctgcccgaactctggctggggcaaaacgagtttgattttatgacggacttcgtgtgcaaacagcagcccagcagagtgagctgttgactcgatcgaaaccccggcgaaagaaatcaaacccccaacttcttcggcgtgaattaaaagaaacattcccttagacacagtatctcacttttcagatcttgaaaggtttgagaacttggaaacaaagtaaactataaacttgtacaaattggttttaaaaaaaattgctgccacttttttttcctgtttttgtttcgtttttgtagccttgacattcacccacctcccttatgtagttgaaatatctagctaacttggtctttttcgttgtttgtttttactcctttccctcactttctccagtgctcaactgttagatattaatcttggcaaactgcttaatcttgtggattttgtagatggtttcaaatgactgaactgcattcagatttacgagtgaaaggaaaaattgcattagttggttgcatgaacttcgaagggcagatattactgcacaaactgccatctcgcttcatttttttaactatgcatttgagtacagactaatttttaaaatatgctaaactggaagattaaacagatgtgggccaaactgttctggatcaggaaagtcatactgttcactttcaagttggctgtcccccccgccgccccccccacccccatatgtacagatgataatagggtgtggaatgtcgtcagtggcaaacatttcacagatttttattttgtttctgtcttcaacatttttgacactgtgctaatagttatattcagtacatgaaaagatactactgtgttgaaagctttttaggaaattttgacagtatttttgtacaaaacatttttttgaaaaaatacttgttaatttattctattttaatttgccaatgtcaataaaaagttaagaaa

SEQ ID NO: 4910 - DNA, 1776 bp, Homo sapiens
caaagggggtgtgggctcgggtccccccgcccgatcgcaggggaaggggctgtttgtgcagcgtccggctgtgttatgagtggactggaaatggcagaccatatgatggccatgaaccacgggcgcttccccgacggcaccaatgggctgcaccatcaccctgcccaccgcatgggcatggggcagttcccgagcccccatcaccaccagcagcagcagccccagcacgccttcaacgccctaatgggcgagcacatacactacggcgcgggcaacatgaatgccacgagcggcatcaggcatgcgatggggccggggactgtgaacggagggcaccccccgagcgcgctggcccccgcggccaggtttaacaactcccagttcatgggtcccccggtggccagccagggaggctccctgccggccagcatgcagctgcagaagctcaacaaccagtatttcaaccatcacccctacccccacaaccactacatgccggatttgcaccctgctgcaggccaccagatgaacgggacaaaccagcacttccgagattgcaaccccaagcacagcggcggcagcagcacccccggcggctcgggcggcagcagcacccccggcggctctggcagcagctcgggcggcggcgcgggcagcagcaacagcggcggcggcagcggcagcggcaacatgcccgcctccgtggcccacgtccccgctgcaatgctgccgcccaatgtcatagacactgatttcatcgacgaggaagttcttatgtccttggtgatagaaatgggtttggaccgcatcaaggagctgcccgaactctggctggggcaaaacgagtttgattttatgacggacttcgtgtgcaaacagcagcccagcagagtgagctgttgactcgatcgaaaccccggcgaaagaaatcaaacccccaacttcttcggcgtgaattaaaagaaacattcccttagacacagtatctcacttttcagatcttgaaaggtttgagaacttggaaacaaagtaaactataaacttgtacaaattggttttaaaaaaaattgctgccacttttttttcctgtttttgtttcgtttttgtagccttgacattcacccacctcccttatgtagttgaaatatctagctaacttggtctttttcgttgtttgtttttactcctttccctcactttctccagtgctcaactgttagatattaatcttggcaaactgcttaatcttgtggattttgtagatggtttcaaatgactgaactgcattcagatttacgagtgaaaggaaaaattgcattagttggttgcatgaacttcgaagggcagatattactgcacaaactgccatctcgcttcatttttttaactatgcatttgagtacagactaatttttaaaatatgctaaactggaagattaaacagatgtgggccaaactgttctggatcaggaaagtcatactgttcactttcaagttggctgtcccccccgccgccccccccacccccatatgtacagatgataatagggtgtggaatgtcgtcagtggcaaacatttcacagatttttattttgtttctgtcttcaacatttttgacactgtgctaatagttatattcagtacatgaaaagatactactgtgttgaaagctttttaggaaattttgacagtatttttgtacaaaacatttttttgaaaaaatacttgttaatttattctattttaatttgccaatgtcaataaaaagttaagaaa

SEQ ID NO: 4911 - DNA, 5750 bp, Homo sapiens
ctttccctgtgtcagatcagggatcattttttttccttcctctactccctcccccctacccgcccctccctccctgtttcccttccctccctccctcccctctctgctgggtctgtgcgctggggcgcccgatcccctccgcagctgggacgctccgaactcgaggcaggagtcggctctccggagcctcgtccctcccttccccttccctgcccccttcccccacccccgactcgggcttggcgcggcggccagaggaaccccgagtcccggcccaggcccctgagctggagggatggaaaactcctctgcagcatcagcctcctcggaggcagggagcagccgctcccaggagatcgaggagctggagcgcttcatcgacagctacgtgctggagtaccaggtgcaggggctgctggctgacaagacggagggtgatggcgagagcgagaggacccagtcccacatctcccagtggacagcggactgcagcgaaccgctggacagcagctgttccttctcccgagggcgagcccccccacagcagaatggcagcaaagacaactctctggacatgctgggcacggacatctgggcggccaacaccttcgattccttcagtggtgccacctgggacctgcagccggaaaagctggacttcacccagttccaccgcaaagtccgacacacgcccaagcagcccctgccacacatcgaccgcgaagggtgtggcaaagggaagctggaagatggggatggcatcaacctgaatgacatcgagaaggtccttccagcctggcagggctaccacccgatgccccatgaagtggagatcgcacacaccaagaagctgttccgcaggaggagaaatgatcgaaggcggcagcagagacctccggggggcaacaagccccaacagcatggtgaccaccagccaggcagtgccaaacacaacagggaccaccagaaatcctaccaggggggctcagcaccccacccctcagggaggcccactcaccatggctacagccagaaccggcgctggcaccatggcaacatgaagcacccaccaggcgacaagggggaggcaggcgcacaccgcaatgccaaagagaccatgaccatcgagaacccaaaactggaggacactgcaggggacaccgggcacagcagccttgaggccccccgcagccctgacaccctggccccggtggcttctgagcggctgcccccacagcagtcaggggggccagaggttgagacaaaacgtaaagacagtattcttcccgagcgcatcggggagcggcccaaaattaccctgctccagtcttccaaagacagactgcggcgaaggctaaaggaaaaggatgaagtggccgtggagacgaccactccccagcagaacaagatggacaagctgatcgagatcctgaacagcatgcggaacaacagcagcgacgtggacaccaagctcaccaccttcatggaggaggcccagaactccaccaactccgaggagatgctgggcgagatcgtgcgcacaatctaccagaaggctgtgtccgaccgcagcttcgccttcaccgctgccaagctctgcgacaagatggcgctctttatggtggaggggaccaagttccggagcctgctcctcaacatgctgcagaaggacttcacggtgcgcgaggagctgcagcagcaggacgtggagcgctggctgggcttcatcaccttcctgtgcgaggtcttcggcaccatgcgcagcagcacaggcgagcccttccgtgtgctcgtgtgccccatctacacctgcctcagggagctcttgcaatctcaggatgtgaaggaagatgctgtcctttgctgctctatggagctgcagagtacaggccggctgctggaggaacagctgcctgagatgatgacagagctcctggccagcgcacgggacaagatgctgtgcccctcggagtccatgctgacccggtcgctgctcctagaggtcatcgagctccacgctaacagctggaaccctctgacgccccccatcacgcagtactacaacagaaccatccagaaactgacagcctgacagccagggggcctggcaggcggcccacgggcagctggggccctggtgcacagggccagatggacaggcgggaggacaggggtggccctggcgggagaaagaaatggggaggagggcaggcagagtcggtggccagtctggagccagacggggaagggagcaaatccctgagaggagtgcccccgcacaagccccccagcccgagcatgcaagctcacaccaataagggaagcatgtttctttttcctggtggccctggccctccccttcctcactcccgcctctcccctccccatcagacccatcccccacggagctttgtgtgagggatctcatcgctgtgactcctcggagaccttggcagcctcgcacgccggggcaccgcttgggtcagaaaggacctcggaaggctgaaaaagtgggtcggagacgggctcgcattgttcccgcatgctgtcagccgcagtcgccaactggcagcaggcgacgtgtagcagatgtccgggaggacaaaggcaggcacggtccccaccagccgcccgtaattgacggcctttgtcagccatggcagagctgacgctccacctcccacctccaagtcctcctcactgcagcccccacagcctcaggcctagggggtcaggcgcagcgggggagatggagtttgcagttccacttgcactcttttgtttattgtgttttatttttcaaaagtcggttgctttgaagtctctttggccaatgaaaatgcccgtgatgtgatcacacagtcagcactgttgaggacccccggattagtgggagatcaaacccagctcccctctagaagaaggattcgagccacagacagcttgccagtagccaattagggtaattggaaacttctgccccggcggggggtccccgctggaatcctgtgttcctcgccactggcttccagcgcctctgttttctcaaagggctgatactgtcaccactgggaccaagttaaacctggtcctggccccaggggccttgtggcaaacagggcacagaacgagactggcaaattaaaaccaaaattctagatggtgtcttgcgctccacacgcaggtcttactggggaaaaggatgggagtgggggctccccaggactcgattttagctaatgcgctgtgtcactgccccagctcggacgtagaagcccagccctccgtgagctcttgggaaaggggtgaattcactgggtcatggaagggacagtcaggtgaccagcggggtcgccagatgaagcttcccagccgggaaacaagacggggtttcttggcaggccctggtcctggggagcaggccctgttgttggctggagaggaaggtgtggggtggaacaggtgtccacatagctccatctctgggggctggagcacacactttgatgagcccccccggaaatgatgtcagagcctagccgcttccttatttgctcttttattgaggccgggcaggccctgggtcactttggaggcccctcttggtccacactggactggccgggaggtgatgggcggggaaggttctcgtgattgattgattctgagtctgagagtggcgagtggggagaggcttccccagttctctccagctttccctgcagctgcaacctgccctctggtcccaggtgtggagcctttgcctgtctctaaaaagagcctgttggcgacaaggtgtagggggcacaagtttacctgaaacaggtcagtggtctctcccaagaagcgcacgccacctctggtccctggccctgaaccctgccttcttcctccctccacggtttcttcccagactttctcaagctcctcctcactgcccttcctccccagcccagcctgggaacacagatgccccgcgggtaggaggcctcgagggaggagccgggctgatgcggggctgctcagggcaggccccagggcgagcttgccatcgtggccaggcagcctccacctgtgcttcagtggcccctgcccccctgaagcatgtggggtttgtccgctaggaggaggcaaggcccccgaagagaggagagacctgggagtgggagctcaggtcagggaggaggcaggggagtggggtctcccagacccaacggtgagctcagagcaagcttcacgcaggacgctccgaaacactgtgtggagggggctgtgttgtgggcaccttggggcctgattctccttcctccgaacgggctccttgatggcctggccacaggggcagctccccattggctgttaggaccagagtgtgaagaagaagtgaaatataaatatgtatacatatataaatatatttttaattacatgtcgtgtcacggtggctccagacatactgtttgcctagtttattccactgcttgaaagcgcttcctagccaatctgaacaacaacactttaagctgtttttctaaatgcaggttgctgctcctttttcagatatggaaggaaaacgttaagactattttttttttaaagaaacaacagtcaagcctaaaatttgagaccccgaggcagcttcccgagggagactgctcagacaggaactgcaggacagaagtggatgccccacagaccctggccccctccccaagtccatcccctctctgtggcatgaggaaggccgcgtccgagttgacctctgaatgtatgtgatgagaggcagagctggatattgcatttctaaggcttgcattgctttcccctcgcccgcggttcttggcgcatggaagaggcggtccagccatctgatgttgatcctgtctcagtctccccactgcctgtcaggatgagttagtcattgtttttctccgaggcggcctgcttgccacagccctgctccccaaggcctggtggctttgccgaagctctgggaccgcagccccagcgaggcccccaacctcacccagacgaggccaggagccccgccaccctccacgggatgtgcaccctcagaccccattctctctgttcgtccttccttgaccagtctgtaaaccttcactgtttggggatcgtcctgtccatccatgtaaatgtaaatgttggccgagtcggtatttattctgattgatttttattttattctattattttctccgagggatgagggtggggggtgtgggaagggtaccacagatcaggccggggcagctgtaggggcgggggcccagacagccaggccgccaccagagcagccccatggggtgccccagacgcgggcctccaagaagccaagtcccagtctgttttctggcatcagacaccggcccgtgttccttgtcagacagacagactctcaggcctgcctggggagtcgtgtccctcagctgcagggcactgtgttgggaaaccattggctgggcctttgaggacacagatcagaagaaagaaagacaactttcctctgcgcggaacactcacacggaagggctggccgcctccctgagccggctgggagtggacgacaggacctacctccccagagcaagggcctggggcttcccgccaaagctgccgcggaaccccgctagtgcgaccaccctccctccgtcggtatgtcctgctttccagctgaacccaaactacaagtgggtttaaaaaaataaacaccaccaccaaaaacaaaa

SEQ ID NO: 4912 - DNA, 5810 bp, Homo sapiens
gtcagatcagggatcattttttttccttcctctactccctcccccctacccgcccctccctccctgtttcccttccctccctccctcccctctctgctgggtctgtgcgctggggcgcccgatcccctccgcagctgggacgctccgaactcgaggcaggagtcggctctccggagcctcgtccctcccttccccttccctgcccccttcccccacccccgactcgggcttggcgcggcggccagaggaaccccgagcccgcatttgctgcatcgagcagttggtttagtatcagccaaacttgcagctgttcagaccgcgctccgccgagtcccggcccaggcccctgagctggagggatggaaaactcctctgcagcatcagcctcctcggaggcagggagcagccgctcccaggagatcgaggagctggagcgcttcatcgacagctacgtgctggagtaccaggtgcaggggctgctggctgacaagacggagggtgatggcgagagcgagaggacccagtcccacatctcccagtggacagcggactgcagcgaaccgctggacagcagctgttccttctcccgagggcgagcccccccacagcagaatggcagcaaagacaactctctggacatgctgggcacggacatctgggcggccaacaccttcgattccttcagtggtgccacctgggacctgcagccggaaaagctggacttcacccagttccaccgcaaagtccgacacacgcccaagcagcccctgccacacatcgaccgcgaagggtgtggcaaagggaagctggaagatggggatggcatcaacctgaatgacatcgagaaggtccttccagcctggcagggctaccacccgatgccccatgaagtggagatcgcacacaccaagaagctgttccgcaggaggagaaatgatcgaaggcggcagcagagacctccggggggcaacaagccccaacagcatggtgaccaccagccaggcagtgccaaacacaacagggaccaccagaaatcctaccaggggggctcagcaccccacccctcagggaggcccactcaccatggctacagccagaaccggcgctggcaccatggcaacatgaagcacccaccaggcgacaagggggaggcaggcgcacaccgcaatgccaaagagaccatgaccatcgagaacccaaaactggaggacactgcaggggacaccgggcacagcagccttgaggccccccgcagccctgacaccctggccccggtggcttctgagcggctgcccccacagcagtcaggggggccagaggttgagacaaaacgtaaagacagtattcttcccgagcgcatcggggagcggcccaaaattaccctgctccagtcttccaaagacagactgcggcgaaggctaaaggaaaaggtaccggatgaagtggccgtggagacgaccactccccagcagaacaagatggacaagctgatcgagatcctgaacagcatgcggaacaacagcagcgacgtggacaccaagctcaccaccttcatggaggaggcccagaactccaccaactccgaggagatgctgggcgagatcgtgcgcacaatctaccagaaggctgtgtccgaccgcagcttcgccttcaccgctgccaagctctgcgacaagatggcgctctttatggtggaggggaccaagttccggagcctgctcctcaacatgctgcagaaggacttcacggtgcgcgaggagctgcagcagcaggacgtggagcgctggctgggcttcatcaccttcctgtgcgaggtcttcggcaccatgcgcagcagcacaggcgagcccttccgtgtgctcgtgtgccccatctacacctgcctcagggagctcttgcaatctcaggatgtgaaggaagatgctgtcctttgctgctctatggagctgcagagtacaggccggctgctggaggaacagctgcctgagatgatgacagagctcctggccagcgcacgggacaagatgctgtgcccctcggagtccatgctgacccggtcgctgctcctagaggtcatcgagctccacgctaacagctggaaccctctgacgccccccatcacgcagtactacaacagaaccatccagaaactgacagcctgacagccagggggcctggcaggcggcccacgggcagctggggccctggtgcacagggccagatggacaggcgggaggacaggggtggccctggcgggagaaagaaatggggaggagggcaggcagagtcggtggccagtctggagccagacggggaagggagcaaatccctgagaggagtgcccccgcacaagccccccagcccgagcatgcaagctcacaccaataagggaagcatgtttctttttcctggtggccctggccctccccttcctcactcccgcctctcccctccccatcagacccatcccccacggagctttgtgtgagggatctcatcgctgtgactcctcggagaccttggcagcctcgcacgccggggcaccgcttgggtcagaaaggacctcggaaggctgaaaaagtgggtcggagacgggctcgcattgttcccgcatgctgtcagccgcagtcgccaactggcagcaggcgacgtgtagcagatgtccgggaggacaaaggcaggcacggtccccaccagccgcccgtaattgacggcctttgtcagccatggcagagctgacgctccacctcccacctccaagtcctcctcactgcagcccccacagcctcaggcctagggggtcaggcgcagcgggggagatggagtttgcagttccacttgcactcttttgtttattgtgttttatttttcaaaagtcggttgctttgaagtctctttggccaatgaaaatgcccgtgatgtgatcacacagtcagcactgttgaggacccccggattagtgggagatcaaacccagctcccctctagaagaaggattcgagccacagacagcttgccagtagccaattagggtaattggaaacttctgccccggcggggggtccccgctggaatcctgtgttcctcgccactggcttccagcgcctctgttttctcaaagggctgatactgtcaccactgggaccaagttaaacctggtcctggccccaggggccttgtggcaaacagggcacagaacgagactggcaaattaaaaccaaaattctagatggtgtcttgcgctccacacgcaggtcttactggggaaaaggatgggagtgggggctccccaggactcgattttagctaatgcgctgtgtcactgccccagctcggacgtagaagcccagccctccgtgagctcttgggaaaggggtgaattcactgggtcatggaagggacagtcaggtgaccagcggggtcgccagatgaagcttcccagccgggaaacaagacggggtttcttggcaggccctggtcctggggagcaggccctgttgttggctggagaggaaggtgtggggtggaacaggtgtccacatagctccatctctgggggctggagcacacactttgatgagcccccccggaaatgatgtcagagcctagccgcttccttatttgctcttttattgaggccgggcaggccctgggtcactttggaggcccctcttggtccacactggactggccgggaggtgatgggcggggaaggttctcgtgattgattgattctgagtctgagagtggcgagtggggagaggcttccccagttctctccagctttccctgcagctgcaacctgccctctggtcccaggtgtggagcctttgcctgtctctaaaaagagcctgttggcgacaaggtgtagggggcacaagtttacctgaaacaggtcagtggtctctcccaagaagcgcacgccacctctggtccctggccctgaaccctgccttcttcctccctccacggtttcttcccagactttctcaagctcctcctcactgcccttcctccccagcccagcctgggaacacagatgccccgcgggtaggaggcctcgagggaggagccgggctgatgcggggctgctcagggcaggccccagggcgagcttgccatcgtggccaggcagcctccacctgtgcttcagtggcccctgcccccctgaagcatgtggggtttgtccgctaggaggaggcaaggcccccgaagagaggagagacctgggagtgggagctcaggtcagggaggaggcaggggagtggggtctcccagacccaacggtgagctcagagcaagcttcacgcaggacgctccgaaacactgtgtggagggggctgtgttgtgggcaccttggggcctgattctccttcctccgaacgggctccttgatggcctggccacaggggcagctccccattggctgttaggaccagagtgtgaagaagaagtgaaatataaatatgtatacatatataaatatatttttaattacatgtcgtgtcacggtggctccagacatactgtttgcctagtttattccactgcttgaaagcgcttcctagccaatctgaacaacaacactttaagctgtttttctaaatgcaggttgctgctcctttttcagatatggaaggaaaacgttaagactattttttttttaaagaaacaacagtcaagcctaaaatttgagaccccgaggcagcttcccgagggagactgctcagacaggaactgcaggacagaagtggatgccccacagaccctggccccctccccaagtccatcccctctctgtggcatgaggaaggccgcgtccgagttgacctctgaatgtatgtgatgagaggcagagctggatattgcatttctaaggcttgcattgctttcccctcgcccgcggttcttggcgcatggaagaggcggtccagccatctgatgttgatcctgtctcagtctccccactgcctgtcaggatgagttagtcattgtttttctccgaggcggcctgcttgccacagccctgctccccaaggcctggtggctttgccgaagctctgggaccgcagccccagcgaggcccccaacctcacccagacgaggccaggagccccgccaccctccacgggatgtgcaccctcagaccccattctctctgttcgtccttccttgaccagtctgtaaaccttcactgtttggggatcgtcctgtccatccatgtaaatgtaaatgttggccgagtcggtatttattctgattgatttttattttattctattattttctccgagggatgagggtggggggtgtgggaagggtaccacagatcaggccggggcagctgtaggggcgggggcccagacagccaggccgccaccagagcagccccatggggtgccccagacgcgggcctccaagaagccaagtcccagtctgttttctggcatcagacaccggcccgtgttccttgtcagacagacagactctcaggcctgcctggggagtcgtgtccctcagctgcagggcactgtgttgggaaaccattggctgggcctttgaggacacagatcagaagaaagaaagacaactttcctctgcgcggaacactcacacggaagggctggccgcctccctgagccggctgggagtggacgacaggacctacctccccagagcaagggcctggggcttcccgccaaagctgccgcggaaccccgctagtgcgaccaccctccctccgtcggtatgtcctgctttccagctgaacccaaactacaagtgggtttaaaaaaataaacaccaccacc

SEQ ID NO: 4913 - DNA, 1947 bp, Homo sapiens
atggggagactgccttgcgggccactgccaggccagtggacagcggactgcagcgaaccgctggacagcagctgttccttctcccgagggcgagcccccccacagcagaatggcagcaaagacaactctctggacatgctgggcacggacatctgggcggccaacaccttcgattccttcagtggtgccacctgggacctgcagccggaaaagctggacttcacccagttccaccgcaaagtccgacacacgcccaagcagcccctgccacacatcgaccgcgaagggtgtggcaaagggaagctggaagatggggatggcatcaacctgaatgacatcgagaaggtccttccagcctggcagggctaccacccgatgccccatgaagtggagatcgcacacaccaagaagctgttccgcaggaggagaaatgatcgaaggcggcagcagagacctccggggggcaacaagccccaacagcatggtgaccaccagccaggcagtgccaaacacaacagggaccaccagaaatcctaccaggggggctcagcaccccacccctcagggaggcccactcaccatggctacagccagaaccggcgctggcaccatggcaacatgaagcacccaccaggcgacaagggggaggcaggcgcacaccgcaatgccaaagagaccatgaccatcgagaacccaaaactggaggacactgcaggggacaccgggcacagcagccttgaggccccccgcagccctgacaccctggccccggtggcttctgagcggctgcccccacagcagtcaggggggccagaggttgagacaaaacgtaaagacagtattcttcccgagcgcatcggggagcggcccaaaattaccctgctccagtcttccaaagacagactgcggcgaaggctaaaggaaaaggatgaagtggccgtggagacgaccactccccagcagaacaagatggacaagctgatcgagatcctgaacagcatgcggaacaacagcagcgacgtggacaccaagctcaccaccttcatggaggaggcccagaactccaccaactccgaggagatgctgggcgagatcgtgcgcacaatctaccagaaggctgtgtccgaccgcagcttcgccttcaccgctgccaagctctgcgacaagatggcgctctttatggtggaggggaccaagttccggagcctgctcctcaacatgctgcagaaggacttcacggtgcgcgaggagctgcagcagcaggacgtggagcgctggctgggcttcatcaccttcctgtgcgaggtcttcggcaccatgcgcagcagcacaggcgagcccttccgtgtgctcgtgtgccccatctacacctgcctcagggagctcttgcaatctcaggatgtgaaggaagatgctgtcctttgctgctctatggagctgcagagtacaggccggctgctggaggaacagctgcctgagatgatgacagagctcctggccagcgcacgggacaagatgctgtgcccctcggagtccatgctgacccggtcgctgctcctagaggtcatcgagctccacgctaacagctggaaccagggggcctggcaggcggcccacgggcagctggggccctggtgcacagggccagatggacaggcgggaggacaggggtggccctggcgggagaaagaaatggggaggagggcaggcagagtcggtggccagtctggagcccgagcatgcaagctcacaccaataagggaagcatgtttctttttcctggtggccctggccctccccttcctcactcccgcctctcccctccccatcagacccatcccccacggagctttgtgtgagggatctcatcgctgtgactcctcggagaccttggcagcctcgcacgccggggcaccgcttgggtcagaaaggacctcggaaggctga

SEQ ID NO: 4914 - DNA, 2631 bp, Homo sapiens
tataaaagctgggccggcgcgggccgggccattcgcgacccggaggtgcgcgggcgcgggcgagcagggtctccgggtgggcggcggcgacgccccgcgcaggctggaggccgccgaggctcgccatgccgggagaactctaactcccccatggagtcggccgacttctacgaggcggagccgcggcccccgatgagcagccacctgcagagccccccgcacgcgcccagcagcgccgccttcggctttccccggggcgcgggccccgcgcagcctcccgccccacctgccgccccggagccgctgggcggcatctgcgagcacgagacgtccatcgacatcagcgcctacatcgacccggccgccttcaacgacgagttcctggccgacctgttccagcacagccggcagcaggagaaggccaaggcggccgtgggccccacgggcggcggcggcggcggcgactttgactacccgggcgcgcccgcgggccccggcggcgccgtcatgcccgggggagcgcacgggcccccgcccggctacggctgcgcggccgccggctacctggacggcaggctggagcccctgtacgagcgcgtcggggcgccggcgctgcggccgctggtgatcaagcaggagccccgcgaggaggatgaagccaagcagctggcgctggccggcctcttcccttaccagccgccgccgccgccgccgccctcgcacccgcacccgcacccgccgcccgcgcacctggccgccccgcacctgcagttccagatcgcgcactgcggccagaccaccatgcacctgcagcccggtcaccccacgccgccgcccacgcccgtgcccagcccgcaccccgcgcccgcgctcggtgccgccggcctgccgggccctggcagcgcgctcaaggggctgggcgccgcgcaccccgacctccgcgcgagtggcggcagcggcgcgggcaaggccaagaagtcggtggacaagaacagcaacgagtaccgggtgcggcgcgagcgcaacaacatcgcggtgcgcaagagccgcgacaaggccaagcagcgcaacgtggagacgcagcagaaggtgctggagctgaccagtgacaatgaccgcctgcgcaagcgggtggaacagctgagccgcgaactggacacgctgcggggcatcttccgccagctgccagagagctccttggtcaaggccatgggcaactgcgcgtgaggcgcgcggctgtgggaccgccctgggccagcctccggcggggacccagggagtggtttggggtcgccggatctcgaggcttgcccgagccgtgcgagccaggactaggagattccggtgcctcctgaaagcctggcctgctccgcgtgtcccctcccttcctctgcgccggacttggtgcgtctaagatgagggggccaggcggtggcttctccctgcgaggaggggagaattcttggggctgagctgggagcccggcaactctagtatttaggataaccttgtgccttggaaatgcaaactcaccgctccaatgcctactgagtagggggagcaaatcgtgccttgtcattttatttggaggtttcctgcctccttcccgaggctacagcagacccccatgagagaaggaggggagcaggcccgtggcaggaggagggctcagggagctgagatcccgacaagcccgccagccccagccgctcctccacgcctgtccttagaaaggggtggaaacatagggacttggggcttggaacctaaggttgttcccctagttctacatgaaggtggagggtctctagttccacgcctctcccacctccctccgcacacaccccaccccagcctgctataggctgggcttccccttggggcggaactcactgcgatgggggtcaccaggtgaccagtgggagcccccaccccgagtcacaccagaaagctaggtcgtgggtcagctctgaggatgtatacccctggtgggagagggagacctagagatctggctgtggggcgggcatggggggtgaagggccactgggaccctcagccttgtttgtactgtatgccttcagcattgcctaggaacacgaagcacgatcagtccatcccagagggaccggagttatgacaagctttccaaatattttgctttatcagccgatatcaacacttgtatctggcctctgtgccccagcagtgccttgtgcaatgtgaatgtgcgcgtctctgctaaaccaccattttatttggtttttgttttgttttggttttgctcggatacttgccaaaatgagactctccgtcggcagctgggggaagggtctgagactccctttccttttggttttgggattacttttgatcctgggggaccaatgaggtgaggggggttctcctttgccctcagctttccccagcccctccggcctgggctgcccacaaggcttgtcccccagaggccctggctcctggtcgggaagggaggtggcctcccgccaacgcatcactggggctgggagcagggaaggacggcttggttctcttcttttggggagaacgtagagtctcactctagatgttttatgtattatatctataatataaacatatcaaagtcaa

SEQ ID NO: 4915 - DNA, 2178 bp, Homo sapiens
gatgccgccacacgatggcactgcttccgtagacctggaagaaacgcgggcgcgggagctggcggcggacgcccgggtctgcggggtcggggagtagcgtccggccggagagcccgcacctcgaggagccggcggaggacgcggtgtcgtgaccgcgtctcccccatctgctctgcttttggcgacagcgtcccgtcggcctttcggccaggacgcagcagccgcgtctctgggcctcgacccccagggccggccggacccgggacctccgaggagagcagcgagaaccggcccggattccccgaggcgcccgagtgcggtgcgggcagccctccccgcctgccaggccgccgctgtccccacgtctggtcccccacgcctcttcccgcatctggtcccacggtggaggcgcggggcgagggcctcacgcgcgtgcccacggtcggggggcgtccttggacgcgcgggtcctctcccacgggtctccaccccccgccctccggcgacaggagccggcctgggacgcgcgcgctgcggccaagtcctggttttgatttcactcccaaccccgaggagcgaggaggttccaagcccacaaacaggaagaagagaaggccctggagtgctggcagagggagtgtcattcccagcagcgcagcgcaggccggcccgggccggggagggagcagcagcgcgggcaccctcctgcaacgtgggctgggggtccccagggccggggagggggccccggggaggaactgagagggggcgcgccccgggaaggctcggggcggctccggggggctcccagggcgcccccgccccttcccccgcggccccggggcgcccccgcggtgccggagtcggggcggggcgtgcacgtcagccggggctagaaaaggcggcggggctgggcccagcgaggtgacagcctcgcttggacgcagagcccggcccgacgccgccatgagcgccgcgctcttcagcctggacggcccggcgcgcggcgcgccctggcctgcggagcctgcgcccttctacgaaccgggccgggcgggcaagccgggccgcggggccgagccaggggccctaggcgagccaggcgccgccgcccccgccatgtacgacgacgagagcgccatcgacttcagcgcctacatcgactccatggccgccgtgcccaccctggagctgtgccacgacgagctcttcgccgacctcttcaacagcaatcacaaggcgggcggcgcggggcccctggagcttcttcccggcggccccgcgcgccccttgggcccgggccctgccgctccccgcctgctcaagcgcgagcccgactggggcgacggcgacgcgcccggctcgctgttgcccgcgcaggtggccgcgtgcgcacagaccgtggtgagcttggcggccgcagggcagcccaccccgcccacgtcgccggagccgccgcgcagcagccccaggcagacccccgcgcccggccccgcccgggagaagagcgccggcaagaggggcccggaccgcggcagccccgagtaccggcagcggcgcgagcgcaacaacatcgccgtgcgcaagagccgcgacaaggccaagcggcgcaaccaggagatgcagcagaagttggtggagctgtcggctgagaacgagaagctgcaccagcgcgtggagcagctcacgcgggacctggccggcctccggcagttcttcaagcagctgcccagcccgcccttcctgccggccgccgggacagcagactgccggtaacgcgcggccggggcgggagagactcagcaacgacccatacctcagacccgacggcccggagcggagcgcgccctgccctggcgcagccagagccgccgggtgcccgctgcagtttcttgggacataggagcgcaaagaagctacagcctggacttaccaccactaaactgcgagagaagctaaacgtgtttattttcccttaaattatttttgtaatggtagctttttctacatcttactcctgttgatgcagctaaggtacatttgtaaaaagaaaaaaaaccagacttttcagacaaaccctttgtattgtagataagaggaaaagactgagcatgctcacttttttatattaatttttacagtatttgtaagaataaagcagcatttgaaatcgcccct

SEQ ID NO: 4916 - DNA, 1462 bp, Homo sapiens
gggccggggagggagcagcagcgcgggcaccctcctgcaacgtgggctgggggtccccagggccggggagggggccccggggaggaactgagagggggcgcgccccgggaaggctcggggcggctccggggggctcccagggcgcccccgccccttcccccgcggccccggggcgcccccgcggtgccggagtcggggcggggcgtgcacgtcagccggggctagaaaaggcggcggggctgggcccagcgaggtgacagcctcgcttggacgcagagcccggcccgacgccgccatgagcgccgcgctcttcagcctggacggcccggcgcgcggcgcgccctggcctgcggagcctgcgcccttctacgaaccgggccgggcgggcaagccgggccgcggggccgagccaggggccctaggcgagccaggcgccgccgcccccgccatgtacgacgacgagagcgccatcgacttcagcgcctacatcgactccatggccgccgtgcccaccctggagctgtgccacgacgagctcttcgccgacctcttcaacagcaatcacaaggcgcgcgccccttgggcccgggccctgccgctccccgcctgctcaagcgcgagcccgactggggcgacggcgacgcgcccggctcgctgttgcccgcgcaggtggccgcgtgcgcacagaccgtggtgagcttggcggccgcagggcagcccaccccgcccacgtcgccggagccgccgcgcagcagccccaggcagacccccgcgcccggccccgcccgggagaagagcgccggcaagaggggcccggaccgcggcagccccgagtaccggcagcggcgcgagcgcaacaacatcgccgtgcgcaagagccgcgacaaggccaagcggcgcaaccaggagatgcagcagaagttggtggagctgtcggctgagaacgagaagctgcaccagcgcgtggagcagctcacgcgggacctggccggcctccggcagttcttcaagcagctgcccagcccgcccttcctgccggccgccgggacagcagactgccggtaacgcgcggccggggcgggagagactcagcaacgacccatacctcagacccgacggcccggagcggagcgcgccctgccctggcgcagccagagccgccgggtgcccgctgcagtttcttgggacataggagcgcaaagaagctacagcctggacttaccaccactaaactgcgagagaagctaaacgtgtttattttcccttaaattatttttgtaatggtagctttttctacatcttactcctgttgatgcagctaaggtacatttgtaaaaagaaaaaaaaccagacttttcagacaaaccctttgtattgtagataagaggaaaagactgagcatgctcacttttttatattaatttttacagtatttgtaagaataaagcagcatttgaaatcg

SEQ ID NO: 4917 - DNA, 1554 bp, Homo sapiens
ggaacctcattctgcatagaactttttcaaagtcggagggaggaggttgctcagagtggggtgttgccctctgcgaggatttggagtcccctggcctcccagcagggagtggagaggcattcccagaagcatcagcttcgggcatctccagaaccctggcttggtccctgaccaaggagtgtccccaactgctgaataggccaggagtcgcctttctctaaggcttacatctctccctctggggtgtgtcctgcccctccctgagtcaccccaaggggagagaggggaaaaaagggaagagaagagaggcattgactacagaggaaggaaaaggaagcagagcagaggggggagagaggccacacaggagtgggtgacagaggagactgcagagggcaggtctagggcagaagatcgagagagggcaggcccaggtcaggaggaggtagagagagggcagccggagcaccccaaggggtgcctcaagagcaggtgggggcggggagccgagggggcgggccggccatgtcccacgggacctactacgagtgtgagccccggggtggccagcagccactcgagttctcagggggccgagctgggcccggggagctaggggacatgtgtgagcatgaggcctccattgacctctccgcctacatcgagtctggggaagagcagcttctctccgatctctttgccgtgaagccagcgcctgaggccagaggcctcaagggccccggaacccctgccttcccccactacttgccgcctgaccctcggccctttgcctaccctccacataccttcggcccagacaggaaggcgctggggcctggcatctacagcagcccagggagctacgaccccagggctgtggcggtgaaggaggagccccgggggccagagggcagccgagctgccagccgaggcagctacaatcccctgcagtaccaagtggcacactgtgggcagacagccatgcacctgcccccaactctggcagcacccggccagcctctgcgcgttctcaaggcccctttggccactgccgcacccccctgcagtcccctcctgaaggcgccctccccggctggccccttacacaagggcaagaaggcagtgaacaaagatagccttgagtaccggctgaggcgggagcgcaacaacatcgccgtgcgcaagagccgagacaaggccaagaggcgcattctggagacgcagcagaaggtgctggagtacatggcagagaacgagcgcctccgcagccgcgtggagcagctcacccaggagctagacaccctccgcaacctcttccgccagattcctgaggcggccaacctcatcaagggcgtggggggttgcagctgaggctggctggtggattgtgggcaccaggctccctggcacggcctaactctgcggacccccatcctgctgggggcctagaaccctgagacatagaccatggataaatggcaaccggggtggcaaagagggcaggacccagcataatgattatatggctgaataaagttgcactgtgactgggtg

SEQ ID NO: 4918 - DNA, 3463 bp, Homo sapiens
acactcatgctgaaattcgcaggctagctcgctccgccaggagctggggcttagaccatttccgggagaagacacgccccgacaggaattacgccactggcagagcggaaataggctgagtttcacgcgcgtatgctttgcccgccatggccgcagtcaaggagcctttggagttccatgccaagcggccttggcgccccgaggaggcagtagaagatccggacgaggaggatgaggataatactagtgaagccgagaatgggttctccctggaggaagtgttacggctcggaggcaccaagcaagattaccttatgctggctactttggatgagaatgaggaagtgatagatggaggcaaaaaaggagcaatcgatgaccttcagcaaggtgaattggaagcatttattcaaaatcttaatttggcgaagtatacaaaagcttccttagttgaagaagatgaaccagctgaaaaagaaaattccagcaaaaaagaagtaaaaatacctaaaataaataataaaaatacagcagaaagtcaaaggacatcagttaataaggtgaaaaataagaataggccagaaccacattctgatgagaatggcagtaccacaccgaaagtaaagaaagataaacagaacatctttgaattttttgagagacagactttgttacttaggcctggaggcaaatggtatgatctggagtacagcaatgaatattctttgaaaccccagcctcaggatgttgtatctaagtacaaaacccttgctcagaagctgtatcagcatgaaatcaacttattcaaaagtaagacgaatagtcaaaagggagcctcttctacctggatgaaggcaattgtgtcatcggggacactaggtgacaggatggcagccatgattcttcttattcaggatgatgccgttcacacacttcagtttgtagaaactcttgtgaaccttgttaaaaagaagggcagcaaacagcagtgccttatggccttggatactttcaaagagttgcttatcacagaccttttgccagacaatcggaagctgaggattttcagccagcgtccttttgacaaactggaacagttgtccagtggcaacaaggactcaagagatagaagactgatattatggtattttgaacaccagctgaaacacttagtggctgaatttgtgcaggtcttagaaactttaagtcatgatacattagtaaccactaaaactcgagcccttaccgtggctcatgagctgctttgtaacaagcctgaggaagaaaaggctcttcttgtgcaagtggtaaataaactgggagatcctcagaacagaattgccacaaaagcatcccatctgttagagacattactttgtaaacatcccaatatgaaaggagttgtgtctggtgaagtagaaaggctactcttccgctcaaatatcagctccaaagctcaatattatgcaatttgctttttaaatcaaatggctctgtcccatgaagaaagtgaattggctaacaaattaataactgtttacttttgcttttttcggacttgtgtcaaaaaaaaagatgttgaatcaaaaatgcttagcgcccttttaacaggtgtgaatagggcatacccttattcccagactggtgatgacaaagtaagggagcagattgacacactgtttaaagtgttgcatattgtgaattttaataccagtgtccaggctttaatgttgcttttccaagtaatgaattctcagcagacaatatcggatcgatattacacagcattatacaggaagatgttggatccagggttgatgacgtgttccaagcaagctatgtttcttaaccttgtctacaaatctctgaaagctgacattgtgttgcgccgggtgaaggcttttgtgaagaggttacttcaagttacttgtcaacagatgccaccatttatatgtggagctttatatcttgtgtctgagatccttaaagcaaaaccaggtttaagaagccaactagatgatcatccggagtctgatgatgaagaaaattttattgatgcaaatgatgatgaagacatggaaaaattcactgatgcagacaaagaaacagagatagtgaaaaaacttgagacagaggaaacagttcctgaaactgatgtagaaaccaaaaaaccagaggttgcttcctgggtgcactttgataatttgaaaggtgggaaacagttaaataaatacgatccattcagtagaaaccctctgttctgtggagctgaaaatacaagtctttgggaactcaaaaagttatctgtgcattttcatccctccgtggccctttttgcaaagaccatccttcagggaaactatattcagtattcaggggacccactgcaggatttcactctaatgagatttttggatcgatttgtataccgaaatccaaagccccataaaggcaaagaaaacacagatagtgttgtgatgcagccgaaaagaaaacattttattaaggatattcgtcatcttcctgtgaacagtaaggagttccttgcaaaagaagaaagccaaataccagtggatgaagtgtttttccacaggtattataaaaaagttgctgttaaagagaaacaaaaacgggatgcagatgaagaaagtatagaagacgtggatgatgaagaatttgaagagctgattgacacatttgaagatgataactgtttcagctctggaaaggatgatatggattttgctggaaacgtgaaaaagagaacaaaaggagctaaggataacacattagatgaagattcagaaggtagtgatgatgaacttggtaacctggatgacgatgaagtttctttaggaagtatggatgatgaagaatttgctgaagttgatgaagatggaggaacattcatggatgtgttagatgatgaaagtgagagcgttccagaacttgaagtccactccaaagtcagtactaagaaaagcaagagaaaaggtacagatgattttgactttgctggctcatttcaagggccaagaaaaaagaaaagaaacttaaatgattccagcctatttgtatctgctgaagagtttggccatctattggatgaaaatatgggatccaagtttgataacattggcatgaatgccatggctaacaaagataatgcaagtctcaaacagcttagatgggaggctgaacgtgatgactggctacacaacagagatgcaaaaagtatcatcaagaaaaagaaacattttaaaaagaagaggattaaaaccactcaaaaaactaaaaaacaaaggaaatgagttattaatgtaaattatagattaaaattctacttacatctaatttttgctgttcaaccatgttttttgatctagctctctgattccatacattccagacttctcagtggatttgtaataaactataaataaaaatagctctcatttataaa

SEQ ID NO: 4919 - DNA, 3026 bp, Homo sapiens
gagtttcacgcgcgtatgctttgcccgccatggccgcagtcaaggagcctttggagttccatgccaagcggccttggcgccccgaggaggcagtagaagatccggacgaggaggatgaggataatactagtgaagccgagaatgggttctccctggaggaagtgttacggctcggaggcaccaagcaagattaccttatgctggctactttggatgagaatgaggaagtgatagatggaggcaaaaaaggagcaatcgatgaccttcagcaaggtgaattggaagcatttattcaaaatcttaatttggcgaagtatacaaaagcttccttagttgaagaagatgaaccagctgaaaaagaaaattccagcaaaaaagaagtaaaaatacctaaaataaataataaaaatacagcagaaagtcaaaggacatcagttaataaggtgaaaaataagaataggccagaaccacattctgatgagaatggcagtaccacaccgaaagtaaagaaagataaacagaacatctttgaattttttgagagacagactttgttacttaggcctggaggcaaatggtatgatctggagtacagcaatgaatattctttgaaaccccagcctcaggatgttgtatctaagtacaaaacccttgctcagaagctgtatcagcatgaaatcaacttattcaaaagtaagacgaatagtcaaaagggagcctcttctacctggatgaaggcaattgtgtcatcggggacactaggtgacaggatggcagccatgattcttcttattcaggatgatgccgttcacacacttcagtttgtagaaactcttgtgaaccttgttaaaaagaagggcagcaaacagcagtgccttatggccttggatactttcaaagagttgcttatcacagaccttttgccagacaatcggaagctgaggattttcagccagcgtccttttgacaaactggaacagttgtccagtggcaacaaggactcaagagatagaagactgatattatggtattttgaacaccagctgaaacacttagtggctgaatttgtgcaggtcttagaaactttaagtcatgatacattagtaaccactaaaactcgagcccttaccgtggctcatgagctgctttgtaacaagcctgaggaagaaaaggctcttcttgtgcaagtggtaaataaactgggagatcctcagaacagaattgccacaaaagcatcccatctgttagagacattactttgtaaacatcccaatatgaaaggagttgtgtctggtgaagtagaaaggctactcttccgctcaaatatcagctccaaagctcaatattatgcaatttgctttttaaatcaaatggctctgtcccatgaagaaagtgaattggctaacaaattaataactgtttacttttgcttttttcggacttgtgtcaaaaaaaaagatgttgaatcaaaaatgcttagcgcccttttaacaggtgtgaatagggcatacccttattcccagactggtgatgacaaagtaagggagcagattgacacactgtttaaagtgttgcatattgtgaattttaataccagtgtccaggctttaatgttgcttttccaagtaatgaattctcagcagacaatatcggatcgatattacacagcattatacaggaagatgttggatccagggttgatgacgtgttccaagcaagctatgtttcttaaccttgtctacaaatctctgaaagctgacattgtgttgcgccgggtgaaggcttttgtgaagaggttacttcaagttacttgtcaacagatgccaccatttatatgtggagctttatatcttgtgtctgagatccttaaagcaaaaccaggtttaagaagccaactagatgatcatccggagtctgatgatgaagaaaattttattgatgcaaatgatgatgaagacatggaaaaattcactgatgcagacaaagaaacagagatagtgaaaaaacttgagacagaggaaacagttcctgaaactgatgtagaaaccaaaaaaccagaggttgcttcctgggtgcactttgataatttgaaaggtgggaaacagttaaataaatacgatccattcagtagaaaccctctgttctgtggagctgaaaatacaagtctttgggaactcaaaaagttatctgtgcattttcatccctccgtggccctttttgcaaagaccatccttcagggaaactatattcagtattcaggggacccactgcaggatttcactctaatgagatttttggatcgatttgtataccgaaatccaaagccccataaaggcaaagaaaacacagatagtgttgtgatgcagccgaaaagaaaacattttattaaggatattcgtcatcttcctgtgaacagtaaggagttccttgcaaaagaagaaagccaaataccagtggatgaagtgtttttccacaggtattataaaaaagttgctgttaaagagaaacaaaaacgggatgcagatgaagaaagtatagaagacgtggatgatgaagaatttgaagagctgattgacacatttgaagatgataactgtttcagctctggaaaggatgatatggattttgctggaaacgtgaaaaagagaacaaaaggagctaaggataacacattagatgaagattcagaaggtagtgatgatgaacttggtaacctggatgacgatgaagtttctttaggaagtatggatgatgaagaatttgctgaagttgatgaagatggaggaacattcatggatgtgttagatgatgaaagtgagagcgttccagaacttgaagtccactccaaagtcagtactaagaaaagcaagagaaaaggtacagatgattttgactttgctggctcatttcaagggccaagaaaaaagaaaagaaacttaaatgattccagcctatttgtatctgctgaagagtttggccatctattggatgaaaatatgggatccaagtttgataacattgcatga

SEQ ID NO: 4920 - DNA, 3567 bp, Homo sapiens
aaccctgcctggctccgcccccttcacgccccctcttttccgctccgcgcctgcgcactgccaccctccactctcgcgccagcccggcggcggccggctgtgggctgcagcacgcggtgcacgaggcagagcccacaagccaaagacggagtgggccgagcattccggccacgccttccgcggccaagtcattatggcagccactgagatctctgtcctttctgagcaattcaccaagatcaaagaactcgagttgatgccggaaaaaggcctgaaggaggaggaaaaagacggagtgtgcagagagaaagaccatcggagccctagtgagttggaggccgagcgtacctctggggccttccaggacagcgtcctggaggaagaagtggagctggtgctggccccctcggaggagagcgagaagtacatcctgaccctgcagacggtgcacttcacttctgaagctgtggagttgcaggatatgagcttgctgagcatacagcagcaagaaggggtgcaggtggtggtgcaacagcctggccctgggttgctgtggcttgaggaagggccccggcagagcctgcagcagtgtgtggccattagtatccagcaagagctgtactccccgcaagagatggaggtgttgcagttccacgctctagaggagaatgtgatggtggccagtgaagacagtaagttagcggtgagcctggctgaaactactggactgatcaagctcgaggaagagcaggagaagaaccagttattggctgaaagaacaaaggagcagctcttttttgtggaaacaatgtcaggagatgaaagaagtgacgaaattgttctcacagtttcaaattcaaatgtggaagaacaagaggatcaacctacagctggtcaagcagatgctgaaaaggccaaatctacaaaaaatcaaagaaagacaaagggagcaaaaggaaccttccactgtgatgtctgcatgttcacctcttctagaatgtcaagttttaatcgtcatatgaaaactcacaccagtgagaagcctcacctgtgtcacctctgcctgaaaaccttccgtacggtcactctgctgcggaaccatgttaacacccacacaggaaccaggccctacaagtgtaacgactgcaacatggcatttgtcaccagtggagaactcgtccgacacaggcgctataaacatactcatgagaaaccctttaaatgttccatgtgcaagtatgccagtgtggaggcaagtaaattgaagcgccatgtccgatcccacactggggagcgcccctttcagtgttgccagtgcagctatgccagcagagatacctacaagctgaaacgccacatgagaacgcactcaggtgagaagccttacgaatgccacatctgccacacccgcttcacccagagcgggaccatgaaaatacatattctgcagaaacacggcgaaaatgtccccaaataccagtgtccccattgtgccaccatcattgcacggaaaagcgacctacgtgtgcatatgcgcaacttgcatgcttacagcgctgcagagctgaaatgccgctactgttctgctgtcttccatgaacgctatgccctcattcagcaccagaaaactcataagaatgagaagaggttcaagtgcaaacactgcagttatgcctgcaagcaggaacgtcatatgaccgctcacattcgtacccacactggagagaaaccattcacctgcctttcttgcaataaatgtttccgacagaagcaacttctaaacgctcacttcaggaaataccacgatgcaaatttcatcccgactgtttacaaatgctccaagtgtggcaaaggcttttcccgctggattaacctgcacagacattcggagaagtgtggatcaggggaagcaaagtcggctgcttcaggaaagggaagaagaacaagaaagaggaagcagaccatcctgaaggaagccacaaagggtcagaaggaagctgcgaagggatggaaggaagccgcgaacggagacgaagctgctgctgaggaggcttccaccacgaagggagaacagttcccaggagagatgtttcctgtcgcctgcagagaaaccacagccagagtcaaagaggaagtggatgaaggcgtgacctgtgaaatgctcctcaacacgatggataagtgagagggattcgggttgcgtgttcactgcccccaattcctaaagcaagttagaagtttttagcatttaaggtgtgaaatgctcctcaacacgatggataagtgagagagagtcaggttgcatgttcactgcccctaattcctaaagcaagttagaaatttttagcattttctttgaaacaattaagttcatgacaatggatgacacaagtttgaggtagtgtctagaattgttctcctgtttgtagctggatatttcaaagaaacattgcaggtattttataaaagttttaaaccttgaatgagagggtaacacctcaaacctatggattcattcacttgatattggcaaggtggcccacaatgagtgagtagtgatttttggatatttcaaaatagtctagaccagctagtgcttccacagtcaaagctggacatttttatgttgcattatatacacccatgatatttctaataatatatggttttaaacattaaagacaaatgtttttatacaaatgaattttctacaaaatttaaagctaccataatgcttttaattagttctaaattcaaccaaaaaatgttttactcttataaaaaggaaaactgagtaggaaatgaaatactagattagactagaaaataaggaataaatcgattttactttggtataggagcaaggttcacctttagatttttgtattctcttttaattatgctccttggcaggtatgaaattgccctggttacattccattattgcttattagtatttcactccataacccttttttctgctaaaactactctttttatatttgtaaaataattggcagagtgagaagaaacataaaatcagataaggcaaatgtgtacctgtaaggaatttgtactttttcataatgcccagtgattagtgagtatttcccttttgccagttgacaagatttttccaccctcgagcagcgtgagagatgcctctttaacacttgaaattcatttctatctggatacagaggcagatttttcttcattgcttagttgagcagtttgttttgctgccaacctgtctccacccctgtatttcaagatcattgataagccctaaattcaaattcttaagatatggaccttttattgaaaatatcacaagttcagaatccctatacaatgtgaatatgtggaaataatttcccagcaggaagagcattatattctctttgtaccagcaaattaatttaactcaactcacatgagatttaaattctgtgggctgtagtatgccatcattgtgactgaatttgtgcaatggtttcttaatttttttactgttatttaaagatgttttacataattcaataaaatgaaatgacttaaaattgc

SEQ ID NO: 4921 - DNA, 3491 bp, Homo sapiens
tctcccaggccccctgcaggccctcgtgccctccttacttcccccccgggtctcccagcgccccctgcggggccctcctcccttcctcatccacttcaaccccaaggccaagtcattatggcagccactgagatctctgtcctttctgagcaattcaccaagatcaaagaactcgagttgatgccggaaaaaggcctgaaggaggaggaaaaagacggagtgtgcagagagaaagaccatcggagccctagtgagttggaggccgagcgtacctctggggccttccaggacagcgtcctggaggaagaagtggagctggtgctggccccctcggaggagagcgagaagtacatcctgaccctgcagacggtgcacttcacttctgaagctgtggagttgcaggatatgagcttgctgagcatacagcagcaagaaggggtgcaggtggtggtgcaacagcctggccctgggttgctgtggcttgaggaagggccccggcagagcctgcagcagtgtgtggccattagtatccagcaagagctgtactccccgcaagagatggaggtgttgcagttccacgctctagaggagaatgtgatggtggccagtgaagacagtaagttagcggtgagcctggctgaaactactggactgatcaagctcgaggaagagcaggagaagaaccagttattggctgaaagaacaaaggagcagctcttttttgtggaaacaatgtcaggagatgaaagaagtgacgaaattgttctcacagtttcaaattcaaatgtggaagaacaagaggatcaacctacagctggtcaagcagatgctgaaaaggccaaatctacaaaaaatcaaagaaagacaaagggagcaaaaggaaccttccactgtgatgtctgcatgttcacctcttctagaatgtcaagttttaatcgtcatatgaaaactcacaccagtgagaagcctcacctgtgtcacctctgcctgaaaaccttccgtacggtcactctgctgcggaaccatgttaacacccacacaggaaccaggccctacaagtgtaacgactgcaacatggcatttgtcaccagtggagaactcgtccgacacaggcgctataaacatactcatgagaaaccctttaaatgttccatgtgcaagtatgccagtgtggaggcaagtaaattgaagcgccatgtccgatcccacactggggagcgcccctttcagtgttgccagtgcagctatgccagcagagatacctacaagctgaaacgccacatgagaacgcactcaggtgagaagccttacgaatgccacatctgccacacccgcttcacccagagcgggaccatgaaaatacatattctgcagaaacacggcgaaaatgtccccaaataccagtgtccccattgtgccaccatcattgcacggaaaagcgacctacgtgtgcatatgcgcaacttgcatgcttacagcgctgcagagctgaaatgccgctactgttctgctgtcttccatgaacgctatgccctcattcagcaccagaaaactcataagaatgagaagaggttcaagtgcaaacactgcagttatgcctgcaagcaggaacgtcatatgaccgctcacattcgtacccacactggagagaaaccattcacctgcctttcttgcaataaatgtttccgacagaagcaacttctaaacgctcacttcaggaaataccacgatgcaaatttcatcccgactgtttacaaatgctccaagtgtggcaaaggcttttcccgctggattaacctgcacagacattcggagaagtgtggatcaggggaagcaaagtcggctgcttcaggaaagggaagaagaacaagaaagaggaagcagaccatcctgaaggaagccacaaagggtcagaaggaagctgcgaagggatggaaggaagccgcgaacggagacgaagctgctgctgaggaggcttccaccacgaagggagaacagttcccaggagagatgtttcctgtcgcctgcagagaaaccacagccagagtcaaagaggaagtggatgaaggcgtgacctgtgaaatgctcctcaacacgatggataagtgagagggattcgggttgcgtgttcactgcccccaattcctaaagcaagttagaagtttttagcatttaaggtgtgaaatgctcctcaacacgatggataagtgagagagagtcaggttgcatgttcactgcccctaattcctaaagcaagttagaaatttttagcattttctttgaaacaattaagttcatgacaatggatgacacaagtttgaggtagtgtctagaattgttctcctgtttgtagctggatatttcaaagaaacattgcaggtattttataaaagttttaaaccttgaatgagagggtaacacctcaaacctatggattcattcacttgatattggcaaggtggcccacaatgagtgagtagtgatttttggatatttcaaaatagtctagaccagctagtgcttccacagtcaaagctggacatttttatgttgcattatatacacccatgatatttctaataatatatggttttaaacattaaagacaaatgtttttatacaaatgaattttctacaaaatttaaagctaccataatgcttttaattagttctaaattcaaccaaaaaatgttttactcttataaaaaggaaaactgagtaggaaatgaaatactagattagactagaaaataaggaataaatcgattttactttggtataggagcaaggttcacctttagatttttgtattctcttttaattatgctccttggcaggtatgaaattgccctggttacattccattattgcttattagtatttcactccataacccttttttctgctaaaactactctttttatatttgtaaaataattggcagagtgagaagaaacataaaatcagataaggcaaatgtgtacctgtaaggaatttgtactttttcataatgcccagtgattagtgagtatttcccttttgccagttgacaagatttttccaccctcgagcagcgtgagagatgcctctttaacacttgaaattcatttctatctggatacagaggcagatttttcttcattgcttagttgagcagtttgttttgctgccaacctgtctccacccctgtatttcaagatcattgataagccctaaattcaaattcttaagatatggaccttttattgaaaatatcacaagttcagaatccctatacaatgtgaatatgtggaaataatttcccagcaggaagagcattatattctctttgtaccagcaaattaatttaactcaactcacatgagatttaaattctgtgggctgtagtatgccatcattgtgactgaatttgtgcaatggtttcttaatttttttactgttatttaaagatgttttacataattcaataaaatgaaatgacttaaaattgc

SEQ ID NO: 4922 - DNA, 2964 bp, Homo sapiens
agggtaaagcaggggccctgccaggcctccgagggagtgtgcttggtctggccgagggctgcttggccaagtctgggtgggctcgaggccactaggcccaaagcctgcctggctctgagggtgctaggtctagaaccgtgcacgaggggaatgcctgctcgggcccgaacctcgctgggcgccgggtgtgcactggcccggggcctgcttggacctgaaacttgctaggcccaggatatgcactggccgagagcctgctgggcccaaaccttactaggcccaggatgttcactgactgaaccggctcaggcctaaccttgctaggcccaggatatgcactgggccagagtgtgctcaggcggaaccttgccaggcgcaggatgtgtgctggccctaagcctgctgaggcccaaacctgttcgttctagggttttgtacaaaatcctgctttagcctaaatcctgcttagccttgaccccctcctagacccaagccagatcagcattgttctgaccctactaagtccaaaaccttttgaggccagaccttgtttcaactccaaagcctgctaggttccagcaccccccgcatccctcctcataccacccccttctcccccctatggaaaccgcttgcttatttttcaaacaggccaagtcattatggcagccactgagatctctgtcctttctgagcaattcaccaagatcaaagaactcgagttgatgccggaaaaaggcctgaaggaggaggaaaaagacggagtgtgcagagagaaagaccatcggagccctagtgagttggaggccgagcgtacctctggggccttccaggacagcgtcctggaggaagaagtggagctggtgctggccccctcggaggagagcgagaagtacatcctgaccctgcagacggtgcacttcacttctgaagctgtggagttgcaggatatgagcttgctgagcatacagcagcaagaaggggtgcaggtggtggtgcaacagcctggccctgggttgctgtggcttgaggaagggccccggcagagcctgcagcagtgtgtggccattagtatccagcaagagctgtactccccgcaagagatggaggtgttgcagttccacgctctagaggagaatgtgatggtggccagtgaagacagtaagttagcggtgagcctggctgaaactactggactgatcaagctcgaggaagagcaggagaagaaccagttattggctgaaagaacaaaggagcagctcttttttgtggaaacaatgtcaggagatgaaagaagtgacgaaattgttctcacagtttcaaattcaaatgtggaagaacaagaggatcaacctacagctggtcaagcagatgctgaaaaggccaaatctacaaaaaatcaaagaaagacaaagggagcaaaaggaaccttccactgtgatgtctgcatgttcacctcttctagaatgtcaagttttaatcgtcatatgaaaactcacaccagtgagaagcctcacctgtgtcacctctgcctgaaaaccttccgtacggtcactctgctgcggaaccatgttaacacccacacaggaaccaggccctacaagtgtaacgactgcaacatggcatttgtcaccagtggagaactcgtccgacacaggcgctataaacatactcatgagaaaccctttaaatgttccatgtgcaagtatgccagtgtggaggcaagtaaattgaagcgccatgtccgatcccacactggggagcgcccctttcagtgttgccagtgcagctatgccagcagagatacctacaagctgaaacgccacatgagaacgcactcagaagcaacttctaaacgctcacttcaggaaataccacgatgcaaatttcatcccgactgtttacaaatgctccaagtgtggcaaaggcttttcccgctggattaacctgcacagacattcggagaagtgtggatcaggggaagcaaagtcggctgcttcaggaaagggaagaagaacaagaaagaggaagcagaccatcctgaaggaagccacaaagggtcagaaggaagctgcgaagggatggaaggaagccgcgaacggagacggtgtgatctcagctcaccgcaacctctgcctcctgggttcaagtgattctcatgcctcagtctccggagctgggattacagatgcccgccaccacgcctggctaattgttctattatttttagtagagatggggttttaccatgtctctcactcctgacctcaagtgatctgcccgcctcggcctcccaaagtggtgggattacaggcatgagcccctgtgcctggcctgatggcaccagttttgtggatctcagtgtttcttttcatatccaagaactgggtcttcttgtctccctccatccaccaaaaaaaaaaaaaaaaaaatacttcaaggaagcatggacaaaaatatcctcagacaagttagaacatgagacagtcacgttcttcagtgtggcgctctgtggatgtttgggaaagtaatttggaaaatgagtagagcagggctccccaaccccccagccgtggacctgtgggctgttaggaactgggcctcccagcaggaggtgagcagtgggtgagggagtgaagctttgtattgacagccgctccccatcgggcgcatcaccgcctgagctccgcctcctgtcagatcagcggcagcgttagattctcatgagtgtgaaccctgttgtgaactctgcacgtgcaagggatctaggctgcacactccttacgagaatctaatgcccgacgatctgtcactgtctcccatcacccccagatgggactgtctagatgcaggaaaacaagcccagggctcccactgattctacattatggtgagctgtataattatttcattatatatcacaatgtaataataaaaataaagtacataagaaatgtaatgtgc

SEQ ID NO: 4923 - DNA, 2966 bp, Homo sapiens
attccacccctccccccagtatctcagtgcctcctgtgggccctcctcccctccttatccattccccctcagatctcccaggccccctgcaggccctcgtgccctccttacttcccccccgggtctcccagcgccccctgcggggccctcctcccttcctcatccacttcaaccccaaggccaagtcattatggcagccactgagatctctgtcctttctgagcaattcaccaagatcaaagaactcgagttgatgccggaaaaaggcctgaaggaggaggaaaaagacggagtgtgcagagagaaagaccatcggagccctagtgagttggaggccgagcgtacctctggggccttccaggacagcgtcctggaggaagaagtggagctggtgctggccccctcggaggagagcgagaagtacatcctgaccctgcagacggtgcacttcacttctgaagctgtggagttgcaggatatgagcttgctgagcatacagcagcaagaaggggtgcaggtggtggtgcaacagcctggccctgggttgctgtggcttgaggaagggccccggcagagcctgcagcagtgtgtggccattagtatccagcaagagctgtactccccgcaagagatggaggtgttgcagttccacgctctagaggagaatgtgatggtggccagtgaagacagtaagttagcggtgagcctggctgaaactactggactgatcaagctcgaggaagagcaggagaagaaccagttattggctgaaagaacaaaggagcagctcttttttgtggaaacaatgtcaggagatgaaagaagtgacgaaattgttctcacagtttcaaattcaaatgtggaagaacaagaggatcaacctacagctggtcaagcagatgctgaaaaggccaaatctacaaaaaatcaaagaaagacaaagggagcaaaaggaaccttccactgtgatgtctgcatgttcacctcttctagaatgtcaagttttaatcgtcatatgaaaactcacaccagtgagaagcctcacctgtgtcacctctgcctgaaaaccttccgtacggtcactctgctgcggaaccatgttaacacccacacaggaaccaggccctacaagtgtaacgactgcaacatggcatttgtcaccagtggagaactcgtccgacacaggcgctataaacatactcatgagaaaccctttaaatgttccatgtgcaagtatgccagtgtggaggcaagtaaattgaagcgccatgtccgatcccacactggggagcgcccctttcagtgttgccagtgcagctatgccagcagagatacctacaagctgaaacgccacatgagaacgcactcaggtgagaagccttacgaatgccacatctgccacacccgcttcacccagagcgggaccatgaaaatacatattctgcagaaacacggcgaaaatgtccccaaataccagtgtccccattgtgccaccatcattgcacggaaaagcgacctacgtgtgcatatgcgcaacttgcatgcttacagcgctgcagagctgaaatgccgctactgttctgctgtcttccatgaacgctatgccctcattcagcaccagaaaactcataagaatgagaagaggttcaagtgcaaacactgcagttatgcctgcaagcaggaacgtcatatgaccgctcacattcgtacccacactggagagaaaccattcacctgcctttcttgcaataaatgtttccgacagaagcaacttctaaacgctcacttcaggaaataccacgatgcaaatttcatcccgactgtttacaaatgctccaagtgtggcaaaggcttttcccgctggattacctcaaaatggagtggcttaaaaccacaaacatttatcacctgacagattctctgggttgggaactcggaagtggctgaactgggtggtcctggctcagggccactcctgaggctgcagtcaggatgtccgccagggctgcatcatccgaaggctggactggggccagaggatccacttccaggacagctccgccacacaactgctggcaccggcctcagttccttgctacagggacctctctgcagggctgcttgagtgtcctcctgactcagagcaagtgagagagtgcaagtaggaagccatggtgccttttgcagtctagtcctaaaagcggcacaacagccagctgtgggggctcacacctgtaatcccagtacttcgggaggccaaggcaggtggataacttgaggccaggagctcaagaccagcctggccaacatggtgaaaccctgtctctactttaaaaaaaaaaaaagaaaatagctaggcgtggtagtgcacgcttgtaatcccagctacttgggtggttgggacgggaggatcacttgaacccaggagacagaggttgcagtgagctgagattgtgccactggcctccagcctgggcgacagagcaagactctgtctcaaaaaaaaaaaaaaagtggcacattctagtcacaagaaatgaaccatgaagtcccacccacactcgagtggggaatgaagtttcttttgaaaggaacagcatcaaagaatttcaggacatttaaaaaccactgcacatggctagctagatccttggaccatgtaggcttcagcctaactttataaaagttttataaaagttgaatttcctgaagttgactatttttttaaaaatatttcttcttaaaacagtagtgtagttgtgtttttctgagtagcacagtgggatagttctggaatgtcaaccctattagtttaaaatttcaaataaaagctgtggcagtgctcccaaaacaccattgctcatgcaaaaattgtgaagagttaaaattaacgagtagaattctaaagagaaaaaaactgctctttggtgcaagaaataaaaatgtagagaaaagaacaagtctgc

SEQ ID NO: 4924 - DNA, 2479 bp, Homo sapiens
ggctgcagcacgcggtgcacgaggcagagcccacaagccaaagacggagtgggccgagcattccggccacgccttccgcggccaagtcattatggcagccactgagatctctgtcctttctgagcaattcaccaagatcaaagaactcgagttgatgccggaaaaaggcctgaaggaggaggaaaaagacggagtgtgcagagagaaagaccatcggagccctagtgagttggaggccgagcgtacctctggggccttccaggacagcgtcctggaggaagaagtggagctggtgctggccccctcggaggagagcgagaagtacatcctgaccctgcagacggtgcacttcacttctgaagctgtggagttgcaggatatgagcttgctgagcatacagcagcaagaaggggtgcaggtggtggtgcaacagcctggccctgggttgctgtggcttgaggaagggccccggcagagcctgcagcagtgtgtggccattagtatccagcaagagctgtactccccgcaagagatggaggtgttgcagttccacgctctagaggagaatgtgatggtggccagtgaagacagtaagttagcggtgagcctggctgaaactactggactgatcaagctcgaggaagagcaggagaagaaccagttattggctgaaagaacaaaggagcagctcttttttgtggaaacaatgtcaggagatgaaagaagtgacgaaattgttctcacagtttcaaattcaaatgtggaagaacaagaggatcaacctacagctggtcaagcagatgctgaaaaggccaaatctacaaaaaatcaaagaaagacaaagggagcaaaaggaaccttccactgtgatgtctgcatgttcacctcttctagaatgtcaagttttaatcgtcatatgaaaactcacaccagtgagaagcctcacctgtgtcacctctgcctgaaaaccttccgtacggtcactctgctgcggaaccatgttaacacccacacaggaaccaggccctacaagtgtaacgactgcaacatggcatttgtcaccagtggagaactcgtccgacacaggcgctataaacatactcatgagaaaccctttaaatgttccatgtgcaagtatgccagtgtggaggcaagtaaattgaagcgccatgtccgatcccacactggggagcgcccctttcagtgttgccagtgcagctatgccagcagagatacctacaagctgaaacgccacatgagaacgcactcaggtgagaagccttacgaatgccacatctgccacacccgcttcacccagagcgggaccatgaaaatacatattctgcagaaacacggcgaaaatgtccccaaataccagtgtccccattgtgccaccatcattgcacggaaaagcgacctacgtgtgcatatgcgcaacttgcatgcttacagcgctgcagagctgaaatgccgctactgttctgctgtcttccatgaacgctatgccctcattcagcaccagaaaactcataagaatgagaagaggttcaagtgcaaacactgcagttatgcctgcaagcaggaacgtcatatgaccgctcacattcgtacccacactggagagaaaccattcacctgcctttcttgcaataaatgtttccgacagaagcaacttctaaacgctcacttcaggaaataccacgatgcaaatttcatcccgactgtttacaaatgctccaagtgtggcaaaggcttttcccgctggattaacctgcacagacattcggagaagtgtggatcaggggaagcaaagtcggctgcttcaggaaagggaagaagaacaagaaagaggaagcagaccatcctgaaggaagccacaaagggtcagaaggaagctgcgaagggatggaaggaagccgcgaacggagacgaagctgctgctgaggaggcttccaccacgaagggagaacagttcccaggagagatgtttcctgtcgcctgcagagaaaccacagccagagtcaaagaggaagtggatgaaggcgtgacctgtgaaatgctcctcaacacgatggataattccgcaggctgtacaggaaggatgatgttggtatctgcctggcttctggggaggcctcaggaaacttacaatcaaggcagaaggcgaagagggagtaggcgcgtcacatggtgaaagcaggagcgagagagggggaggcgccacactcctctgaacgaccagattccttgagaaccgccactgtcatgaggacagcaccaagcggatggtgctaaatcattcctaagaaaccgcccccgtgatccagtcacctcctaccaggccccacctccaacactggggattacaattcaacatgagctttggccagggacaaatatccaaactatatcatgtattttactacaaccaaatgtatgttaatttcaaaaacagataacataaatatgtttgaaaacg

SEQ ID NO: 4925 - DNA, 3996 bp, Homo sapiens
agggtaaagcaggggccctgccaggcctccgagggagtgtgcttggtctggccgagggctgcttggccaagtctgggtgggctcgaggccactaggcccaaagcctgcctggctctgagggtgctaggtctagaaccgtgcacgaggggaatgcctgctcgggcccgaacctcgctgggcgccgggtgtgcactggcccggggcctgcttggacctgaaacttgctaggcccaggatatgcactggccgagagcctgctgggcccaaaccttactaggcccaggatgttcactgactgaaccggctcaggcctaaccttgctaggcccaggatatgcactgggccagagtgtgctcaggcggaaccttgccaggcgcaggatgtgtgctggccctaagcctgctgaggcccaaacctgttcgttctagggttttgtacaaaatcctgctttagcctaaatcctgcttagccttgaccccctcctagacccaagccagatcagcattgttctgaccctactaagtccaaaaccttttgaggccagaccttgtttcaactccaaagcctgctaggttccagcaccccccgcatccctcctcataccacccccttctcccccctatggaaaccgcttgcttatttttcaaacaggccaagtcattatggcagccactgagatctctgtcctttctgagcaattcaccaagatcaaagaactcgagttgatgccggaaaaaggcctgaaggaggaggaaaaagacggagtgtgcagagagaaagaccatcggagccctagtgagttggaggccgagcgtacctctggggccttccaggacagcgtcctggaggaagaagtggagctggtgctggccccctcggaggagagcgagaagtacatcctgaccctgcagacggtgcacttcacttctgaagctgtggagttgcaggatatgagcttgctgagcatacagcagcaagaaggggtgcaggtggtggtgcaacagcctggccctgggttgctgtggcttgaggaagggccccggcagagcctgcagcagtgtgtggccattagtatccagcaagagctgtactccccgcaagagatggaggtgttgcagttccacgctctagaggagaatgtgatggtggccagtgaagacagtaagttagcggtgagcctggctgaaactactggactgatcaagctcgaggaagagcaggagaagaaccagttattggctgaaagaacaaaggagcagctcttttttgtggaaacaatgtcaggagatgaaagaagtgacgaaattgttctcacagtttcaaattcaaatgtggaagaacaagaggatcaacctacagctggtcaagcagatgctgaaaaggccaaatctacaaaaaatcaaagaaagacaaagggagcaaaaggaaccttccactgtgatgtctgcatgttcacctcttctagaatgtcaagttttaatcgtcatatgaaaactcacaccagtgagaagcctcacctgtgtcacctctgcctgaaaaccttccgtacggtcactctgctgcggaaccatgttaacacccacacaggaaccaggccctacaagtgtaacgactgcaacatggcatttgtcaccagtggagaactcgtccgacacaggcgctataaacatactcatgagaaaccctttaaatgttccatgtgcaagtatgccagtgtggaggcaagtaaattgaagcgccatgtccgatcccacactggggagcgcccctttcagtgttgccagtgcagctatgccagcagagatacctacaagctgaaacgccacatgagaacgcactcaggtgagaagccttacgaatgccacatctgccacacccgcttcacccagagcgggaccatgaaaatacatattctgcagaaacacggcgaaaatgtccccaaataccagtgtccccattgtgccaccatcattgcacggaaaagcgacctacgattcctgggcctcccttttccatgatcttatttctctttccaaaatatatgacactgtgatacacaaaaatatgttagcagaacaaaaaatttgacccttttgcccaaagagattctggagatgagatgaatttttttgaaaacctttctgaaaggcgaaaggtgttccacaaagtcttcacttttatttttcatctggaccattctgtcattgttgccgtagataccagcacatcacaaaacacagtccagtggggcttggtggggcacaagtctagccagttgctagacttttttgacaccatggcaaagtaacatggtttatatccatctcatgccagtgggtgatacactccacatagccctataagatgctttataaacacattaattcttccttcccatgactgtatgagaaatcaagctctctaaatgtctgagtcactgtgggtaaggtggagtagctccatcacacagctgtccattgtcatttggcttcttacacaagtatcacaagaccatcatgctttagacttagatgagcaaacccagccagaccttaccatgtgtctcaggttaatttcaacataggaaataacagggcactgacttctaacaacgagtggattatttaaggtgtgcatatgcgcaacttgcatgcttacagcgctgcagagctgaaatgccgctactgttctgctgtcttccatgaacgctatgccctcattcagcaccagaaaactcataagaatgagaagaggttcaagtgcaaacactgcagttatgcctgcaagcaggaacgtcatatgaccgctcacattcgtacccacactggagagaaaccattcacctgcctttcttgcaataaatgtttccgacagaagcaacttctaaacgctcacttcaggaaataccacgatgcaaatttcatcccgactgtttacaaatgctccaagtgtggcaaaggcttttcccgctggattaacctgcacagacattcggagaagtgtggatcaggggaagcaaagtcggctgcttcaggaaagggaagaagaacaagaaagaggaagcagaccatcctgaaggaagccacaaagggtcagaaggaagctgcgaagggatggaaggaagccgcgaacggagacggtgtgatctcagctcaccgcaacctctgcctcctgggttcaagtgattctcatgcctcagtctccggagctgggattacagatgcccgccaccacgcctggctaattgttctattatttttagtagagatggggttttaccatgtctctcactcctgacctcaagtgatctgcccgcctcggcctcccaaagtggtgggattacaggcatgagcccctgtgcctggcctgatggcaccagttttgtggatctcagtgtttcttttcatatccaagaactgggtcttcttgtctccctccatccaccaaaaaaaaaaaaaaaaaaatacttcaaggaagcatggacaaaaatatcctcagacaagttagaacatgagacagtcacgttcttcagtgtggcgctctgtggatgtttgggaaagtaatttggaaaatgagtagagcagggctccccaaccccccagccgtggacctgtgggctgttaggaactgggcctcccagcaggaggtgagcagtgggtgagggagtgaagctttgtattgacagccgctccccatcgggcgcatcaccgcctgagctccgcctcctgtcagatcagcggcagcgttagattctcatgagtgtgaaccctgttgtgaactctgcacgtgcaagggatctaggctgcacactccttacgagaatctaatgcccgacgatctgtcactgtctcccatcacccccagatgggactgtctagatgcaggaaaacaagcccagggctcccactgattctacattatggtgagctgtataattatttcattatatatcacaatgtaataataaaaataaagtacataagaaatgtaatgtgc

SEQ ID NO: 4926 - DNA, 3785 bp, Homo sapiens
tcccaggccccctgcaggccctcgtgccctccttacttcccccccgggtctcccagcgccccctgcggggccctcctcccttcctcatccacttcaaccccaaggtatttccgtgcccctgcaggaccctcctcccctccttaggcgctcccccactacccagtcttccagtgccctgcaggctctcctcctctccttatccacccccaccccaggtctcccagtgccctgtatgggaccctcctcccctcctcatccacccccccaggtccaccagtgccccctctggggtcctcctcatccgtgctccccctccccctccctactccccttcccccctgcccccacagtacatcaccccctcccccaaccctgcctggctccgcccccttcacgccccctcttttccgctccgcgcctgcgcactgccaccctccactctcgcgccagcccggcggcggccggctgtgggctgcagcacgcggtgcacgaggcagagcccacaagccaaagacggagtgggccgagcattccggccacgccttccgcggccaagtcattatggcagccactgagatctctgtcctttctgagcaattcaccaagatcaaagaactcgagttgatgccggaaaaaggcctgaaggaggaggaaaaagacggagtgtgcagagagaaagaccatcggagccctagtgagttggaggccgagcgtacctctggggccttccaggacagcgtcctggaggaagaagtggagctggtgctggccccctcggaggagagcgagaagtacatcctgaccctgcagacggtgcacttcacttctgaagctgtggagttgcaggatatgagcttgctgagcatacagcagcaagaaggggtgcaggtggtggtgcaacagcctggccctgggttgctgtggcttgaggaagggccccggcagagcctgcagcagtgtgtggccattagtatccagcaagagctgtactccccgcaagagatggaggtgttgcagttccacgctctagaggagaatgtgatggtggccagtgaagacagtaagttagcggtgagcctggctgaaactactggactgatcaagctcgaggaagagcaggagaagaaccagttattggctgaaagaacaaaggagcagctcttttttgtggaaacaatgtcaggagatgaaagaagtgacgaaattgttctcacagtttcaaattcaaatgtggaagaacaagaggatcaacctacagctggtcaagcagatgctgaaaaggccaaatctacaaaaaatcaaagaaagacaaagggagcaaaaggaaccttccactgtgatgtctgcatgttcacctcttctagaatgtcaagttttaatcgtcatatgaaaactcacaccagtgagaagcctcacctgtgtcacctctgcctgaaaaccttccgtacggtcactctgctgcggaaccatgttaacacccacacaggaaccaggccctacaagtgtaacgactgcaacatggcatttgtcaccagtggagaactcgtccgacacaggcgctataaacatactcatgagaaaccctttaaatgttccatgtgcaagtatgccagtgtggaggcaagtaaattgaagcgccatgtccgatcccacactggggagcgcccctttcagtgttgccagtgcagctatgccagcagagatacctacaagctgaaacgccacatgagaacgcactcaggtgtgcatatgcgcaacttgcatgcttacagcgctgcagagctgaaatgccgctactgttctgctgtcttccatgaacgctatgccctcattcagcaccagaaaactcataagaatgagaagaggttcaagtgcaaacactgcagttatgcctgcaagcaggaacgtcatatgaccgctcacattcgtacccacactggagagaaaccattcacctgcctttcttgcaataaatgtttccgacagaagcaacttctaaacgctcacttcaggaaataccacgatgcaaatttcatcccgactgtttacaaatgctccaagtgtggcaaaggcttttcccgctggattaacctgcacagacattcggagaagtgtggatcaggggaagcaaagtcggctgcttcaggaaagggaagaagaacaagaaagaggaagcagaccatcctgaaggaagccacaaagggtcagaaggaagctgcgaagggatggaaggaagccgcgaacggagacgaagctgctgctgaggaggcttccaccacgaagggagaacagttcccaggagagatgtttcctgtcgcctgcagagaaaccacagccagagtcaaagaggaagtggatgaaggcgtgacctgtgaaatgctcctcaacacgatggataagtgagagggattcgggttgcgtgttcactgcccccaattcctaaagcaagttagaagtttttagcatttaaggtgtgaaatgctcctcaacacgatggataagtgagagagagtcaggttgcatgttcactgcccctaattcctaaagcaagttagaaatttttagcattttctttgaaacaattaagttcatgacaatggatgacacaagtttgaggtagtgtctagaattgttctcctgtttgtagctggatatttcaaagaaacattgcaggtattttataaaagttttaaaccttgaatgagagggtaacacctcaaacctatggattcattcacttgatattggcaaggtggcccacaatgagtgagtagtgatttttggatatttcaaaatagtctagaccagctagtgcttccacagtcaaagctggacatttttatgttgcattatatacacccatgatatttctaataatatatggttttaaacattaaagacaaatgtttttatacaaatgaattttctacaaaatttaaagctaccataatgcttttaattagttctaaattcaaccaaaaaatgttttactcttataaaaaggaaaactgagtaggaaatgaaatactagattagactagaaaataaggaataaatcgattttactttggtataggagcaaggttcacctttagatttttgtattctcttttaattatgctccttggcaggtatgaaattgccctggttacattccattattgcttattagtatttcactccataacccttttttctgctaaaactactctttttatatttgtaaaataattggcagagtgagaagaaacataaaatcagataaggcaaatgtgtacctgtaaggaatttgtactttttcataatgcccagtgattagtgagtatttcccttttgccagttgacaagatttttccaccctcgagcagcgtgagagatgcctctttaacacttgaaattcatttctatctggatacagaggcagatttttcttcattgcttagttgagcagtttgttttgctgccaacctgtctccacccctgtatttcaagatcattgataagccctaaattcaaattcttaagatatggaccttttattgaaaatatcacaagttcagaatccctatacaatgtgaatatgtggaaataatttcccagcaggaagagcattatattctctttgtaccagcaaattaatttaactcaactcacatgagatttaaattctgtgggctgtagtatgccatcattgtgactgaatttgtgcaatggtttcttaatttttttactgttatttaaagatgttttacataattcaataaaatgaaatgacttaaaattgc

SEQ ID NO: 4927 - DNA, 2955 bp, Homo sapiens
agggtaaagcaggggccctgccaggcctccgagggagtgtgcttggtctggccgagggctgcttggccaagtctgggtgggctcgaggccactaggcccaaagcctgcctggctctgagggtgctaggtctagaaccgtgcacgaggggaatgcctgctcgggcccgaacctcgctgggcgccgggtgtgcactggcccggggcctgcttggacctgaaacttgctaggcccaggatatgcactggccgagagcctgctgggcccaaaccttactaggcccaggatgttcactgactgaaccggctcaggcctaaccttgctaggcccaggatatgcactgggccagagtgtgctcaggcggaaccttgccaggcgcaggatgtgtgctggccctaagcctgctgaggcccaaacctgttcgttctagggttttgtacaaaatcctgctttagcctaaatcctgcttagccttgaccccctcctagacccaagccagatcagcattgttctgaccctactaagtccaaaaccttttgaggccagaccttgtttcaactccaaagcctgctaggttccagcaccccccgcatccctcctcataccacccccttctcccccctatggaaaccgcttgcttatttttcaaacaggccaagtcattatggcagccactgagatctctgtcctttctgagcaattcaccaagatcaaagaactcgagttgatgccggaaaaaggcctgaaggaggaggaaaaagacggagtgtgcagagagaaagaccatcggagccctagtgagttggaggccgagcgtacctctggggccttccaggacagcgtcctggaggaagaagtggagctggtgctggccccctcggaggagagcgagaagtacatcctgaccctgcagacggtgcacttcacttctgaagctgtggagttgcaggatatgagcttgctgagcatacagcagcaagaaggggtgcaggtggtggtgcaacagcctggccctgggttgctgtggcttgaggaagggccccggcagagcctgcagcagtgtgtggccattagtatccagcaagagctgtactccccgcaagagatggaggtgttgcagttccacgctctagaggagaatgtgatggtggccagtgaagacagtaagttagcggtgagcctggctgaaactactggactgatcaagctcgaggaagagcaggagaagaaccagttattggctgaaagaacaaaggagcagctcttttttgtggaaacaatgtcaggagatgaaagaagtgacgaaattgttctcacagtttcaaattcaaatgtggaagaacaagaggatcaacctacagctggtcaagcagatgctgaaaaggccaaatctacaaaaaatcaaagaaagacaaagggagcaaaaggaaccttccactgtgatgtctgcatgttcacctcttctagaatgtcaagttttaatcgtcatatgaaaactcacaccagtgagaagcctcacctgtgtcacctctgcctgaaaaccttccgtacggtcactctgctgcggaaccatgttaacacccacacaggaaccaggccctacaagtgtaacgactgcaacatggcatttgtcaccagtggagaactcgtccgacacaggcgctataaacatactcatgagaaaccctttaaatgttccatgtgcaagtatgccagtgtggaggaacgtcatatgaccgctcacattcgtacccacactggagagaaaccattcacctgcctttcttgcaataaatgtttccgacagaagcaacttctaaacgctcacttcaggaaataccacgatgcaaatttcatcccgactgtttacaaatgctccaagtgtggcaaaggcttttcccgctggattctctgggttgggaactcggaagtggctgaactgggtggtcctggctcagggccactcctgaggctgcagtcaggatgtccgccagggctgcatcatccgaaggctggactggggccagaggatccacttccaggacagctccgccacacaactgctggcaccggcctcagttccttgctacagggacctctctgcagggctgcttgagtgtcctcctgactcagagcaagtgagagagtgcaagtaggaagccatggtgccttttgcagtctagtcctaaaagcggcacaacagccagctgtgggggctcacacctgtaatcccagtacttcgggaggccaaggcaggtggataacttgaggccaggagctcaagaccagcctggccaacatggtgaaaccctgtctctactttaaaaaaaaaaaaagaaaatagctaggcgtggtagtgcacgcttgtaatcccagctacttgggtggttgggacgggaggatcacttgaacccaggagacagaggttgcagtgagctgagattgtgccactggcctccagcctgggcgacagagcaagactctgtctcaaaaaaaaaaaaaaagtggcacattctagtcacaagaaatgaaccatgaagtcccacccacactcgagtggggaatgaagtttcttttgaaaggaacagcatcaaagaatttcaggacatttaaaaaccactgcacatggctagctagatccttggaccatgtaggcttcagcctaactttataaaagttttataaaagttgaatttcctgaagttgactatttttttaaaaatatttcttcttaaaacagtagtgtagttgtgtttttctgagtagcacagtgggatagttctggaatgtcaaccctattagtttaaaatttcaaataaaagctgtggcagtgctcccaaaacaccattgctcatgcaaaaattgtgaagagttaaaattaacgagtagaattctaaagagaaaaaaactgctctttggtgcaagaaataaaaatgtagagaaaagaacaagtctgc

SEQ ID NO: 4928 - DNA, 3359 bp, Homo sapiens
agggtaaagcaggggccctgccaggcctccgagggagtgtgcttggtctggccgagggctgcttggccaagtctgggtgggctcgaggccactaggcccaaagcctgcctggctctgagggtgctaggtctagaaccgtgcacgaggggaatgcctgctcgggcccgaacctcgctgggcgccgggtgtgcactggcccggggcctgcttggacctgaaacttgctaggcccaggatatgcactggccgagagcctgctgggcccaaaccttactaggcccaggatgttcactgactgaaccggctcaggcctaaccttgctaggcccaggatatgcactgggccagagtgtgctcaggcggaaccttgccaggcgcaggatgtgtgctggccctaagcctgctgaggcccaaacctgttcgttctagggttttgtacaaaatcctgctttagcctaaatcctgcttagccttgaccccctcctagacccaagccagatcagcattgttctgaccctactaagtccaaaaccttttgaggccagaccttgtttcaactccaaagcctgctaggttccagcaccccccgcatccctcctcataccacccccttctcccccctatggaaaccgcttgcttatttttcaaacaggccaagtcattatggcagccactgagatctctgtcctttctgagcaattcaccaagatcaaagaactcgagttgatgccggaaaaaggcctgaaggaggaggaaaaagacggagtgtgcagagagaaagaccatcggagccctagtgagttggaggccgagcgtacctctggggccttccaggacagcgtcctggaggaagaagtggagctggtgctggccccctcggaggagagcgagaagtacatcctgaccctgcagacggtgcacttcacttctgaagctgtggagttgcaggatatgagcttgctgagcatacagcagcaagaaggggtgcaggtggtggtgcaacagcctggccctgggttgctgtggcttgaggaagggccccggcagagcctgcagcagtgtgtggccattagtatccagcaagagctgtactccccgcaagagatggaggtgttgcagttccacgctctagaggagaatgtgatggtggccagtgaagacagtaagttagcggtgagcctggctgaaactactggactgatcaagctcgaggaagagcaggagaagaaccagttattggctgaaagaacaaaggagcagctcttttttgtggaaacaatgtcaggagatgaaagaagtgacgaaattgttctcacagtttcaaattcaaatgtggaagaacaagaggatcaacctacagctggtcaagcagatgctgaaaaggccaaatctacaaaaaatcaaagaaagacaaagggagcaaaaggaaccttccactgtgatgtctgcatgttcacctcttctagaatgtcaagttttaatcgtcatatgaaaactcacaccagtgagaagcctcacctgtgtcacctctgcctgaaaaccttccgtacggtcactctgctgcggaaccatgttaacacccacacaggaaccaggccctacaagtgtaacgactgcaacatggcatttgtcaccagtggagaactcgtccgacacaggcgctataaacatactcatgagaaaccctttaaatgttccatgtgcaagtatgccagtgtggaggcaagtaaattgaagcgccatgtccgatcccacactggggagcgcccctttcagtgttgccagtgcagctatgccagcagagatacctacaagctgaaacgccacatgagaacgcactcaggtgagaagccttacgaatgccacatctgccacacccgcttcacccagagcgggaccatgaaaatacatattctgcagaaacacggcgaaaatgtccccaaataccagtgtccccattgtgccaccatcattgcacggaaaagcgacctacgtgtgcatatgcgcaacttgcatgcttacagcgctgcagagctgaaatgccgctactgttctgctgtcttccatgaacgctatgccctcattcagcaccagaaaactcataagaatgagaagaggttcaagtgcaaacactgcagttatgcctgcaagcaggaacgtcatatgaccgctcacattcgtacccacactggagagaaaccattcacctgcctttcttgcaataaatgtttccgacagaagcaacttctaaacgctcacttcaggaaataccacgatgcaaatttcatcccgactgtttacaaatgctccaagtgtggcaaaggcttttcccgctggattaacctgcacagacattcggagaagtgtggatcaggggaagcaaagtcggctgcttcaggaaagggaagaagaacaagaaagaggaagcagaccatcctgaaggaagccacaaagggtcagaaggaagctgcgaagggatggaaggaagccgcgaacggagacggtgtgatctcagctcaccgcaacctctgcctcctgggttcaagtgattctcatgcctcagtctccggagctgggattacagatgcccgccaccacgcctggctaattgttctattatttttagtagagatggggttttaccatgtctctcactcctgacctcaagtgatctgcccgcctcggcctcccaaagtggtgggattacaggcatgagcccctgtgcctggcctgatggcaccagttttgtggatctcagtgtttcttttcatatccaagaactgggtcttcttgtctccctccatccaccaaaaaaaaaaaaaaaaaaatacttcaaggaagcatggacaaaaatatcctcagacaagttagaacatgagacagtcacgttcttcagtgtggcgctctgtggatgtttgggaaagtaatttggaaaatgagtagagcagggctccccaaccccccagccgtggacctgtgggctgttaggaactgggcctcccagcaggaggtgagcagtgggtgagggagtgaagctttgtattgacagccgctccccatcgggcgcatcaccgcctgagctccgcctcctgtcagatcagcggcagcgttagattctcatgagtgtgaaccctgttgtgaactctgcacgtgcaagggatctaggctgcacactccttacgagaatctaatgcccgacgatctgtcactgtctcccatcacccccagatgggactgtctagatgcaggaaaacaagcccagggctcccactgattctacattatggtgagctgtataattatttcattatatatcacaatgtaataataaaaataaagtacataagaaatgtaatgtgc

SEQ ID NO: 4929 - DNA, 2023 bp, Homo sapiens
ggctgcagcacgcggtgcacgaggcagagcccacaagccaaagacggagtgggccgagcattccggccacgccttccgcggagcaaaaggaaccttccactgtgatgtctgcatgttcacctcttctagaatgtcaagttttaatcgtcatatgaaaactcacaccagtgagaagcctcacctgtgtcacctctgcctgaaaaccttccgtacggtcactctgctgcggaaccatgttaacacccacacaggaaccaggccctacaagtgtaacgactgcaacatggcatttgtcaccagtggagaactcgtccgacacaggcgctataaacatactcatgagaaaccctttaaatgttccatgtgcaagtatgccagtgtggaggcaagtaaattgaagcgccatgtccgatcccacactggggagcgcccctttcagtgttgccagtgcagctatgccagcagagatacctacaagctgaaacgccacatgagaacgcactcaggtgagaagccttacgaatgccacatctgccacacccgcttcacccagagcgggaccatgaaaatacatattctgcagaaacacggcgaaaatgtccccaaataccagtgtccccattgtgccaccatcattgcacggaaaagcgacctacgtgtgcatatgcgcaacttgcatgcttacagcgctgcagagctgaaatgccgctactgttctgctgtcttccatgaacgctatgccctcattcagcaccagaaaactcataagaatgagaagaggttcaagtgcaaacactgcagttatgcctgcaagcaggaacgtcatatgaccgctcacattcgtacccacactggagagaaaccattcacctgcctttcttgcaataaatgtttccgacagaagcaacttctaaacgctcacttcaggaaataccacgatgcaaatttcatcccgactgtttacaaatgctccaagtgtggcaaaggcttttcccgctggattaacctgcacagacattcggagaagtgtggatcaggggaagcaaagtcggctgcttcaggaaagggaagaagaacaagaaagaggaagcagaccatcctgaaggaagccacaaagggtcagaaggaagctgcgaagggatggaaggaagccgcgaacggagacggtgtgatctcagctcaccgcaacctctgcctcctgggttcaagtgattctcatgcctcagtctccggagctgggattacagatgcccgccaccacgcctggctaattgttctattatttttagtagagatggggttttaccatgtctctcactcctgacctcaagtgatctgcccgcctcggcctcccaaagtggtgggattacaggcatgagcccctgtgcctggcctgatggcaccagttttgtggatctcagtgtttcttttcatatccaagaactgggtcttcttgtctccctccatccaccaaaaaaaaaaaaaaaaaaatacttcaaggaagcatggacaaaaatatcctcagacaagttagaacatgagacagtcacgttcttcagtgtggcgctctgtggatgtttgggaaagtaatttggaaaatgagtagagcagggctccccaaccccccagccgtggacctgtgggctgttaggaactgggcctcccagcaggaggtgagcagtgggtgagggagtgaagctttgtattgacagccgctccccatcgggcgcatcaccgcctgagctccgcctcctgtcagatcagcggcagcgttagattctcatgagtgtgaaccctgttgtgaactctgcacgtgcaagggatctaggctgcacactccttacgagaatctaatgcccgacgatctgtcactgtctcccatcacccccagatgggactgtctagatgcaggaaaacaagcccagggctcccactgattctacattatggtgagctgtataattatttcattatatatcacaatgtaataataaaaataaagtacataagaaatgtaatgtgc

SEQ ID NO: 4930 - DNA, 2262 bp, Homo sapiens
ggctgcagcacgcggtgcacgaggcagagcccacaagccaaagacggagtgggccgagcattccggccacgccttccgcgctcgaggaagagcaggagaagaaccagttattggctgaaagaacaaaggagcagctcttttttgtggaaacaatgtcaggagatgaaagaagtgacgaaattgttctcacagtttcaaattcaaatgtggaagaacaagaggatcaacctacagctggtcaagcagatgctgaaaaggccaaatctacaaaaaatcaaagaaagacaaagggagcaaaaggaaccttccactgtgatgtctgcatgttcacctcttctagaatgtcaagttttaatcgtcatatgaaaactcacaccagtgagaagcctcacctgtgtcacctctgcctgaaaaccttccgtacggtcactctgctgcggaaccatgttaacacccacacaggaaccaggccctacaagtgtaacgactgcaacatggcatttgtcaccagtggagaactcgtccgacacaggcgctataaacatactcatgagaaaccctttaaatgttccatgtgcaagtatgccagtgtggaggcaagtaaattgaagcgccatgtccgatcccacactggggagcgcccctttcagtgttgccagtgcagctatgccagcagagatacctacaagctgaaacgccacatgagaacgcactcaggtgagaagccttacgaatgccacatctgccacacccgcttcacccagagcgggaccatgaaaatacatattctgcagaaacacggcgaaaatgtccccaaataccagtgtccccattgtgccaccatcattgcacggaaaagcgacctacgtgtgcatatgcgcaacttgcatgcttacagcgctgcagagctgaaatgccgctactgttctgctgtcttccatgaacgctatgccctcattcagcaccagaaaactcataagaatgagaagaggttcaagtgcaaacactgcagttatgcctgcaagcaggaacgtcatatgaccgctcacattcgtacccacactggagagaaaccattcacctgcctttcttgcaataaatgtttccgacagaagcaacttctaaacgctcacttcaggaaataccacgatgcaaatttcatcccgactgtttacaaatgctccaagtgtggcaaaggcttttcccgctggattctctgggttgggaactcggaagtggctgaactgggtggtcctggctcagggccactcctgaggctgcagtcaggatgtccgccagggctgcatcatccgaaggctggactggggccagaggatccacttccaggacagctccgccacacaactgctggcaccggcctcagttccttgctacagggacctctctgcagggctgcttgagtgtcctcctgactcagagcaagtgagagagtgcaagtaggaagccatggtgccttttgcagtctagtcctaaaagcggcacaacagccagctgtgggggctcacacctgtaatcccagtacttcgggaggccaaggcaggtggataacttgaggccaggagctcaagaccagcctggccaacatggtgaaaccctgtctctactttaaaaaaaaaaaaagaaaatagctaggcgtggtagtgcacgcttgtaatcccagctacttgggtggttgggacgggaggatcacttgaacccaggagacagaggttgcagtgagctgagattgtgccactggcctccagcctgggcgacagagcaagactctgtctcaaaaaaaaaaaaaaagtggcacattctagtcacaagaaatgaaccatgaagtcccacccacactcgagtggggaatgaagtttcttttgaaaggaacagcatcaaagaatttcaggacatttaaaaaccactgcacatggctagctagatccttggaccatgtaggcttcagcctaactttataaaagttttataaaagttgaatttcctgaagttgactatttttttaaaaatatttcttcttaaaacagtagtgtagttgtgtttttctgagtagcacagtgggatagttctggaatgtcaaccctattagtttaaaatttcaaataaaagctgtggcagtgctcccaaaacaccattgctcatgcaaaaattgtgaagagttaaaattaacgagtagaattctaaagagaaaaaaactgctctttggtgcaagaaataaaaatgtagagaaaagaacaagtctgc

SEQ ID NO: 4931 - DNA, 1767 bp, Homo sapiens
ccgacgcagcggtgttgcacctccctctccggctctgctgcccgggatttccccagaacctgcgccgcgcgagaaggagcctgggagcatccgcccacactgcccggacagtcggctcgactcggtgccctcggccccagccgggctccgctcctcgggcgcgcgaggggccgtggtggcggcggcgcccggcatgtttcatagtccgcggcggctctgctcggccctgctgcagagggacgcgcccggcctgcgccgcctgcccgccccagggctgcgccgcccgttgtccccgccggctgctgttcccaggcccgcatccccccggctgctggcggcggcctcggcggcctcgggcgccgcgaggtcgtgttcccgaacagtgtgttccatgggaaccggtacaagcagactctatagtgctctcgccaagacactgaacagcagcgctgcctcccagcacccagagtatttggtgtcacctgacccagagcatctggagcccattgatcctaaagagcttcttgaggaatgcagggccgtcctgcacacccgacctccccggttccagagggattttgtggatctgaggacagattgccctagtacccacccacctatcagggttatgcaatggaacatcctcgcccaagctcttggagaaggcaaagacaactttgtacagtgccctgttgaagcactcaaatgggaagaaaggaaatgtctcatcctggaagaaatcctggcctaccagcctgatatattgtgcctccaagaggtggaccactattttgacaccttccagccactcctcagtagactaggctatcaaggcacgtttttccccaaaccctggtcaccttgtctagatgtagaacacaacaatggaccagatggttgtgccttattttttcttcaaaaccgattcaagctagtcaacagtgccaatattaggctgacagccatgacattgaaaaccaaccaggtggccattgcacagaccctggagtgcaaggagtcaggccgacagttctgcatcgctgttacccatctaaaagcacgcactggctgggagcggtttcgatcagctcaaggctgtgacctccttcagaacctgcaaaacatcacccaaggagccaagattccccttattgtgtgtggggacttcaatgcagagccaacagaagaggtctacaaacactttgcttcctccagcctcaacctgaacagcgcctacaagctgctgagtgctgatgggcagtcagaacccccatacactacctggaagatccggacctcaggggagtgcaggcacaccctggattacatctggtattctaaacatgctctaaatgtaaggtcagctctcgatctgctcactgaagaacagattggacccaacaggttaccttccttcaattatccttcagaccacctgtctctagtgtgtgacttcagctttactgaggaatctgatggactttcataaatacttgcttttgtctttttaatcacaggagtctatttttttttttttttttttttttttgagacagagtctcgctctgttgcctaggctggagtacagtggcctgatctcggctcactgcaagatccgcctcccgggttcatggcattctcctgcctcagcctccagagcaactgggacaacaggcgcccgtcaccacgcccagctaattttttgtatttttagtagagacggggtttcaccgtgttagccaggatggtctcgatctcctgaccttg

SEQ ID NO: 4932 - DNA, 3505 bp, Homo sapiens
agatggtggcccgtctggctgtggaacccaccgaaagctgagagtctctctctcagccgtaaaggtcggactcgctgaagcaatcaggcccggttctgaagagttttttccccgacgctcgttcggtggtttcttgtgaggacgcggcagcccgtggagtcggctgagggaaaagcgaggcaaggcaggcgggtcgtcaaagtcctacattttagctttcagtgctgaacttccttctcccttaaattattataaacttttgctgctgtttaataaacgtgaagatgtctcgcagtcctgatgcgaaggaagaccctgtggagtgccctctttgcatggagcccttggagatagatgatatcaactttttcccttgcacctgtggctaccagatttgccgattttgttggcatcgaattcgcactgatgaaaatgggctttgtcctgcatgtagaaagccatatccagaagacccagcagtttataaaccactctcccaggaagagctgcaaaggataaagaatgagaaaaaacagaaacaaaatgagagaaaacagaaaatatcagaaaatcgcaaacatttggctagtgtacgtgtcgtacaaaaaaacctcgtctttgttgtaggtttatctcagcgcctagcagacccagaggttttaaaacgaccagaatattttgggaagtttggtaaaatacataaagttgtcatcaataatagcacatcatatgcaggctcacagggtccaagtgccagtgcttatgtaacctatatccggtcagaagacgctctcagagccatacagtgtgtcaacaatgtggtagtagatggcagaacacttaaggcatctctaggtacaacaaaatactgcagttacttcttaaagaatatgcagtgtccaaaacctgactgcatgtatcttcatgaattgggggatgaggcggccagcttcacaaaagaggaaatgcaggcgggtaaacaccaagaatatgaacagaagctacttcaagaattatataaattaaatcccaattttcttcagctatctacgggttcagttgataaaaataagaacaaagtgacaccactgcagagccccattgacaaaccttcagattctctcagtatagggaacggtgataattcccagcagatatctaacagtgatacgccttcaccaccacctggtttgtcaaaatccaatccagtcatccccatcagttcatccaatcacagtgcacggtccccttttgaaggggcagtaacagagtcacagtcgttattctcagacaattttcgccatcccaaccctatcccaagtgggcttcctcctttccccagctccccacagacatccagtgactggcctacagcaccagaaccacagagcctcttcacatcagaaacaatcccagtatcatcctctacagactggcaagcagcttttggctttggttcttctaaacaaccagaggatgacttgggttttgatcccttcgatgtcactcgaaaagccttagcagacctgattgagaaggaactgtccgttcaagaccaaccttccctttcgcccacatctcttcagaactcctcttcacacactacaaccgccaaaggtccaggctctggattcctgcatcctgctgcagctacaaatgccaattctctcaatagtaccttttcagtcttgccccagaggttccctcaatttcagcagcaccgagcggtttataattcattcagttttccaggccaggcagcccgctatccttggatggcctttccacgcaatagcatcatgcacttgaaccacacagcaaaccccacctcaaatagtaatttcttggacttgaatctcccgccacagcacaacacaggtctgggagggatccctgtagcagacaacagcagttctgtagagagtttaaatatgaaggaatggcaggacgggctaagggcacttctacccaacattaacatcaactttggtggactgcccaattcttcttccccctccaacgccaaccacagtgcaccaacgtccaacactgccaccaccgacagcctgagttgggacagccctggcagctggacagacccagccatcatcacaggtattccagcgtcttcaggaaacagtttagactctcttcaagatgacaatcctccacactggctaaaatcccttcaggccctcacagagatggacggccccagcgctgctccatcacagacccaccacagcgcccccttcagcacacagatcccgctgcacagagccagttggaatccctaccctcctccttcaaacccttccagcttccactccccacccccaggctttcagacagccttcagaccccccagcaaaacccccacagatttactacagagttcaacactggaccgccattaggcaaagaggagcaaccattagaaaatgcaggatttgtcccactctgttttctccctctcagcccaccacccacagctcccttctcatctcttatgttctgaagaatccagtacctgatcaattttttttctccctaaccccagatgcaatgcgatcacagggtcattaccatctctttattaattgtaaaaatttttgttgatccagcatttgagtgacactgttgaatgtttctaaaaatgcctttttaaggagagaaaaaaaaatcaaagggcagtctcaatacttagaaaattattgtttgtctgttgcgcataataatgacataatctgcttagcagaaaatgacgattaatctataggaaagctcaagtaaatgcattatcaactgcagaagtttgaaaaccaggttcatttacgtgagattgctaaatgcatgggggaaagcagtggtcctagcatccatcttgtattcagcttatcattattgcagggaaaatgcttttaatttaaattaatttttaattcttttggcaagttgatggcaaggacttgattgtgtcattaagcaaaagaatgtattggaagttgatggaaagacaaattcatctgtagtagtaactggccgattgctaaagagttcataaggaggtgagaagtaatttttttaaaggagaaaaattttttggctttagatttaaagtaaattgaaatgttttaaagaaaaaagtattcacagatttaatacctattaataatataagagctgaaatgtaagtcatttcttcagtccttctcctctgtcggaatcttttttgttttaccataaattcacctgacgagggcactctgagatagcactgctctggggccatctgatcaccatcgggagcaaatctctgacctccttgcctgcagcttttacttaaccctgtagtttctggacgtttgtgcagtattgaaaagacaggagaaaagaaaacagaaacctggttataacctgacgctaaaactaaaaacaaggaaatgtacctctttcttcagaattaaaactaaaatcttaaataaaacagaaaacttgatggtga

SEQ ID NO: 4933 - DNA, 4098 bp, Homo sapiens
agctttaagaaagatgtgccaccttctattaatactacaaatatagatacgttgcttgtggccacagatcaaactgagagaattgtggagcccccagaaaatatccaggagaaaattgcttttattttcaataatctctcacagtcaaatatgacacaaaaggttgaagagctaaaggaaacggtgaaagaagaatttatgccttgggtttcacagtatctggttatgaagagagtcagtattgagccaaactttcatagcctgtattcaaacttccttgacacgctgaagaatcctgaatttaacaagatggttctgaatgagacctacagaaacattaaagacttggatgtgaaatcattgctgctagaggcttatgttaaaggacaacaagaattgctctatgtagtgccctttgttgccaaagtcttagaatctagcattcgtagtgtggtttttaggccaccaaacccttggacaatggcaattatgaatgtattagctgagctacatcaggagcatgacttaaagttaaacttgaagtttgaaatcgaggttctctgcaagaaccttgcattagacatcaatgagctaaaacctggaaacctcctaaaggataaagatcgcctgaagaatttagatgagcaactctctgctccaaagaaagatgtcaagcagccagaagaactccctcccatcacaaccacaacaacttctactacaccagctaccaacaccacttgtacagccacggttccaccacagccacagtacagctaccacgacatcaatgtctattcccttgcgggcttggcaccacacattactctgaatccaacaattcccttgtttcaggcccatccacagttgaagcagtgtgtgcgtcaggcaattgaacgggctgtccaggagctggtccatcctgtggtggatcgatcaattaagattgccatgactacttgtgagcaaatagtcaggaaggattttgccctggattcggaggaatctcgaatgcgaatagcagctcatcacatgatgcgtaacttgacagctggaatggctatgattacatgcagggaacctttgctcatgagcatatctaccaacttaaaaaacagttttgcctcagcccttcgtactgcttccccacaacaaagagaaatgatggatcaggcagctgctcaattagctcaggacaattgtgagttggcttgctgttttattcagaagactgcagtagaaaaagcaggccctgagatggacaagagattagcaactgaatttgagctgagaaaacatgctaggcaagaaggacgcagatactgtgatcctgttgttttaacatatcaagctgaacggatgccagagcaaatcaggctgaaagttggtggtgtggacccaaagcagttggctgtttacgaagagtttgcacgcaatgttcctggcttcttacctacaaatgacttaagtcagcccacgggatttttagcccagcccatgaagcaagcttgggcaacagatgatgtagctcagatttatgataagtgtattacagaactggagcaacatctacatgccatcccaccaactttggccatgaaccctcaagctcaggctcttcgaagtctcttggaggttgtagttttatctcgaaactctcgggatgccatagctgctcttggattgctccaaaaggctgtagagggcttactagatgccacaagtggtgctgatgctgaccttctgctgcgctacagggaatgccacctcttggtcctaaaagctctgcaggatggccgggcatatgggtctccatggtgcaacaaacagatcacaaggtgcctaattgaatgtcgagatgaatataaatataatgtggaggctgtggagctgctaattcgcaatcatttggttaatatgcagcagtatgatcttcacctagcgcagtcaatggagaatggcttaaactacatggctgtggcatttgctatgcagttagtaaaaatcctgctggtggatgaaaggagtgttgctcatgttactgaggcagatctgttccacaccattgaaaccctcatgaggattaatgctcattccagaggcaatgctccagaaggattgccccagctgatggaagtagtgcgatccaactatgaagcaatgattgatcgtgctcatggaggcccaaactttatgatgcattctgggatctctcaagcctcagagtatgatgaccctccaggcctgagggagaaggcagagtatcttctgagggaatgggtgaatctctaccattcagcagcagctggccgcgacagtaccaaagctttctctgcatttgttggacagatgcaccagcaaggaatactgaagaccgatgatctcataacaaggttctttcgtctgtgtactgaaatgtgtgttgaaatcagttaccgtgctcaggctgagcagcagcacaatcctgctgccaatcccaccatgatccgagccaagtgctatcacaacctggatgcctttgttcgactcattgcactgctcgtgaaacactcaggggaggccaccaacactgtcacaaagattaatctgctgaacaaggtccttggtatagtagtgggagttctccttcaggatcatgatgttcgtcagagtgaatttcagcaacttccctaccatcgaatttttatcatgcttctcttggaactcaatgcacctgagcatgtgttggaaaccattaatttccagacacttacagctttctgcaatacattccacatcttgaggcctaccaaagctcctggctttgtatatgcctggcttgaactgatttcccatcggatatttattgcaagaatgctggcacatacgccacagcagaaggggtggcctatgtatgcacagctactgattgatttattcaaatatttagcgcctttccttagaaatgtggaactcaccaaacctatgcaaatcctctacaagggcactttaagagtgctgctggttcttttgcatgatttcccagagttcctttgtgattaccattatgggttctgtgatgtgatcccacctaattgtatccagttaagaaatttgatcctgagtgcctttccaagaaacatgaggctccccgacccattcactcctaatctaaaggtggacatgttgagtgaaattaacattgctccccggattctcaccaatttcactggagtaatgccacctcagttcaaaaaggatttggattcctatcttaaaactcgatcaccagtcactttcctgtctgatctgcgcagcaacctacaggtatccaatgaacctgggaatcgctacaacctccagctcatcaatgcactggtgctctatgtcgggactcaggccattgcgcacatccacaacaagggcagcacaccttcaatgagcaccatcactcactcagcacacatggatatcttccagaatttggctgtggacttggacactgagggtcgctatctctttttgaatgcaattgcaaatcagctccggtacccaaatagccacactcactacttcagttgcaccatgctgtacctttttgcagaggccaatacggaagccatccaagaacagatcacaagagttctcttggaacggttgattgtaaataggccacatccttggggtcttcttattaccttcattgagctgattaaaaacccagcgtttaagttctggaaccatgaatttgtacactgtgccccagaaatcgaaaagttattccagtcggtcgcacagtgctgcatgggacagaagcaggcccagcaagtaatggaagggacaggtgccagttagacgaaactgcatctctgttgtacgtgtcagtctagaggtctcactgcaccgagttcataaactgactgaagaatcctttcagctcttcctgactttcccagccctttggtttgtgggtatctgccccaactactgttgggatcagcctcctgtcttatgtgggcacgttccaaagtttaaatgcatttttttgactcttggccaaaatttagaagatgctgtgaatatcattttgaacttgtgtaaatacatgaaagagaaaac

SEQ ID NO: 4934 - DNA, 8429 bp, Homo sapiens
gacctccggcgccattttgtagagaaacaagcggagttaaccgaagagggggtcgaggagagccggagtcggggacccaggagtttcctgtgtccagcgctgccggagccgcctgaggtgccatgtttcagaacagagtaagacccctggtaaagaagaactgaagatattatacagataccagatatagcctaattacaaagaaagcattaacctgcctctgaggtgactaaaggggaataatggtgattttgcgccgggctcggccgcctgcttccgccccaaccagcaatgaatcttgactcgctctcgctggccttgtctcaaatcagctacctggtggacaatttaaccaagaaaaattaccgagccagccagcaggaaatacagcatattgtgaatcggcacggtcctgaggcagacaggcatttattacgctgcctattttcgcatgtggatttcagtggcgatggtaaaagcagtggcaaagatttccatcagactcagtttctgattcaggagtgtgcgttgctgattacaaagccaaattttatctcgacgctgtcctatgccattgataatccattgcactatcagaagagtttaaagcctgcaccccacttatttgcccagctgagtaaagtgctcaaattaagcaaagtacaagaggtaatttttggccttgccctgttgaattcttccagctcagatcttagaggtttcgctgcccagtttatcaaacagaagcttccagatcttctgcgttcttacattgacgcagacgtcagtggaaatcaagaaggtggcttccaagatatagcaatagaggtcctacacctcctcctctcccatctcctctttgggcagaagggagcctttggagttggacaagaacagatagacgcttttcttaagacgctgcgcagagattttccccaagaacgctgtcccgtggtgctcgcaccacttttataccctgaaaaacgggacattctaatggacaggatcctgcctgattccggaggggtagctaaaaccatgatggagagctctttggctgatttcatgcaagaagtaggctatggcttttgtgcaagtattgaagaatgtcgcaatataatcgtgcagtttggtgttcgggaggtcacagctgcccaggttgcaagggttttgggaatgatggctcgaactcattcaggattaacagatggcattccattacagagtatttctgctccgggcagtgggatctggagtgatgggaaagataaaagtgatggagcacaggcacacacatggaatgtagaagtcttgattgacgttcttaaagaactgaatccaagtttgaatttcaaggaagtaacttatgaactggaccatcctggatttcaaattcgtgacagtaaaggacttcataatgtggtttatggcattcagaggggtttgggtatggaagtgttcccagtagacctcatatatagaccttggaaacatgctgaaggccagctctccttcattcaacattcccttataaatccagagatcttctgttttgctgactatccctgtcatactgttgccactgatattctgaaagcaccaccagaggatgacaatcgagaaattgccacatggaagagcttggatttgattgaatctctgctgaggcttgcagaggttgggcagtatgagcaagtcaaacagctcttcagcttccctatcaaacactgtccagacatgctggtattggccttactacaaattaacacctcttggcataccttgcgccatgaacttatctccactctgatgccaattttccttggaaaccatcctaactcagctattattttgcactatgcatggcatgggcagggacagtctccctcaattcgccaacttatcatgcatgcaatggcagaatggtacatgagaggggagcagtatgatcaggccaaattgtctcgaatacttgatgtggcccaggacttgaaggccttgtcaatgctgctaaatggtactccatttgcctttgttattgaccttgctgcacttgcttcacgtcgtgaatacctcaaacttgataagtggctcacagataaaattcgagagcatggggagccttttatccaggcgtgtatgacttttttaaagagacggtgtccttctattttgggcggacttgccccagaaaaagaccagcccaaaagtgctcaacttcctccagaaactttggcgacaatgttggcctgtctgcaagcttgtgcagggagtgtttctcaggagctatcagaaactatcctcaccatggtagccaattgcagtaatgttatgaataaggccagacaaccaccacctggagttatgccaaaaggacgtcctcctagtgctagcagcttagatgccatttctcctgttcagattgaccctcttgctggaatgacatctcttagtataggtggttcagctgcccctcacacccagagtatgcagggttttcctccaaatttgggttctgcattcagtacccctcagtcaccagcaaaagcatttccacccctttcaacccccaatcagaccactgcattcagtggtattggaggactttcatcacagcttccagtaggtggtcttggcacaggcagcctgactggtataggaactggtgctcttggactccctgcagtgaataacgacccttttgtacagaggaaactgggcacctctggactgaatcagcctacattccagcagagtaagatgaaaccttcggacttgtctcaggtgtggccagaggcaaaccagcactttagtaaagagatagatgatgaagcaaacagctatttccagcgaatatataatcatccaccacatccaaccatgtctgttgatgaggtattagaaatgctgcagagatttaaagactctactataaagagggaacgagaagtatttaactgtatgctaaggaacttgtttgaagaatatcgtttttttccccagtatcctgataaagagttacatataacagcctgcctatttggtggtataattgagaaaggactggtcacttacatggcactaggtctggctctacgatatgttcttgaagccttacgcaagccttttggatccaaaatgtattatttcgggattgctgcactagatagatttaaaaacagattgaaggactatccccagtattgtcagcatttggcttctatcagtcactttatgcaatttccacatcatttacaggagtatattgagtatggacagcagtctagagatcctcctgtgaaaatgcaaggctctatcacaacccctggaagtattgcactggctcaggcccaggctcaggcccaggttccagcaaaagctcctcttgctggtcaagttagcactatggtaaccacctcaacaactaccactgttgctaaaacggttacggtcaccaggccaactggagtcagctttaagaaagatgtgccaccttctattaatactacaaatatagatacgttgcttgtggccacagatcaaactgagagaattgtggagcccccagaaaatatccaggagaaaattgcttttattttcaataatctctcacagtcaaatatgacacaaaaggttgaagagctaaaggaaacggtgaaagaagaatttatgccttgggtttcacagtatctggttatgaagagagtcagtattgagccaaactttcatagcctgtattcaaacttccttgacacgctgaagaatcctgaatttaacaagatggttctgaatgagacctacagaaacattaaagtgctcctgacctctgataaagctgcagccaatttctcagatcgttctttgctgaagaacttgggacattggctaggaatgatcacattagctaaaaacaaacccatcttacacactgacttggatgtgaaatcattgctgctagaggcttatgttaaaggacaacaagaattgctctatgtagtgccctttgttgccaaagtcttagaatctagcattcgtagtgtggtttttaggccaccaaacccttggacaatggcaattatgaatgtattagctgagctacatcaggagcatgacttaaagttaaacttgaagtttgaaatcgaggttctctgcaagaaccttgcattagacatcaatgagctaaaacctggaaacctcctaaaggataaagatcgcctgaagaatttagatgagcaactctctgctccaaagaaagatgtcaagcagccagaagaactccctcccatcacaaccacaacaacttctactacaccagctaccaacaccacttgtacagccacggttccaccacagccacagtacagctaccacgacatcaatgtctattcccttgcgggcttggcaccacacattactctgaatccaacaattcccttgtttcaggcccatccacagttgaagcagtgtgtgcgtcaggcaattgaacgggctgtccaggagctggtccatcctgtggtggatcgatcaattaagattgccatgactacttgtgagcaaatagtcaggaaggattttgccctggattcggaggaatctcgaatgcgaatagcagctcatcacatgatgcgtaacttgacagctggaatggctatgattacatgcagggaacctttgctcatgagcatatctaccaacttaaaaaacagttttgcctcagcccttcgtactgcttccccacaacaaagagaaatgatggatcaggcagctgctcaattagctcaggacaattgtgagttggcttgctgttttattcagaagactgcagtagaaaaagcaggccctgagatggacaagagattagcaactgaatttgagctgagaaaacatgctaggcaagaaggacgcagatactgtgatcctgttgttttaacatatcaagctgaacggatgccagagcaaatcaggctgaaagttggtggtgtggacccaaagcagttggctgtttacgaagagtttgcacgcaatgttcctggcttcttacctacaaatgacttaagtcagcccacgggatttttagcccagcccatgaagcaagcttgggcaacagatgatgtagctcagatttatgataagtgtattacagaactggagcaacatctacatgccatcccaccaactttggccatgaaccctcaagctcaggctcttcgaagtctcttggaggttgtagttttatctcgaaactctcgggatgccatagctgctcttggattgctccaaaaggctgtagagggcttactagatgccacaagtggtgctgatgctgaccttctgctgcgctacagggaatgccacctcttggtcctaaaagctctgcaggatggccgggcatatgggtctccatggtgcaacaaacagatcacaaggtgcctaattgaatgtcgagatgaatataaatataatgtggaggctgtggagctgctaattcgcaatcatttggttaatatgcagcagtatgatcttcacctagcgcagtcaatggagaatggcttaaactacatggctgtggcatttgctatgcagttagtaaaaatcctgctggtggatgaaaggagtgttgctcatgttactgaggcagatctgttccacaccattgaaaccctcatgaggattaatgctcattccagaggcaatgctccagaaggattgccccagctgatggaagtagtgcgatccaactatgaagcaatgattgatcgtgctcatggaggcccaaactttatgatgcattctgggatctctcaagcctcagagtatgatgaccctccaggcctgagggagaaggcagagtatcttctgagggaatgggtgaatctctaccattcagcagcagctggccgcgacagtaccaaagctttctctgcatttgttggacagatgcaccagcaaggaatactgaagaccgatgatctcataacaaggttctttcgtctgtgtactgaaatgtgtgttgaaatcagttaccgtgctcaggctgagcagcagcacaatcctgctgccaatcccaccatgatccgagccaagtgctatcacaacctggatgcctttgttcgactcattgcactgctcgtgaaacactcaggggaggccaccaacactgtcacaaagattaatctgctgaacaaggtccttggtatagtagtgggagttctccttcaggatcatgatgttcgtcagagtgaatttcagcaacttccctaccatcgaatttttatcatgcttctcttggaactcaatgcacctgagcatgtgttggaaaccattaatttccagacacttacagctttctgcaatacattccacatcttgaggcctaccaaagctcctggctttgtatatgcctggcttgaactgatttcccatcggatatttattgcaagaatgctggcacatacgccacagcagaaggggtggcctatgtatgcacagctactgattgatttattcaaatatttagcgcctttccttagaaatgtggaactcaccaaacctatgcaaatcctctacaagggcactttaagagtgctgctggttcttttgcatgatttcccagagttcctttgtgattaccattatgggttctgtgatgtgatcccacctaattgtatccagttaagaaatttgatcctgagtgcctttccaagaaacatgaggctccccgacccattcactcctaatctaaaggtggacatgttgagtgaaattaacattgctccccggattctcaccaatttcactggagtaatgccacctcagttcaaaaaggatttggattcctatcttaaaactcgatcaccagtcactttcctgtctgatctgcgcagcaacctacaggtatccaatgaacctgggaatcgctacaacctccagctcatcaatgcactggtgctctatgtcgggactcaggccattgcgcacatccacaacaagggcagcacaccttcaatgagcaccatcactcactcagcacacatggatatcttccagaatttggctgtggacttggacactgagggtcgctatctctttttgaatgcaattgcaaatcagctccggtacccaaatagccacactcactacttcagttgcaccatgctgtacctttttgcagaggccaatacggaagccatccaagaacagatcacaagagttctcttggaacggttgattgtaaataggccacatccttggggtcttcttattaccttcattgagctgattaaaaacccagcgtttaagttctggaaccatgaatttgtacactgtgccccagaaatcgaaaagttattccagtcggtcgcacagtgctgcatgggacagaagcaggcccagcaagtaatggaagggacaggtgccagttagacgaaactgcatctctgttgtacgtgtcagtctagaggtctcactgcaccgagttcataaactgactgaagaatcctttcagctcttcctgactttcccagccctttggtttgtgggtatctgccccaactactgttgggatcagcctcctgtcttatgtgggcacgttccaaagtttaaatgcatttttttgactcttggccaaaatttagaagatgctgtgaatatcattttgaacttgtgtaaatacatgaaagagaaaacctttgtctggaacttcttggctttgtgcaagctgtgtccaaggcaagtacataaactggtaccttgtaatgaagaggcagctgatgccatgcacttgtctgagggcatagctccatgtcttctgacattcctggtgtcccaaagaatagcaaaaagccagtttgaatattatgtaacttatttttttaatgtggacaggggaccttgaaaatcactaagttattaaaaatgtggatgtgctagaattggatatgtccaggaacatgggaagggctcactattggaatcccatgagtttccattttgtctctacccaaacgtattccaaagctgactgcatttgtaccatcttatttcttttggggattatacacctcagccgcctgagatgggggtcagctctttatataaagggaaaccagaccaggcctaaagcccacccctaccctcacccccccaatcctctcctgaaacttaaaaacagtgggaatataggaaagggaaccaaatctcattaattaattgttctcccccattaccccactgaatgaatggccatacaggctaagctgaataatgacaaagttgaaaggaccaatacagccccttttataaggattttgaatgttttgcaaatgtattggtccctgtgttgtattttgtagccttttcctgggcttcagctcccctacttcttgtatgtgtatgcatactgtagctaaccattaaagtcatgacacaca

SEQ ID NO: 4935 - DNA, 6743 bp, Homo sapiens
gcgacctccggcgccattttgtagagaaacaagcggagttaaccgaagagggggtcgaggagagccggagtcggggacccaggagtttcctgtgtccagcgctgccggagccgcctgaggtgccatgtttcagaacagagtaagacccctggtaaagaagaactgaagatattatacagataccagatatagcctaattacaaagaaagcattaacctgcctctgaggtgactaaaggggaataatggtgattttgcgccgggctcggccgcctgcttccgccccaaccagcaatgaatcttgactcgctctcgctggccttgtctcaaatcagctacctggtggacaatttaaccaagaaaaattaccgagccagccagcaggaaatacagcatattgtgaatcggcacggtcctgaggcagacaggcatttattacgctgcctattttcgcatgtggatttcagtggcgatggtaaaagcagtggcaaagatttccatcagactcagtttctgattcaggagtgtgcgttgctgattacaaagccaaattttatctcgacgctgtcctatgccattgataatccattgcactatcagaagagtttaaagcctgcaccccacttatttgcccagctgagtaaagtgctcaaattaagcaaagtacaagaggtaatttttggccttgccctgttgaattcttccagctcagatcttagaggtttcgctgcccagtttatcaaacagaagcttccagatcttctgcgttcttacattgacgcagacgtcagtggaaatcaagaaggtggcttccaagatatagcaatagaggtcctacacctcctcctctcccatctcctctttgggcagaagggagcctttggagttggacaagaacagatagacgcttttcttaagacgctgcgcagagattttccccaagaacgctgtcccgtggtgctcgcaccacttttataccctgaaaaacgggacattctaatggacaggatcctgcctgattccggaggggtagctaaaaccatgatggagagctctttggctgatttcatgcaagaagtaggctatggcttttgtgcaagtattgaagaatgtcgcaatataatcgtgcagtttggtgttcgggaggtcacagctgcccaggttgcaagggttttgggaatgatggctcgaactcattcaggattaacagatggcattccattacagagtatttctgctccgggcagtgggatctggagtgatgggaaagataaaagtgatggagcacaggcacacacatggaatgtagaagtcttgattgacgttcttaaagaactgaatccaagtttgaatttcaaggaagtaacttatgaactggaccatcctggatttcaaattcgtgacagtaaaggacttcataatgtggtttatggcattcagaggggtttgggtatggaagtgttcccagtagacctcatatatagaccttggaaacatgctgaaggccagctctccttcattcaacattcccttataaatccagagatcttctgttttgctgactatccctgtcatactgttgccactgatattctgaaagcaccaccagaggatgacaatcgagaaattgccacatggaagagcttggatttgattgaatctctgctgaggcttgcagaggttgggcagtatgagcaagtcaaacagctcttcagcttccctatcaaacactgtccagacatgctggtattggccttactacaaattaacacctcttggcataccttgcgccatgaacttatctccactctgatgccaattttccttggaaaccatcctaactcagctattattttgcactatgcatggcatgggcagggacagtctccctcaattcgccaacttatcatgcatgcaatggcagaatggtacatgagaggggagcagtatgatcaggccaaattgtctcgaatacttgatgtggcccaggacttgaaggccttgtcaatgctgctaaatggtactccatttgcctttgttattgaccttgctgcacttgcttcacgtcgtgaatacctcaaacttgataagtggctcacagataaaattcgagagcatggggagccttttatccaggcgtgtatgacttttttaaagagacggtgtccttctattttgggcggacttgccccagaaaaagaccagcccaaaagtgctcaacttcctccagaaactttggcgacaatgttggcctgtctgcaagcttgtgcagggagtgtttctcaggagctatcagaaactatcctcaccatggtagccaattgcagtaatgttatgaataaggccagacaaccaccacctggagttatgccaaaaggacgtcctcctagtgctagcagcttagatgccatttctcctgttcagattgaccctcttgctggaatgacatctcttagtataggtggttcagctgcccctcacacccagagtatgcagggttttcctccaaatttgggttctgcattcagtacccctcagtcaccagcaaaagcatttccacccctttcaacccccaatcagaccactgcattcagtggtattggaggactttcatcacagcttccagtaggtggtcttggcacaggcagcctgactggtataggaactggtgctcttggactccctgcagtgaataacgacccttttgtacagaggaaactgggcacctctggactgaatcagcctacattccagcagacggacttgtctcaggtgtggccagaggcaaaccagcactttagtaaagagatagatgatgaagcaaacagctatttccagcgaatatataatcatccaccacatccaaccatgtctgttgatgaggtattagaaatgctgcagagatttaaagactctactataaagagggaacgagaagtatttaactgtatgctaaggaacttgtttgaagaatatcgtttttttccccagtatcctgataaagagttacatataacagcctgcctatttggtggtataattgagaaaggactggtcacttacatggcactaggtctggctctacgatatgttcttgaagccttacgcaagccttttggatccaaaatgtattatttcgggattgctgcactagatagatttaaaaacagattgaaggactatccccagtattgtcagcatttggcttctatcagtcactttatgcaatttccacatcatttacaggagtatattgagtatggacagcagtctagagatcctcctgtgaaaatgcaaggctctatcacaacccctggaagtattgcactggctcaggcccaggctcaggcccaggttccagcaaaagctcctcttgctggtcaagttagcactatggtaaccacctcaacaactaccactgttgctaaaacggttacggtcaccaggccaactggagtcagctttaagaaagatgtgccaccttctattaatactacaaatatagatacgttgcttgtggccacagatcaaactgagagaattgtggagcccccagaaaatatccaggagaaaattgcttttattttcaataatctctcacagtcaaatatgacacaaaaggttgaagagctaaaggaaacggtgaaagaagaatttatgccttgggtttcacagtatctggttatgaagagagtcagtattgagccaaactttcatagcctgtattcaaacttccttgacacgctgaagaatcctgaatttaacaagatggttctgaatgagacctacagaaacattaaagtgctcctgacctctgataaagctgcagccaatttctcagatcgttctttgctgaagaacttgggacattggctaggaatgatcacattagctaaaaacaaacccatcttacacactgacttggatgtgaaatcattgctgctagaggcttatgttaaaggacaacaagaattgctctatgtagtgccctttgttgccaaagtcttagaatctagcattcgtagtgtggtttttaggccaccaaacccttggacaatggcaattatgaatgtattagctgagctacatcaggagcatgacttaaagttaaacttgaagtttgaaatcgaggttctctgcaagaaccttgcattagacatcaatgagctaaaacctggaaacctcctaaaggataaagatcgcctgaagaatttagatgagcaactctctgctccaaagaaagatgtcaagcagccagaagaactccctcccatcacaaccacaacaacttctactacaccagctaccaacaccacttgtacagccacggttccaccacagccacagtacagctaccacgacatcaatgtctattcccttgcgggcttggcaccacacattactctgaatccaacaattcccttgtttcaggcccatccacagttgaagcagtgtgtgcgtcaggcaattgaacgggctgtccaggagctggtccatcctgtggtggatcgatcaattaagattgccatgactacttgtgagcaaatagtcaggaaggattttgccctggattcggaggaatctcgaatgcgaatagcagctcatcacatgatgcgtaacttgacagctggaatggctatgattacatgcagggaacctttgctcatgagcatatctaccaacttaaaaaacagttttgcctcagcccttcgtactgcttccccacaacaaagagaaatgatggatcaggcagctgctcaattagctcaggacaattgtgagttggcttgctgttttattcagaagactgcagtagaaaaagcaggccctgagatggacaagagattagcaactgaatttgagctgagaaaacatgctaggcaagaaggacgcagatactgtgatcctgttgttttaacatatcaagctgaacggatgccagagcaaatcaggctgaaagttggtggtgtggacccaaagcagttggctgtttacgaagagtttgcacgcaatgttcctggcttcttacctacaaatgacttaagtcagcccacgggatttttagcccagcccatgaagcaagcttgggcaacagatgatgtagctcagatttatgataagtgtattacagaactggagcaacatctacatgccatcccaccaactttggccatgaaccctcaagctcaggctcttcgaagtctcttggaggttgtagttttatctcgaaactctcgggatgccatagctgctcttggattgctccaaaaggctgtagagggcttactagatgccacaagtggtgctgatgctgaccttctgctgcgctacagggaatgccacctcttggtcctaaaagctctgcaggatggccgggcatatgggtctccatggtgcaacaaacagatcacaaggtgcctaattgaatgtcgagatgaatataaatataatgtggaggctgtggagctgctaattcgcaatcatttggttaatatgcagcagtatgatcttcacctagcgcagtcaatggagaatggcttaaactacatggctgtggcatttgctatgcagttagtaaaaatcctgctggtggatgaaaggagtgttgctcatgttactgaggcagatctgttccacaccattgaaaccctcatgaggattaatgctcattccagaggcaatgctccagaaggattgccccagctgatggaagtagtgcgatccaactatgaagcaatgattgatcgtgctcatggaggcccaaactttatgatgcattctgggatctctcaagcctcagagtatgatgaccctccaggcctgagggagaaggcagagtatcttctgagggaatgggtgaatctctaccattcagcagcagctggccgcgacagtaccaaagctttctctgcatttgttggacagatgcaccagcaaggaatactgaagaccgatgatctcataacaaggttctttcgtctgtgtactgaaatgtgtgttgaaatcagttaccgtgctcaggctgagcagcagcacaatcctgctgccaatcccaccatgatccgagccaagtgctatcacaacctggatgcctttgttcgactcattgcactgctcgtgaaacactcaggggaggccaccaacactgtcacaaagattaatctgctgaacaaggtccttggtatagtagtgggagttctccttcaggatcatgatgttcgtcagagtgaatttcagcaacttccctaccatcgaatttttatcatgcttctcttggaactcaatgcacctgagcatgtgttggaaaccattaatttccagacacttacagctttctgcaatacattccacatcttgaggcctaccaaagctcctggctttgtatatgcctggcttgaactgatttcccatcggatatttattgcaagaatgctggcacatacgccacagcagaaggggtggcctatgtatgcacagctactgattgatttattcaaatatttagcgcctttccttagaaatgtggaactcaccaaacctatgcaaatcctctacaagggcactttaagagtgctgctggttcttttgcatgatttcccagagttcctttgtgattaccattatgggttctgtgatgtgatcccacctaattgtatccagttaagaaatttgatcctgagtgcctttccaagaaacatgaggctccccgacccattcactcctaatctaaaggaaataatgtta

SEQ ID NO: 4936 - DNA, 6223 bp, Homo sapiens
gcgacctccggcgccattttgtagagaaacaagcggagttaaccgaagagggggtcgaggagagccggagtcggggacccaggagtttcctgtgtccagcgctgccggagccgcctgaggtgccatgtttcagaacagagtaagacccctggtaaagaagaactgaagatattatacagataccagatatagcctaattacaaagaaagcattaacctgcctctgaggtgactaaaggggaataatggtgattttgcgccgggctcggccgcctgcttccgccccaaccagcaatgaatcttgactcgctctcgctggccttgtctcaaatcagctacctggtggacaatttaaccaagaaaaattaccgagccagccagcaggaaatacagcatattgtgaatcggcacggtcctgaggcagacaggcatttattacgctgcctattttcgcatgtggatttcagtggcgatggtaaaagcagtggcaaagatttccatcagactcagtttctgattcaggagtgtgcgttgctgattacaaagccaaattttatctcgacgctgtcctatgccattgataatccattgcactatcagaagagtttaaagcctgcaccccacttatttgcccagctgagtaaagtgctcaaattaagcaaagtacaagaggtaatttttggccttgccctgttgaattcttccagctcagatcttagaggtttcgctgcccagtttatcaaacagaagcttccagatcttctgcgttcttacattgacgcagacgtcagtggaaatcaagaaggtggcttccaagatatagcaatagaggtcctacacctcctcctctcccatctcctctttgggcagaagggagcctttggagttggacaagaacagatagacgcttttcttaagacgctgcgcagagattttccccaagaacgctgtcccgtggtgctcgcaccacttttataccctgaaaaacgggacattctaatggacaggatcctgcctgattccggaggggtagctaaaaccatgatggagagctctttggctgatttcatgcaagaagtaggctatggcttttgtgcaagtattgaagaatgtcgcaatataatcgtgcagtttggtgttcgggaggtcacagctgcccaggttgcaagggttttgggaatgatggctcgaactcattcaggattaacagatggcattccattacagagtatttctgctccgggcagtgggatctggagtgatgggaaagataaaagtgatggagcacaggcacacacatggaatgtagaagtcttgattgacgttcttaaagaactgaatccaagtttgaatttcaaggaagtaacttatgaactggaccatcctggatttcaaattcgtgacagtaaaggacttcataatgtggtttatggcattcagaggggtttgggtatggaagtgttcccagtagacctcatatatagaccttggaaacatgctgaaggccagctctccttcattcaacattcccttataaatccagagatcttctgttttgctgactatccctgtcatactgttgccactgatattctgaaagcaccaccagaggatgacaatcgagaaattgccacatggaagagcttggatttgattgaatctctgctgaggcttgcagaggttgggcagtatgagcaagtcaaacagctcttcagcttccctatcaaacactgtccagacatgctggtattggccttactacaaattaacacctcttggcataccttgcgccatgaacttatctccactctgatgccaattttccttggaaaccatcctaactcagctattattttgcactatgcatggcatgggcagggacagtctccctcaattcgccaacttatcatgcatgcaatggcagaatggtacatgagaggggagcagtatgatcaggccaaattgtctcgaatacttgatgtggcccaggacttgaaggccttgtcaatgctgctaaatggtactccatttgcctttgttattgaccttgctgcacttgcttcacgtcgtgaatacctcaaacttgataagtggctcacagataaaattcgagagcatggggagccttttatccaggcgtgtatgacttttttaaagagacggtgtccttctattttgggcggacttgccccagaaaaagaccagcccaaaagtgctcaacttcctccagaaactttggcgacaatgttggcctgtctgcaagcttgtgcagggagtgtttctcaggagctatcagaaactatcctcaccatggtagccaattgcagtaatgttatgaataaggccagacaaccaccacctggagttatgccaaaaggacgtcctcctagtgctagcagcttagatgccatttctcctgttcagattgaccctcttgctggaatgacatctcttagtataggtggttcagctgcccctcacacccagagtatgcagggttttcctccaaatttgggttctgcattcagtacccctcagtcaccagcaaaagcatttccacccctttcaacccccaatcagaccactgcattcagtggtattggaggactttcatcacagcttccagtaggtggtcttggcacaggcagcctgactggtataggaactggtgctcttggactccctgcagtgaataacgacccttttgtacagaggaaactgggcacctctggactgaatcagcctacattccagcagagtaagatgaaaccttcggacttgtctcaggtgtggccagaggcaaaccagcactttagtaaagagatagatgatgaagcaaacagctatttccagcgaatatataatcatccaccacatccaaccatgtctgttgatgaggtattagaaatgctgcagagatttaaagactctactataaagagggaacgagaagtatttaactgtatgctaaggaacttgtttgaagaatatcgtttttttccccagtatcctgataaagagttacatataacagcctgcctatttggtggtataattgagaaaggactggtcacttacatggcactaggtctggctctacgatatgttcttgaagccttacgcaagccttttggatccaaaatgtattatttcgggattgctgcactagatagatttaaaaacagattgaaggactatccccagtattgtcagcatttggcttctatcagtcactttatgcaatttccacatcatttacaggagtatattgagtatggacagcagtctagagatcctcctgtgaaaatgcaaggctctatcacaacccctggaagtattgcactggctcaggcccaggctcaggcccaggttccagcaaaagctcctcttgctggtcaagttagcactatggtaaccacctcaacaactaccactgttgctaaaacggttacggtcaccaggccaactggagtcagctttaagaaagatgtgccaccttctattaatactacaaatatagatacgttgcttgtggccacagatcaaactgagagaattgtggagcccccagaaaatatccaggagaaaattgcttttattttcaataatctctcacagtcaaatatgacacaaaaggttgaagagctaaaggaaacggtgaaagaagaatttatgccttgggtttcacagtatctggttatgaagagagtcagtattgagccaaactttcatagcctgtattcaaacttccttgacacgctgaagaatctcataacaaggttctttcgtctgtgtactgaaatgtgtgttgaaatcagttaccgtgctcaggctgagcagcagcacaatcctgctgccaatcccaccatgatccgagccaagtgctatcacaacctggatgcctttgttcgactcattgcactgctcgtgaaacactcaggggaggccaccaacactgtcacaaagattaatctgctgaacaaggtccttggtatagtagtgggagttctccttcaggatcatgatgttcgtcagagtgaatttcagcaacttccctaccatcgaatttttatcatgcttctcttggaactcaatgcacctgagcatgtgttggaaaccattaatttccagacacttacagctttctgcaatacattccacatcttgaggcctaccaaagctcctggctttgtatatgcctggcttgaactgatttcccatcggatatttattgcaagaatgctggcacatacgccacagcagaaggggtggcctatgtatgcacagctactgattgatttattcaaatatttagcgcctttccttagaaatgtggaactcaccaaacctatgcaaatcctctacaagggcactttaagagtgctgctggttcttttgcatgatttcccagagttcctttgtgattaccattatgggttctgtgatgtgatcccacctaattgtatccagttaagaaatttgatcctgagtgcctttccaagaaacatgaggctccccgacccattcactcctaatctaaaggtggacatgttgagtgaaattaacattgctccccggattctcaccaatttcactggagtaatgccacctcagttcaaaaaggatttggattcctatcttaaaactcgatcaccagtcactttcctgtctgatctgcgcagcaacctacaggtatccaatgaacctgggaatcgctacaacctccagctcatcaatgcactggtgctctatgtcgggactcaggccattgcgcacatccacaacaagggcagcacaccttcaatgagcaccatcactcactcagcacacatggatatcttccagaatttggctgtggacttggacactgagggtcgctatctctttttgaatgcaattgcaaatcagctccggtacccaaatagccacactcactacttcagttgcaccatgctgtacctttttgcagaggccaatacggaagccatccaagaacagatcacaagagttctcttggaacggttgattgtaaataggccacatccttggggtcttcttattaccttcattgagctgattaaaaacccagcgtttaagttctggaaccatgaatttgtacactgtgccccagaaatcgaaaagttattccagtcggtcgcacagtgctgcatgggacagaagcaggcccagcaagtaatggaagggacaggtgccagttagacgaaactgcatctctgttgtacgtgtcagtctagaggtctcactgcaccgagttcataaactgactgaagaatcctttcagctcttcctgactttcccagccctttggtttgtgggtatctgccccaactactgttgggatcagcctcctgtcttatgtgggcacgttccaaagtttaaatgcatttttttgactcttggccaaaatttagaagatgctgtgaatatcattttgaacttgtgtaaatacatgaaagagaaaacctttgtctggaacttcttggctttgtgcaagctgtgtccaaggcaagtacataaactggtaccttgtaatgaagaggcagctgatgccatgcacttgtctgagggcatagctccatgtcttctgacattcctggtgtcccaaagaatagcaaaaagccagtttgaatattatgtaacttatttttttaatgtggacaggggaccttgaaaatcactaagttattaaaaatgtggatgtgctagaattggatatgtccaggaacatgggaagggctcactattggaatcccatgagtttccattttgtctctacccaaacgtattccaaagctgactgcatttgtaccatcttatttcttttggggattatacacctcagccgcctgagatgggggtcagctctttatataaagggaaaccagaccaggcctaaagcccacccctaccctcacccccccaatcctctcctgaaacttaaaaacagtgggaatataggaaagggaaccaaatctcattaattaattgttctcccccattaccccactgaatgaatggccatacaggctaagctgaataatgacaaagttgaaaggaccaatacagccccttttataaggattttgaatgttttgcaaatgtattggtccctgtgttgtattttgtagccttttcctgggcttcagctcccctacttcttgtatgtgtatgcatactgtagctaaccattaaagtcatgacac

SEQ ID NO: 4937 - DNA, 4997 bp, Homo sapiens
gcgacctccggcgccattttgtagagaaacaagcggagttaaccgaagagggggtcgaggagagccggagtcggggacccaggagtttcctgtgtccagcgctgccggagccgcctgaggtgccatgtttcagaacagagtaagacccctggtaaagaagaactgaagatattatacagataccagatatagcctaattacaaagaaagcattaacctgcctctgaggtgactaaaggggaataatggtgattttgcgccgggctcggccgcctgcttccgccccaaccagcaatgaatcttgactcgctctcgctggccttgtctcaaatcagctacctggtggacaatttaaccaagaaaaattaccgagccagccagcaggaaatacagcatattgtgaatcggcacggtcctgaggcagacaggcatttattacgctgcctattttcgcatgtggatttcagtggcgatggtaaaagcagtggcaaagatttccatcagactcagtttctgattcaggagtgtgcgttgctgattacaaagccaaattttatctcgacgctgtcctatgccattgataatccattgcactatcagaagagtttaaagcctgcaccccacttatttgcccagctgagtaaagtgctcaaattaagcaaagtacaagaggtaatttttggccttgccctgttgaattcttccagctcagatcttagaggtttcgctgcccagtttatcaaacagaagcttccagatcttctgcgttcttacattgacgcagacgtcagtggaaatcaagaaggtggcttccaagatatagcaatagaggtcctacacctcctcctctcccatctcctctttgggcagaagggagcctttggagttggacaagaacagatagacgcttttcttaagacgctgcgcagagattttccccaagaacgctgtcccgtggtgctcgcaccacttttataccctgaaaaacgggacattctaatggacaggatcctgcctgattccggaggggtagctaaaaccatgatggagagctctttggctgatttcatgcaagaagtaggctatggcttttgtgcaagtattgaagaatgtcgcaatataatcgtgcagtttggtgttcgggaggtcacagctgcccaggttgcaagggttttgggaatgatggctcgaactcattcaggattaacagatggcattccattacagagtatttctgctccgggcagtgggatctggagtgatgggaaagataaaagtgatggagcacaggcacacacatggaatgtagaagtcttgattgacgttcttaaagaactgaatccaagtttgaatttcaaggaagtaacttatgaactggaccatcctggatttcaaattcgtgacagtaaaggacttcataatgtggtttatggcattcagaggggtttgggtatggaagtgttcccagtagacctcatatatagaccttggaaacatgctgaaggccagctctccttcattcaacattcccttataaatccagagatcttctgttttgctgactatccctgtcatactgttgccactgatattctgaaagcaccaccagaggatgacaatcgagaaattgccacatggaagagcttggatttgattgaatctctgctgaggcttgcagaggttgggcagtatgagcaagtcaaacagctcttcagcttccctatcaaacactgtccagacatgctggtattggccttactacaaattaacacctcttggcataccttgcgccatgaacttatctccactctgatgccaattttccttggaaaccatcctaactcagctattattttgcactatgcatggcatgggcagggacagtctccctcaattcgccaacttatcatgcatgcaatggcagaatggtacatgagaggggagcagtatgatcaggccaaattgtctcgaatacttgatgtggcccaggacttgaaggccttgtcaatgctgctaaatggtactccatttgcctttgttattgaccttgctgcacttgcttcacgtcgtgaatacctcaaacttgataagtggctcacagataaaattcgagagcatggggagccttttatccaggcgtgtatgacttttttaaagagacggtgtccttctattttgggcggacttgccccagaaaaagaccagcccaaaagtgctcaacttcctccagaaactttggcgacaatgttggcctgtctgcaagcttgtgcagggagtgtttctcaggagctatcagaaactatcctcaccatggtagccaattgcagtaatgttatgaataaggccagacaaccaccacctggagttatgccaaaaggacgtcctcctagtgctagcagcttagatgccatttctcctgttcagattgaccctcttgctggaatgacatctcttagtataggtggttcagctgcccctcacacccagagtatgcagggttttcctccaaatttgggttctgcattcagtacccctcagtcaccagcaaaagcatttccacccctttcaacccccaatcagaccactgcattcagtggtattggaggactttcatcacagcttccagtaggtggtcttggcacaggcagcctgactggtataggaactggtgctcttggactccctgcagtgaataacgacccttttgtacagaggaaactgggcacctctggactgaatcagcctacattccagcagagtaagatgaaaccttcggacttgtctcaggtgtggccagaggcaaaccagcactttagtaaagagatagatgatgaagcaaacagctatttccagcgaatatataatcatccaccacatccaaccatgtctgttgatgaggtattagaaatgctgcagagatttaaagactctactataaagagggaacgagaagtatttaactgtatgctaaggaacttgtttgaagaatatcgtttttttccccagtatcctgataaagagttacatataacagcctgcctatttggtggtataattgagaaaggactggtcacttacatggcactaggtctggctctacgatatgttcttgaagccttacgcaagccttttggatccaaaatgtattatttcgggattgctgcactagatagatttaaaaacagattgaaggactatccccagtattgtcagcatttggcttctatcagtcactttatgcaatttccacatcatttacaggagtatattgagtatggacagcagtctagagatcctcctgtgaaaatgcaaggctctatcacaacccctggaagtattgcactggctcaggcccaggctcaggcccaggttccagcaaaagctcctcttgctggtcaagttagcactatggtaaccacctcaacaactaccactgttgctaaaacggttacggtcaccaggccaactggagtcagctttaagaaagatgtgccaccttctattaatactacaaatatagatacgttgcttgtggccacagatcaaactgagagaattgtggagcccccagaaaatatccaggagaaaattgcttttattttcaataatctctcacagtcaaatatgacacaaaaggttgaagagctaaaggaaacggtgaaagaagaatttatgccttgggtttcacagtatctggttatgaagagagtcagtattgagccaaactttcatagcctgtattcaaacttccttgacacgctgaagaatcctgaatttaacaagatggttctgaatgagacctacagaaacattaaagtgctcctgacctctgataaagctgcagccaatttctcagatcgttctttgctgaagaacttgggacattggctaggaatgatcacattagctaaaaacaaacccatcttacacactgacttggatgtgaaatcattgctgctagaggcttatgttaaaggacaacaagaattgctctatgtagtgccctttgttgccaaagtcttagaatctagcattcgtagtgtggtttttaggccaccaaacccttggacaatggcaattatgaatgtattagctgagctacatcaggagcatgacttaaagttaaacttgaagtttgaaatcgaggttctctgcaagaaccttgcattagacatcaatgagctaaaacctggaaacctcctaaaggataaagatcgcctgaagaatttagatgagcaactctctgctccaaagaaagatgtcaagcagccagaagaactccctcccatcacaaccacaacaacttctactacaccagctaccaacaccacttgtacagccacggttccaccacagccacagtacagctaccacgacatcaatgtctattcccttgcgggcttggcaccacacattactctgaatccaacaattcccttgtttcaggcccatccacagttgaagcagtgtgtgcgtcaggcaattgaacgggctgtccaggagctggtccatcctgtggtggatcgatcaattaagattgccatgactacttgtgagcaaatagtcaggaaggattttgccctggattcggaggaatctcgaatgcgaatagcagctcatcacatgatgcgtaacttgacagctggaatggctatgattacatgcagggaacctttgctcatgagcatatctaccaacttaaaaaacagttttgcctcagcccttcgtgtaagttggctatttccttggtataggtacaaaacgtattactgcttgtctgtaataatttttttctttgtctatatatggcactgggcgttaccacttattcttaataatcaccatatttgtttgatgtcttccatcattttagattgtaattctgtgaggcaaagcatcatgtctgtgtgtttttttttttttctgttatattctcaacacgatgtttgacagatagtagatacccaaatatttgttggtttaaataaattaagattt

SEQ ID NO: 4938 - DNA, 2241 bp, Homo sapiens
aggtccttggtatagtagtgggagttctccttcaggatcatgatgttcgtcagagtgaatttcagcaacttccctaccatcgaatttttatcatgcttctcttggaactcaatgcacctgagcatgtgttggaaaccattaatttccagacacttacagctttctgcaatacattccacatcttgaggcctaccaaagctcctggctttgtatatgcctggcttgaactgatttcccatcggatatttattgcaagaatgctggcacatacgccacagcagaaggggtggcctatgtatgcacagctactgattgatttattcaaatatttagcgcctttccttagaaatgtggaactcaccaaacctatgcaaatcctctacaagggcactttaagagtgctgctggttcttttgcatgatttcccagagttcctttgtgattaccattatgggttctgtgatgtgatcccacctaattgtatccagttaagaaatttgatcctgagtgcctttccaagaaacatgaggctccccgacccattcactcctaatctaaaggtggacatgttgagtgaaattaacattgctccccggattctcaccaatttcactggagtaatgccacctcagttcaaaaaggatttggattcctatcttaaaactcgatcaccagtcactttcctgtctgatctgcgcagcaacctacaggtatccaatgaacctgggaatcgctacaacctccagctcatcaatgcactggtgctctatgtcgggactcaggccattgcgcacatccacaacaagggcagcacaccttcaatgagcaccatcactcactcagcacacatggatatcttccagaatttggctgtggacttggacactgagggtcgctatctctttttgaatgcaattgcaaatcagtccggtacccaaatagccacactcactacttcagttgcaccatgctgtacctttttgcagaggccaatacggaagccatccaagaacagatcacaagagttctcttggaacggttgattgtaaataggccacatccttggggtcttcttattaccttcattgagctgattaaaaacccagcgtttaagttctggaaccatgaatttgtacactgtgccccagaaatcgaaaagttattccagtcggtcgcacagtgctgcatgggacagaagcaggcccagcaagtaatggaagggacaggtgccagttagacgaaactgcatctctgttgtacgtgtcagtctagaggtctcactgcaccgagttcataaactgactgaagaatcctttcagctcttcctgactttcccagccctttggtttgtgggtatctgccccaactactgttgggatcagcctcctgtcttatgtgggcacgttccaaagtttaaatgcatttttttgactcttggccaaaatttagaagatgctgtgaatatcattttgaacttgtgtaaatacatgaaagagaaaacctttgtctggaacttcttggctttgtgcaagctgtgtccaaggcaagtacataaactggtaccttgtaatgaagaggcagctgatgccatgcacttgtctgagggcatagctccatgtcttctgacattcctggtgtcccaaagaatagcaaaaagccagtttgaatattatgtaacttatttttttaatgtggacaggggaccttgaaaatcactaagttattaaaaatgtggatgtgctagaattggatatgtccaggaacatgggaagggctcactattggaatcccatgagtttccattttgtctctacccaaacgtattccaaagctgactgcatttgtaccatcttatttcttttggggattatacacctcagccgcctgagatgggggtcagctctttatataaagggaaaccagaccaggcctaaagcccacccctaccctcacccccccaatcctctcctgaaacttaaaaacagtgggaatataggaaagggaaccaaatctcattaattaattgttctcccccattaccccactgaatgaatggccatacaggctaagctgaataatgacaaagttgaaaggaccaatacagccccttttataaggattttgaatgttttgcaaatgtattggtccctgtgttgtattttgtagccttttcctgggcttcagctcccctacttcttgtatgtgtatgcatactgtagctaaccattaaagtcatgacac

SEQ ID NO: 4939 - DNA, 3280 bp, Homo sapiens
aacacaaacacaaacacgaacacgaacacgctcagcgtccccggggagggcggactgaagccacctcaccattcatcgcccctggaccccgcagtccccctcggactcagggccagagccttctgcgaagcaacctagccccagggaaacggtagcggccgcagaagccccgctctctgtaacggccgcggaggagcagcaagcctccctgtgagtcggtgggagacaagacggagcggcggtaagggcggtagggaagtgaagcgcctctctccaccttgttagaagcgcgctgaaagcggcctgcctacccaccccatcgctgccgttttgcagtcgtcgctcccaccttccgctgccgcctggagggaagccggagcgacgggggtcacggcggcggtcagagggtaaaggtcttgctcccagcagcctccgcggtggatacgtcgccatcttggatccgcgggacaagaaaattcatgcgagggagacgtggtgggcggtccttcctgtgacacgacccttgagtgacagttctatttgattgcctccggtactgtgaggaaaggacacgactctatggtgaggactgatggacatacattatctgagaaaagaaactaccaggtgacaaacagcatgtttggtgcttcaagaaagaagtttgtagagggggtcgacagtgactaccatgacgaaaacatgtactacagccagtcttctatgtttccacatcggtcagaaaaagatatgctggcatcaccatctacatcaggtcagctgtctcagtttggggcaagtttatacgggcaacaaagtgcactaggccttccaatgagggggatgagcaacaatacccctcagttaaatcgcagcttatcacaaggcactcagttaccgagccacgtcacgccaacaacaggggtaccaacaatgtcacttcacacgcctccatctccaagcaggggtattttgcctatgaatcctaggaatatgatgaaccactcccaggttggtcagggcattggaattcctagcaggacaaatagcatgagcagttcagggttaggtagccccaacagaagctcgccaagcataatatgtatgccaaagcagcagccttctcgacagccttttactgtgaacagtatgtctggatttggaatgaacaggaatcaggcatttggaatgaataactccttatcaagtaacatttttaatggaacagacggaagtgaaaatgtgacaggattggacctttcagatttcccagcattagcagaccgaaacaggagggaaggaagtggtaacccaactccattaataaaccccttggctggaagagctccttatgttggaatggtaacaaaaccagcaaatgaacaatcccaggacttctcaatacacaatgaagattttccagcattaccaggctccagctataaagatccaacatcaagtaatgatgacagtaaatctaatttgaatacatctggcaagacaacttcaagtacagatggacccaaattccctggagataaaagttcaacaacacaaaataataaccagcagaaaaaagggatccaggtgttacctgatggtcgggttactaacattcctcaagggatggtgacggaccaatttggaatgattggcctgttaacatttatcagggcagcagagacagacccaggaatggtacatcttgcattaggaagtgacttaacaacattaggcctcaatctgaactctcctgaaaatctctaccccaaatttgcgtcaccctgggcatcttcaccttgtcgacctcaagacatagacttccatgttccatctgagtacttaacgaacattcacattagggataagctggctgcaataaaacttggccgatatggtgaagaccttctcttctatctctattacatgaatggaggagacgtattacaacttttagctgcagtggagctttttaaccgtgattggagataccacaaagaagaacgagtatggattaccagggcaccaggcatggagccaacaatgaaaaccaatacctatgagaggggaacatattacttctttgactgtcttaactggaggaaagtagctaaggagttccatctggaatatgacaaattagaagaacggcctcacctgccatccaccttcaactacaaccctgctcagcaagccttctaaaaaaaaaaaaaaaaaaaaaaaaagacttcccttttcttggggtatggctgtctcagcacaatactcaacataactgcagaactgatgtggctcaggcaccctggttttaattccttgaggatctggcaattggcttacgcaaaaggtcaccatttgaggtcctgccttactaattatgtgctgcccaacaactaaatttgtaatttgtttttctctagtttgagcagggtctgaattttttcatttatttccttttttgccagcagacagacttgagtctgtaaagacaagcaaatacactgacagaagtttaccatagtttctaaaatgtaaaaaagaaaacccccaaaagactcaagaaaattagaccacaaattttgcattgttcattgtagcactattggtaataaaataacaaatgtttgtgcatttttatgtgaagatccttctcgtatttcatttggaaagatgagcaagaggtctgcttccttcattttacttccccttctgtttttgaaaggcagtttcgccaagcttaatgcaagaatatctgactgtttagaagaaagatattgccacaatctctggatggttttccagggttgtgttattactgagcttcatctttccagaatgagcaaaacactgtccagtctttgttacgattttgtaataaatgtgtacattttttttaaatttttggacatcacatgaataaaggtatgtatgtacgaatgtgtatatattatatatatgacatctattttggaaaatgtttgccctgctgtacctcatttttaggaggtgtgcatggatgcaatatatgaaaatgggacattctggaactgctggtcaggggactttgtcgccctgtgcactaaaagggccagattttcagcagccaaggacatccatacccaagtgaatgtgatgggacttaaaagaagtgaactgagacaattcactctggctgtttgaacagcagcgtttcataggaagagaaaaaaagatcaatcttgtattttctgaccacataaaggcttcttctctttgtaataaagtagaaaagctctcctca

SEQ ID NO: 4940 - DNA, 3152 bp, Homo sapiens
agcgtccccggggagggcggactgaagccacctcaccattcatcgcccctggaccccgcagtccccctcggactcagggccagagccttctgcgaagcaacctagccccagggaaacggtagcggccgcagaagccccgctctctgtaacggccgcggaggagcagcaagcctccctgtgagtcggtgggagacaagacggagcggcgtcgtcgctcccaccttccgctgccgcctggagggaagccggagcgacgggggtcacggcggcggtcagagggtaaaggtcttgctcccagcagcctccgcggtggatacgtcgccatcttggatccgcgggacaagaaaattcatgcgagggagacgtggtgggcggtccttcctgtgacacgacccttgagtgacagttctatttgattgcctccggtactgtgaggaaaggacacgactctatggtgaggactgatggacatacattatctgagaaaagaaactaccaggtgacaaacagcatgtttggtgcttcaagaaagaagtttgtagagggggtcgacagtgactaccatgacgaaaacatgtactacagccagtcttctatgtttccacatcggtcagaaaaagatatgctggcatcaccatctacatcaggtcagctgtctcagtttggggcaagtttatacgggcaacaaagtgcactaggccttccaatgagggggatgagcaacaatacccctcagttaaatcgcagcttatcacaaggcactcagttaccgagccacgtcacgccaacaacaggggtaccaacaatgtcacttcacacgcctccatctccaagcaggggtattttgcctatgaatcctaggaatatgatgaaccactcccaggttggtcagggcattggaattcctagcaggacaaatagcatgagcagttcagggttaggtagccccaacagaagctcgccaagcataatatgtatgccaaagcagcagccttctcgacagccttttactgtgaacagtatgtctggatttggaatgaacaggaatcaggcatttggaatgaataactccttatcaagtaacatttttaatggaacagacggaagtgaaaatgtgacaggattggacctttcagatttcccagcattagcagaccgaaacaggagggaaggaagtggtaacccaactccattaataaaccccttggctggaagagctccttatgttggaatggtaacaaaaccagcaaatgaacaatcccaggacttctcaatacacaatgaagattttccagcattaccaggctccagctataaagatccaacatcaagtaatgatgacagtaaatctaatttgaatacatctggcaagacaacttcaagtacagatggacccaaattccctggagataaaagttcaacaacacaaaataataaccagcagaaaaaagggatccaggtgttacctgatggtcgggttactaacattcctcaagggatggtgacggaccaatttggaatgattggcctgttaacatttatcagggcagcagagacagacccaggaatggtacatcttgcattaggaagtgacttaacaacattaggcctcaatctgaactctcctgaaaatctctaccccaaatttgcgtcaccctgggcatcttcaccttgtcgacctcaagacatagacttccatgttccatctgagtacttaacgaacattcacattagggataagctggctgcaataaaacttggccgatatggtgaagaccttctcttctatctctattacatgaatggaggagacgtattacaacttttagctgcagtggagctttttaaccgtgattggagataccacaaagaagaacgagtatggattaccagggcaccaggcatggagccaacaatgaaaaccaatacctatgagaggggaacatattacttctttgactgtcttaactggaggaaagtagctaaggagttccatctggaatatgacaaattagaagaacggcctcacctgccatccaccttcaactacaaccctgctcagcaagccttctaaaaaaaaaaaaaaaaaaaaaaaaagacttcccttttcttggggtatggctgtctcagcacaatactcaacataactgcagaactgatgtggctcaggcaccctggttttaattccttgaggatctggcaattggcttacgcaaaaggtcaccatttgaggtcctgccttactaattatgtgctgcccaacaactaaatttgtaatttgtttttctctagtttgagcagggtctgaattttttcatttatttccttttttgccagcagacagacttgagtctgtaaagacaagcaaatacactgacagaagtttaccatagtttctaaaatgtaaaaaagaaaacccccaaaagactcaagaaaattagaccacaaattttgcattgttcattgtagcactattggtaataaaataacaaatgtttgtgcatttttatgtgaagatccttctcgtatttcatttggaaagatgagcaagaggtctgcttccttcattttacttccccttctgtttttgaaaggcagtttcgccaagcttaatgcaagaatatctgactgtttagaagaaagatattgccacaatctctggatggttttccagggttgtgttattactgagcttcatctttccagaatgagcaaaacactgtccagtctttgttacgattttgtaataaatgtgtacattttttttaaatttttggacatcacatgaataaaggtatgtatgtacgaatgtgtatatattatatatatgacatctattttggaaaatgtttgccctgctgtacctcatttttaggaggtgtgcatggatgcaatatatgaaaatgggacattctggaactgctggtcaggggactttgtcgccctgtgcactaaaagggccagattttcagcagccaaggacatccatacccaagtgaatgtgatgggacttaaaagaagtgaactgagacaattcactctggctgtttgaacagcagcgtttcataggaagagaaaaaaagatcaatcttgtattttctgaccacataaaggcttcttctctttgtaataaagtagaaaagctctcctca

SEQ ID NO: 4941 - DNA, 582 bp, Homo sapiens
aaacacaaacacgaacacgaacacgctcagcgtccccggggagggcggactgaagccacctcaccattcatcgcccctggaccccgcagtccccctcggactcagggccagagccttctgagcagcaagcctccctgtgagtcggtgggagacaagacggagcggcggtaagggcggtagggaagtgaagcgcctctctccaccttgttagaagcgcgctgaaagcggcctgcctacccaccccatcgctgccgttttgcagtcgtcgctcccaccttccgctgccgcctggagggaagccggagcgacgggggtcacggcggcggtcagagggtaaaggtcttgctcccagcagcctccgcggtggatacgtcgccatcttggatccgcgggacaagaaaattcatgcgagggagacgtggtgggcggtccttcctgtgacacgacccttgagtgacagttctatttgattgcctccggtactgtgaggaaaggacacgactctatggtgaggactgatggacatacattatctgagaaaagaaactaccaggtgacaaacagcatgtttggtgcttcaag

SEQ ID NO: 4942 - DNA, 1085 bp, Homo sapiens
gtcgctgtactcgggccgctgcagcagcagcagctccagatcctaggcccggtcccatccgcgagtggtggggcttccccagactccactcccctaggctcccgccagcgcggaggagccgctgccgccgcgctgcttcctgggggagaagagaaggcggcagcggccgtggccgtggccgacgagctcgagcccgctttagacggctctgccgccttcccggcagctggtgctgtctgtggcttcttaccttctctcaatacacgtatatcatctgccagttatgtgtatttctgttagtgtgtttgcaagtgtcagatgggagacactggactggctaacgggtgtcaggatcctgcaggccctgggataccgaaggctgtgcatggtggagggagaaggaatgcaactgcgatgccgcctctgccaccgcaccaggaagagggagacgtggtgggcggtccttcctgtgacacgacccttgagtgacagttctatttgattgcctccggtactgtgaggaaaggacacgactctatggtgaggactgatggacatacattatctgagaaaagaaactaccaggtgacaaacagcatgtttggtgcttcaagaaagaagtttgtagagggggtcgacagtgactaccatgacgaaaacatgtactacagccagtcttctatgtttccacatcggtcagaaaaagatatgctggcatcaccatctacatcaggtcagctgtctcagtttggggcaagtttatacgggcaacaaagtgcactaggccttccaatgagggggatgagcaacaatacccctcagttaaatcgcagcttatcacaaggcactcagttaccgagccacgtcacgccaacaacaggggtaccaacaatgtcacttcacacgcctccatctccaagcaggggtattttgcctatgaatcctaggaatatgatgaaccactcccaggttggtcagggcattggaattcctagcaggacaaatagcatgagcagttcagggttaggtagccccaacagaagctcgccaagcataatatgtatgccaaagcagcagccttctcg

SEQ ID NO: 4943 - DNA, 2288 bp, Homo sapiens
gctgtactcgggccgctgcagcagcagcagctccagatcctaggcccggtcccatccgcgagtggtggggcttccccagactccactcccctaggctcccgccagcgcggaggagccgctgccgccgcgctgcttcctgggggagaagagaaggcggcagcggccgtggccgtggccgacgagctcgagcccgctttagacggctctgccgccttcccggcagctggtgctgtctgtggcttcttaccttctctcaatacacgtatatcatctgccagttatgtgtatttctgttagtgtgtttgcaagtgtcagatgggagacactggactggctaacgggtgtcaggatcctgcaggccctgggataccgaaggctgtgcatggtggagggagaaggaatgcaactgcgatgccgcctctgccaccgcaccaggaaggtgaagcttccgtagtgtcgtagactgagtccggatgatcctggggcggcggaggaaccacagacgcttctgtctgtgaagttgcaagtcctgggtttctacttccgcaggggcctctccaccttttgctgtcagggagacgtggtgggcggtccttcctgtgacacgacccttgagtgacagttctatttgattgcctccggtactgtgaggaaaggacacgactctatggtgaggactgatggacatacattatctgagaaaagaaactaccaggtgacaaacagcatgtttggtgcttcaagaaagaagtttgtagagggggtcgacagtgactaccatgacgaaaacatgtactacagccagtcttctatgtttccacatcggtcagaaaaagatatgctggcatcaccatctacatcaggtcagctgtctcagtttggggcaagtttatacgggcaacaaagtgcactaggccttccaatgagggggatgagcaacaatacccctcagttaaatcgcagcttatcacaaggcactcagttaccgagccacgtcacgccaacaacaggggtaccaacaatgtcacttcacacgcctccatctccaagcaggggtattttgcctatgaatcctaggaatatgatgaaccactcccaggttggtcagggcattggaattcctagcaggacaaatagcatgagcagttcagggttaggtagccccaacagaagctcgccaagcataatatgtatgccaaagcagcagccttctcgacagccttttactgtgaacagtatgtctggatttggaatgaacaggaatcaggcatttggaatgaataactccttatcaagtaacatttttaatggaacagacggaagtgaaaatgtgacaggattggacctttcagatttcccagcattagcagaccgaaacaggagggaaggaagtggtaacccaactccattaataaaccccttggctggaagagctccttatgttggaatggtaacaaaaccagcaaatgaacaatcccaggacttctcaatacacaatgaagattttccagcattaccaggctccagctataaagatccaacatcaagtaatgatgacagtaaatctaatttgaatacatctggcaagacaacttcaagtacagatggacccaaattccctggagataaaagttcaacaacacaaaataataaccagcagaaaaaagggatccaggtgttacctgatggtcgggttactaacattcctcaagggatggtgacggaccaatttggaatgattggcctgttaacatttatcagggcagcagagacagacccaggaatggtacatcttgcattaggaagtgacttaacaacattaggcctcaatctgaactctcctgaaaatctctaccccaaatttgcgtcaccctgggcatcttcaccttgtcgacctcaagacatagacttccatgttccatctgagtacttaacgaacattcacattagggataagctggctgcaataaaacttggccgatatggtgaagaccttctcttctatctctattacatgaatggaggagacgtattacaacttttagctgcagtggagctttttaaccgtgattggagataccacaaagaagaacgagtatggattaccagggcaccaggcatggagccaacaatgaaaaccaatacctatgagaggggaacatattacttctttgactgtcttaactggaggaaagtagctaaggagttccatctggaatatgacaaattagaagaacggcctcacctgccatccaccttcaactacaaccctgctcagcaagccttct

SEQ ID NO: 4944 - DNA, 4753 bp, Homo sapiens
gtcaacaaagtaatcttgagataacagttactgtttgagattcttacagttgtgaaatttggagaaaactaaaaattaattgggaagtggcaaaataaattgaaaatggtaaaacaaaaattaaaagctatagcgcaggctaaaaggacggtagaaagttttcttcaaaaattaagaacccaaggttataagaatactaaaaagttaagaaattgagatgattaaaatagacaaagtagagaagttgggttaaattttaatttttaaaggaagccagctgattgttttaacttaaaatgaacaaaaatacatttaatttattctatatatatttattgagcgcctactgtgtaataggtaatataaacttctgggctttgtatcatatttctatatttcctatccatttaccatatatgggaaccctactgccaccctgttgtaccccaccctcaaaatgcgcacatgcgcacgcacacacgtttgtatatgaaagcggtcaattacaggtggaagtcctcagggcttctgcttcactgcctgtgcctcagctatatctttctggccatttgcaggaggcactatcattgtcaccatttgtgtgtaaccgaagcttcaagcattctagatataacctccatctgagcataatgaaaagacaagttatatcgtaacaatctccctcttgttagctcacaagctataattttaggttaccatcttccatgggggaaatatatgctttttattctctttgttacatctctaggatttggggtttctattatgctggttgcgtattcctttgctaaattgttcatggaattctttgacatgaaatcaatctgcaagtatcttttgagcacctacatacacctagtacagtgccgtgcattatttaggaagaaggcgcaatcatttcgaattatattatggttggtttttataatctcttaaaaaatatttgtagaatcaataaccagtgtcctttcttattatttagacggaagtgaaaatgtgacaggattggacctttcagatttcccagcattagcagaccgaaacaggagggaaggaagtggtaacccaactccattaataaaccccttggctggaagagctccttatggtaattaagctttttaatgatggccagtagaaagtttccattgtatgtgcacacacatatacatttacatgtacgtatacatatgcttgtgtgtgtacacatgtatgtttgcattttctaatcaggttagtgtaattttttcagaattgatatattagaagtgatttttcttcccagaataccatgatagcaaagttaaatgggaaaactttgtacaaaaacccaagaggaagtcctcattggtattcagaagttattttcttctgttatccctgccttagtttaccttaagtgttttattttgtggtctgccttttctctccttaattgatcacacattttttcaaaataatatattcctggtgattaataatgactgactatacattgaagatgtttttctgagccaaggtttttctcaacctccacactgttgacatttgggccaggtaattctttgtagagaggagatgtggggggctattgtgtttatacagaatgttaagcaatattcctggccttggcctacaagatgctagtagcactttctgtttctaacccccatagcctctattgtgacagacacaaatgttttcagacattggcagatgtcacctggggaaaaaaaattgccccctgttgaaaaccattgctcatgggtcatgtatagcttatgcagactcttggtctccgttaatatccttcatcaccctttttcactgtctctaatagataagaaatttggctaatcagggataaatggaaataaaggaggggaaacatatgcaataacaatataacaatgtagatatgaaaattctgtgacagcaatgtagctatactatttttatcacatagtttttttcttttgggaaaacctgatagagaccagtaacaaaacggtgaatttaaaagaatcagttcatccattattttaagatagaattaatatttgatcacattttcaaccaagaaggatttctgtgccattcagatatgaatacaaataacagtatatgaagaagggaaacatttattgtttatattctaaagtttccaaattagtctccccaaaataaaaaaaaaaatgatctgccctggaagttgagtacctagctacttgattctcagttcagactctaatgtttttaacctttcctcataggtccattttttcatccctttaatcattcccgttgctctccttggaccatctctagtttctccatatcgttcttgaattgtggagccccaaactggatattgttctccaataagggcccgactaatgccaagtatagtgggaggattatttcccagttcttgcatgttttacatctataacatggagtccaagaaaatctgaaataatatggagttgttttataattgattgcaatttgctcactctgtaagtcgctttcaagtagaatactgacatattcttttaaattttattttgttcatttgtatttgagagttaactggtatttataatatctagtcaaatatttaaataaaacaagcttttaaaccaaaattgttaataattaatccaatatcaaattaaatttttaagcacctacgcatgacatggattactgttgatttcccttgtattattttgtatgttgagttattaatcagtaaatgaaaatttagttcttcattgttaccctggatactaattttttgaagtacgctttcatagcattaaaaaaaagaaaccttttggtgtattatcatgaggaaagttaactttataatctgtagcaaaatatcataaatatcaattgcaattctccggattattttcattacatagttggaatggtaacaaaaccagcaaatgaacaatcccaggacttctcaatacacaatgaagattttccagcattaccaggctccagctataaagatccaacatcaagtaatgatgacagtaaatctgtaagtaactgagaagtgtgtatgtgagtgatgtagtttttcccttcagatttctcttatattaacaattacttactaaatactattacaaaactgttttatcttgatatctgtaataacctaacttctgaagaatgtggaaaagctttataacttagaagatagcctatttttttcctatttcatataggtttgcaaatttctgttgaacttctcagagttaatttagacttttattgtagtccctgtcagctggatcccatgaagtttgataatatagccttctaaggagctgtgtttttcttgagtaagttttctccttgaagaatttatacacatttttatacctgtgttgattcaaccaactcagcttcttctttctgacttaacaaatatgtttatttcttccacatttcactgaaaatagcttttctctgtgtgtgatgggagtttatatattattaaaataattgataaagaagatcggtaagaattaaaataagtacaaagttttaaagcttgtatgtctaacttatcttcaaggtagctttggtgattttaggtaatatactatatttagtttctcttttacatgaaagcattgaggagtgtaacttcaagtgtatcccaaagcataaagacctgagaaagagatagatttttttttttctgtgactgaagatctgagataaataagatattttcccttgatttctttttctttaaatactcaaatgtggatgatataggatttatttgtataccatggaacaatgatggaaacaattttctatagaacttgaaaaacaggtaataatttaactaccaatttaaatgtaataaagaataaatagcaaggtattaatatgtgaacttgaatttgtatacttaacaaattttaatgtcacatttaatttttttcatgctagaatttgaatacatctggcaagacaacttcaagtacagatggacccaaattccctggagataaaagttcaacaacacaaaataataaccagcagaaaaaagggatccaggtgttacctgatggtcgggttactaacattcctcaagggatggtgacggaccaatttggaatgattggcctgttaacatttatcagggcagcagagacagacccaggaatggtacatcttgcattaggaagtgacttaacaacattaggcctcaatctgaactctcctgaaaatctctaccccaaatttgcgtcaccctgggcatcttcaccttgtcgacctcaagacatagacttccatgttccatctgagtacttaacgaacattcacattagggataagctggctgcaataaaacttggccgatatggtgaagaccttctcttctatctctattacatgaatggaggagacgtattacaacttttagctgcagtggagctttttaaccgtgattggagataccacaaagaagaacgagtatggattaccagggcaccaggcatggagccaacaatgaaaaccaatacctatgagaggggaacatattacttctttgactgtcttaactggaggaaagtagctaaggagttccatctggaatatgacaaattagaagaacggcctcacctgccatccaccttcaactacaaccctgctcagcaagccttctaaaaaaaaaaaaaaaaaaaaaaaa

SEQ ID NO: 4945 - DNA, 1545 bp, Homo sapiens
acaaacacaaacacaaacacgaacacgaacacgctcagcgtccccggggagggcggactgaagccacctcaccattcatcgcccctggaccccgcagtccccctcggactcagggccagagccttctgcgaagcaacctagccccagggaaacggtagcggccgcagaagccccgctctctgtaacggccgcggaggagcagcaagcctccctgtgagtcggtgggagacaagacggagcggcggtaagggcggtagggaagtgaagcgcctctctccaccttgttagaagcgcgctgaaagcggcctgcctacccaccccatcgctgccgttttgcagtcgtcgctcccaccttccgctgccgcctggagggaagccggagcgacgggggtcacggcggcggtcagagggtaaaggtcttgctcccagcagcctccgcggtggatacgtcgccatcttggatccgcgggacaagaaaattcatgcgagggagacgtggtgggcggtccttcctgtgacacgacccttgagtgacagttctatttgattgcctccggtactgtgaggaaaggacacgactctatggtgaggactgatggacatacattatctgagaaaagaaactaccaggtgacaaacagcatgtttggtgcttcaagaaagaagtttgtagagggggtcgacagtgactaccatgacgaaaacatgtactacagccagtcttctatgtttccacatcggtcagaaaaagatatgctggcatcaccatctacatcaggtcagctgtctcagtttggggcaagtttatacgggcaacaaagtgcactaggccttccaatgagggggatgagcaacaatacccctcagttaaatcgcagcttatcacaaggcactcagttaccgagccacgtcacgccaacaacaggggtaccaacaatgtcacttcacacgcctccatctccaagcaggggtattttgcctatgaatcctaggaatatgatgaaccactcccaggttggtcagggcattggaattcctagcaggacaaatagcatgagcagttcagggttaggtagccccaacagaagctcgccaagcataatatgtatgccaaagcagcagccttctcgacagccttttactgtgaacagtatgtctggatttggaatgaacaggaatcaggcatttggaatgaataactccttatcaagtaacatttttaatggaacagacggaagtgaaaatgtgacaggattggacctttcagatttcccagcattagcagaccgaaacaggagggaaggaagtggtaacccaactccattaataaaccccttggctggaagagctccttatgttggaatggtaacaaaaccagcaaatgaacaatcccaggacttctcaatacacaatgaagattttccagcattaccaggctccagctataaagatccaacatcaagtaatgatgacagtaaatctaatttgaatacatctggcaagacaacttcaagtacagatggacccaaattccctggagataaa

SEQ ID NO: 4946 - DNA, 2852 bp, Homo sapiens
gaagagaggaggggaggcctcctccgccgccgccatcttggaccgggcccggtcagcttccgcggagccatcggcagacgccgcggcctcccttgagccccgacccccgtcgtcagaacaaccccgggcccactcccccaaccccacttccgcttcgcgccgctatcgcgatagcgcccgggcccggggcgcgagaaaaaggcggcgggcgctcgcctcccccgcctgtcgcgatacgctcctcagcggcggcgccagctcctgtgcgtccgtctccaagagagtatgaagagagtgcgtctgtagggcagggaagatggcggacaagcgcaaactccaaggtgagattgatcgctgcctcaagaaggtgtccgagggcgtggagcagtttgaagatatttggcagaagctccacaatgcagccaacgcgaaccagaaagaaaagtatgaggctgacctaaagaaggagattaagaagctacaacggctgagggaccaaatcaagacatgggtagcgtccaacgagatcaaggacaagaggcagcttatagacaaccgcaagctcattgagacgcaaatggaacggttcaaagttgtggaacgagagaccaaaaccaaagcttacagcaaagagggcctgggcctggcccagaaggtagatcctgcccagaaggagaaggaagaggttggccagtggctcacgaataccatcgacacgctcaacatgcaggtggaccagtttgagagtgaagtggagtcactgtcagtgcagacacgcaagaagaagggcgacaaggataagcaggaccggattgagggcttgaagcggcacatcgagaagcaccgctaccacgtgcgcatgctagagaccatcctgcgcatgctggacaatgactccatcctcgttgacgccatccgcaagatcaaggacgacgttgagtactatgttgactcatcccaggaccccgacttcgaggagaacgagtttctctacgatgacctggacctcgaggacattccacaggcgctggtcgccacctcccctcccagccacagccacatggaggatgagatcttcaaccagtccagcagcacgcccacctcaaccacctccagctctcccatcccgcccagcccagccaactgtaccacggaaaactctgaagatgataagaagaggggacgttccacagacagtgaagtcagccagtctccagccaaaaacggctccaagcctgtccacagcaaccagcaccctcagtccccagctgtgccgcccacctacccctccggccccccgcctgctgcctctgccttgagcaccactcctggcaacaatggggtccccgcccccgcagcacccccaagtgccctgggccccaaggccagtccagctcccagccacaactcgggcacccctgctccctatgcccaggctgtggccccaccagctcccagtgggcccagcacgacccagccccggccccccagcgtccagcctagcggaggcggaggcggcggcagcggaggtggagggagcagcagcagtagtaacagcagtgccggtggaggggctggcaagcagaatggcgccaccagttacagctcagttgtggcagacagcccggcagaggtggctttgagcagcagtgggggcaacaatgccagcagccaggccttgggccccccttccggcccccacaacccacctcccagcacctcgaaggaacccagtgcggcagccccaacgggggctgggggcgtggccccaggctcagggaacaactcagggggacccagcctcctggtgccactgcctgtgaatcctcccagctccccaacgcccagcttcagtgatgccaaggcagccggtgccctgctcaatgggcctccacagttcagcaccgccccagaaatcaaggcccctgagcctctgagctccttgaagtccatggcggaacgggcagccatcagctctggcattgaggaccctgtgccaacgctgcacctgaccgagcgagacatcatcctgagcagtacatcagcacctccggcctcagcccagccgcccctgcagctgtcagaggtgaacataccgctgtcgctgggtgtctgtccactgggccctgtgcccctcaccaaggagcagctctatcagcaggccatggaagaggccgcctggcaccacatgcctcacccctctgactctgagcgtattcggcagtacctcccccggaacccctgtccgacgcccccctaccaccaccagatgccacccccacactcggacactgtggaattctaccagcgcctgtcgaccgagacactcttcttcatcttctactatctggagggcactaaggcacagtatctggcagccaaggccctaaagaagcagtcatggcgattccacaccaagtacatgatgtggttccagaggcacgaggagcccaagaccatcactgacgagtttgagcagggcacctacatctactttgactacgagaagtggggccagcggaagaaggaaggcttcacctttgagtaccgctacctggaggaccgggacctccagtgacaccggcccctccctctacccacccccttcccccgcatgctgatccccctgcccaggtgagggccctgccctggaagactggagggaggccccaagccacggggcatccccctctcccaggaagcagggagggggccgggaggttttcctctcagccccaccctgggggcccgggggcgagggctgccccctcctcccctccccagtgagggacattttttggtaaacctattttcattttggaaaatatttatgaataaatagttttatatga

SEQ ID NO: 4947 - DNA, 2570 bp, Homo sapiens
gaggaggggaggcctcctccgccgccgccatcttggaccgggcccggtcagcttccgcggagccatcggcagacgccgcggcctcccttgagccccgacccccgtcgtcagaacaaccccgggcccactcccccaaccccacttccgcttcgcgccgctatcgcgatagcgcccgggcccggggcgcgagaaaaaggcggcgggcgctcgcctcccccgcctgtcgcgatacgctcctcagcggcggcgccagctcctgtgcgtccgtctccaagagagtatgaagagagtgcgtctgtagggcagggaagatggcggacaagcgcaaactccaaggtgagattgatcgctgcctcaagaaggtgtccgagggcgtggagcagtttgaagatatttggcagaagctccacaatgcagccaacgcgaaccagaaagaaaagtatgaggctgacctaaagaaggagattaagaagctacaacggctgagggaccaaatcaagacatgggtagcgtccaacgagatcaaggacaagaggcagcttatagacaaccgcaagctcattgagacgcaaatggaacggttcaaagttgtggaacgagagaccaaaaccaaagcttacagcaaagagggcctgggcctggcccagaaggtagatcctgcccagaaggagaaggaagaggttggccagtggctcacgaataccatcgacacgctcaacatgcaggtggaccagtttgagagtgaagtggagtcactgtcagtgcagacacgcaagaagaagggcgacaaggataagcaggaccggattgagggcttgaagcggcacatcgagaagcaccgctaccacgtgcgcatgctagagaccatcctgcgcatgctggacaatgactccatcctcgttgacgccatccgcaagatcaaggacgacgttgagtactatgttgactcatcccaggaccccgacttcgaggagaacgagtttctctacgatgacctggacctcgaggacattccacaggcgctggtcgccacctcccctcccagccacagccacatggaggatgagatcttcaaccagtccagcagcacgcccacctcaaccacctccagctctcccatcccgcccagcccagccaactgtaccacggaaaactctgaagatgataagaagaggggacgttccacagacagtgaagtcagccagtctccagccaaaaacggctccaagcctgtccacagcaaccagcaccctcagtccccagctgtgccgcccacctacccctccggccccccgcctgctgcctctgccttgagcaccactcctggcaacaatggggtccccgcccccgcagcacccccaagtgccctgggccccaaggccagtccagctcccagccacaactcgggcacccctgctccctatgcccaggctgtggccccaccagctcccagtgggcccagcacgacccagccccggccccccagcgtccagcctagcggaggcggaggcggcggcagcggaggtggagggagcagcagcagtagtaacagcagtgccggtggaggggctggcaagcagaatggcgccaccagttacagctcagttgtggcagacagcccggcagaggtggctttgagcagcagtgggggcaacaatgccagcagccaggccttgggccccccttccggcccccacaacccacctcccagcacctcgaaggaacccagtgcggcagccccaacgggggctgggggcgtggccccaggctcagggaacaactcagggggacccagcctcctggtgccactgcctgtgaatcctcccagctccccaacgcccagcttcagtgatgccaaggcagccggtgccctgctcaatgggcctccacagttcagcaccgccccagaaatcaaggcccctgagcctctgagctccttgaagtccatggcggaacgggcagccatcagctctggcattgaggaccctgtgccaacgctgcacctgaccgagcgagacatcatcctgagcagtacatcagcacctccggcctcagcccagccgcccctgcagctgtcagaggtgaacataccgctgtcgctgggtgtctgtccactgggccctgtgcccctcaccaaggagcagctctatcagcaggccatggaagaggccgcctggcaccacatgcctcacccctctgactctgagcgtattcggcagtacctcccccggaacccctgtccgacgcccccctaccaccaccagatgccacccccacactcggacactgtggaattctaccagcgcctgtcgaccgagacactcttcttcatcttctactatctggagcccagagatgttagaactgcttgggttgacagcgaggctggtccactgaggcacacctcagccccgcttccagttgcccactggctcacccgcggcccctccccagccctgctccagcagccccagtctaggccgaccccactctgctcatcggcacattctcaggcctccctggagaccactggggagctgtccagccccctcccaaccccacttctctga

SEQ ID NO: 4948 - DNA, 4138 bp, Homo sapiens
aaattctccctgggggtaaggtaccagccctgtcctttatgggcttcttgttctaaagcatatccgtcccatatggttgctgctagtcacatgtggtgattagtaactagttaaaaatgaaaaattcagttcctccattacacttgccacatttcagatgttcagtggccaacagatatgcgcaaatagagtgtttccagcattgcaaagttctgttggatagcactgtttgccagatgttcccttctttgtgggtgaggactcttttggtgtgacttccctctgtattgaggctcttgttcctcagtatggggctgtttctgtctttacagtaagtgactactccagggttccctgccctgcacacgtagagtgggagcggcccgtggatcccagggaactgtgcttttcattgtaggccccctccctggaggggaagagggcaatctccgctggtatctcagaagtcttcttctgaggcataagcctctcttcccagggctcccctggtctcgctgtcaggccctaaggtatgtcttcccttggactaaagctccttggaactcccttttgacctcagtcttctctgggttccaggtaacttcctttaaaataaagacgctcctctcttgaagttttgggttcctgccctgatggtctatgtctccctgactctaaattaccaatccacttgctatgggattcctccatgagtgcagatcggctccctcacagctgcggtacctttgcaccctcttatcttagtaagatttctgtcttctcccaggtctctcttgggtactgccttctgcccccaaatctctaagccttcttggtattagcttctttgggttaggagtgttatttccttttggtttaaggatcctgctctggaataaatgtcttggtggtttgagtcccttctacttggcattcagccctgtctgcatgagcgggttcagctcttcacagctttcggcatctctgctcgccgtcgttttcccccacccccaatctttcttctcctacctacagcttacacacacacacacacacacacacacacacacacacacgcccttctctgtgagctgccagtttcatttgtctcctgacttgtctgagggatgacctctcctagccacctctgcccagcccctctgagtaggaagtgtgatttccagggctaatgcctccatcccagtcatcagctgtgtgcagcatgactgtcctgctctgaaaaacctttttgagtgtattctggggagaaggtactccatgctctaggaattttccacttcctgagtcagaggcacacaaaaaagtatgtaacttttcttgtttcaacaaacttatggggtcccctgttggccagacactatgctgggcagtcaagcgagcatcaggagaactggggctggtctcttgtcagatagcaaatgcttcttctctttaccagtcccacctacctcactatgctgactaggtccatgtctctgggtttttaccagccagggaatacgtgttaattcctctccaatctctcctagcagcgtccgtctccaagagagtatgaagagagtgcgtctgtagggcagggaagatggcggacaagcgcaaactccaaggtgagattgatcgctgcctcaagaaggtgtccgagggcgtggagcagtttgaagatatttggcagaagctccacaatgcagccaacgcgaaccagaaagaaaagtatgaggctgacctaaagaaggagattaagaagctacaacggctgagggaccaaatcaagacatgggtagcgtccaacgagatcaaggacaagaggcagcttatagacaaccgcaagctcattgagacgcaaatggaacggttcaaagttgtggaacgagagaccaaaaccaaagcttacagcaaagagggcctgggcctggcccagaaggtagatcctgcccagaaggagaaggaagaggttggccagtggctcacgaataccatcgacacgctcaacatgcaggtggaccagtttgagagtgaagtggagtcactgtcagtgcagacacgcaagaagaagggcgacaaggataagcaggaccggattgagggcttgaagcggcacatcgagaagcaccgctaccacgtgcgcatgctagagaccatcctgcgcatgctggacaatgactccatcctcgttgacgccatccgcaagatcaaggacgacgttgagtactatgttgactcatcccaggaccccgacttcgaggagaacgagtttctctacgatgacctggacctcgaggacattccacaggcgctggtcgccacctcccctcccagccacagccacatggaggatgagatcttcaaccagtccagcagcacgcccacctcaaccacctccagctctcccatcccgcccagcccagccaactgtaccacggaaaactctgaagatgataagaagaggggacgttccacagacagtgaagtcagccagtctccagccaaaaacggctccaagcctgtccacagcaaccagcaccctcagtccccagctgtgccgcccacctacccctccggccccccgcctgctgcctctgccttgagcaccactcctggcaacaatggggtccccgcccccgcagcacccccaagtgccctgggccccaaggccagtccagctcccagccacaactcgggcacccctgctccctatgcccaggctgtggccccaccagctcccagtgggcccagcacgacccagccccggccccccagcgtccagcctagcggaggcggaggcggcggcagcggaggtggagggagcagcagcagtagtaacagcagtgccggtggaggggctggcaagcagaatggcgccaccagttacagctcagttgtggcagacagcccggcagaggtggctttgagcagcagtgggggcaacaatgccagcagccaggccttgggccccccttccggcccccacaacccacctcccagcacctcgaaggaacccagtgcggcagccccaacgggggctgggggcgtggccccaggctcagggaacaactcagggggacccagcctcctggtgccactgcctgtgaatcctcccagctccccaacgcccagcttcagtgatgccaaggcagccggtgccctgctcaatgggcctccacagttcagcaccgccccagaaatcaaggcccctgagcctctgagctccttgaagtccatggcggaacgggcagccatcagctctggcattgaggaccctgtgccaacgctgcacctgaccgagcgagacatcatcctgagcagtacatcagcacctccggcctcagcccagccgcccctgcagctgtcagaggtgaacataccgctgtcgctgggtgtctgtccactgggccctgtgcccctcaccaaggagcagctctatcagcaggccatggaagaggccgcctggcaccacatgcctcacccctctgactctgagcgtattcggcagtacctcccccggaacccctgtccgacgcccccctaccaccaccagatgccacccccacactcggacactgtggaattctaccagcgcctgtcgaccgagacactcttcttcatcttctactatctggagggcactaaggcacagtatctggcagccaaggccctaaagaagcagtcatggcgattccacaccaagtacatgatgtggttccagaggcacgaggagcccaagaccatcactgacgagtttgagcagggcacctacatctactttgactacgagaagtggggccagcggaagaaggaaggcttcacctttgagtaccgctacctggaggaccgggacctccagtgacaccggcccctccctctacccacccccttcccccgcatgctgatccccctgcccaggtgagggccctgccctggaagactggagggaggccccaagccacggggcatccccctctcccaggaagcagggagggggccgggaggttttcctctcagccccaccctgggggcccgggggcgagggctgccccctcctcccctccccagtgagggacattttttggtaaacctattttcattttggaaaatatttatgaataaatagttttatatg

SEQ ID NO: 4949 - DNA, 1269 bp, Homo sapiens
gaaggaacccagtgcggcagccccaacgggggctgggggcgtggccccaggctcagggaacaactcagggggacccagcctcctggtgccactgcctgtgaatcctcccagctccccaacgcccagcttcagtgatgccaaggcagccggtgccctgctcaatgggcctccacagttcagcaccgccccagaaatcaaggcccctgagcctctgagctccttgaagtccatggcggaacgggcagccatcagctctggcattgaggaccctgtgccaacgctgcacctgaccgagcgagacatcatcctgagcagtacatcagcacctccggcctcagcccagccgcccctgcagctgtcagaggtgaacataccgctgtcgctgggtgtctgtccactgggccctgtgcccctcaccaaggagcagctctatcagcaggccatggaagaggccgcctggcaccacatgcctcacccctctgactctgagcgtattcggcagtacctcccccggaacccctgtccgacgcccccctaccaccaccagatgccacccccacactcggacactgtggaattctaccagcgcctgtcgaccgagacactcttcttcatcttctactatctggagggcactaaggcacagtatctggcagccaaggccctaaagaagcagtcatggcgattccacaccaagtacatgatgtggttccagaggcacgaggagcccaagaccatcactgacgagtttgagcagctggcgcagtccctcagcctgaccaagtactcctccctctggctgtctgctcagcctggaacaccgccctctcatcctccacttggccagctcctaggcctcctgtaggtctcagcccaaatgtcccttcctcaaagaaaccttcctggagccacccagcccagtgcctcccctttgcagtgctgggcacactcgcttggggtgtgggattttcccagtatgtgtccctgcaccaggctgtgggctctgctgccgagggaccttgatggcccccacttcacctccaggtcccagcactcagcagggcaggggctcagtgccgaaactattttttttgaatgggcttctcaagttctaatactgggaaattcctgctgcttgcaaacactctggaaccaacctacctgggtttcagcccagtccagctgggcgactctaggcaagtcactcgaacctctgtgtctcaattaacttatctgtaaaaatggggggaagaccacctacctaatgca

SEQ ID NO: 4950 - DNA, 2611 bp, Homo sapiens
cggaggagtcttaccctaatgtaagatggtggcccgtctggctgtggaacccaccgaaagctgagagtctctctctcagccgtaaaggtcggactcgctgaagcaatcaggcccggttctgaagagttttttccccgacgctcgttcggtggtttcttgtgaggacgcggcagcccgtggagtcggctgagggaaaagcgaggcaaggcaggcgggtcgtcaaagtcctacattttagctttcagtgctgaacttccttctcccttaaattattataaacttttgctgctgtttaataaacgtgaagatgtctcgcagtcctgatgcgaaggaagaccctgtggagtgccctctttgcatggagcccttggagatagatgatatcaactttttcccttgcacctgtggctaccagatttgccgattttgttggcatcgaattcgcactgatgaaaatgggctttgtcctgcatgtagaaagccatatccagaagacccagcagtttataaaccactctcccaggaagagctgcaaaggataaagaatgagaaaaaacagaaacaaaatgagagaaaacagaaaatatcagaaaatcgcaaacatttggctagtgtacgtgtcgtacaaaaaaacctcgtctttgttgtaggtttatctcagcgcctagcagacccagaggttttaaaacgaccagaatattttgggaagtttggtaaaatacataaagttgtcatcaataatagcacatcatatgcaggctcacagggtccaagtgccagtgcttatgtaacctatatccggtcagaagacgctctcagagccatacagtgtgtcaacaatgtggtagtagatggcagaacacttaaggcatctctaggtacaacaaaatactgcagttacttcttaaagaatatgcagtgtccaaaacctgactgcatgtatcttcatgaattgggggatgaggcggccagcttcacaaaagaggaaatgcaggcgggtaaacaccaagaatatgaacagaagctacttcaagaattatataaattaaatcccaattttcttcagctatctacgggttcagttgataaaaataagaacaaagtgacaccactgcagaggtatgatacccccattgacaaaccttcagattctctcagtatagggaacggtgataattcccagcagatatctaacagtgatacgccttcaccaccacctggtttgtcaaaatccaatccagtcatccccatcagttcatccaatcacagtgcacggtccccttttgaaggggcagtaacagagtcacagtcgttattctcagacaattttcgccatcccaaccctatcccaagtgggcttcctcctttccccagctccccacagacatccagtgactggcctacagcaccagaaccacagagcctcttcacatcagaaacaatcccagtatcatcctctacagactggcaagcagcttttggctttggttcttctaaacaaccagaggatgacttgggttttgatcccttcgatgtcactcgaaaagccttagcagacctgattgagaaggaactgtccgttcaagaccaaccttccctttcgcccacatctcttcagaactcctcttcacacactacaaccgccaaaggtccaggctctggattcctgcatcctgctgcagctacaaatgccaattctctcaatagtaccttttcagtcttgccccagaggttccctcaatttcagcagcaccgagcggtttataattcattcagttttccaggccaggcagcccgctatccttggatggcctttccacgcaatagcatcatgcacttgaaccacacagcaaaccccacctcaaatagtaatttcttggacttgaatctcccgccacagcacaacacaggtctgggagggatccctgtagcagacaacagcagttctgtagagagtttaaatatgaaggaatggcaggacgggctaagggcacttctacccaacattaacatcaactttggtggactgcccaattcttcttccccctccaacgccaaccacagtgcaccaacgtccaacactgccaccaccgacagcctgagttgggacagccctggcagctggacagacccagccatcatcacaggtattccagcgtcttcaggaaacagtttagactctcttcaagatgacaatcctccacactggctaaaatcccttcaggccctcacagagatggacggccccagcgctgctccatcacagacccaccacagcgcccccttcagcacacagatcccgctgcacagagccagttggaatccctaccctcctccttcaaacccttccagcttccactccccacccccaggcatttactacagagttcaacactggaccgccattaggcaaagaggagcaaccattagaaaatgcaggatttgtcccactctgttttctccctctcagcccaccacccacagctcccttctcatctcttatgttctgaagaatccagtacctgatcaattttttttctccctaaccccagatgcaatgcgatcacagggtcattaccatctctttattaattgtaaaaatttttgttga

SEQ ID NO: 4951 - DNA, 4631 bp, Homo sapiens
ggtggcccgtctggctgtggaacccaccgaaagctgagagtctctctctcagccgtaaaggtcggactcgctgaagcaatcaggcccggttctgaagagttttttccccgacgctcgttcggtggtttcttgtgaggacgcggcagcccgtggagtcggctgagggaaaagcgaggcaaggcaggcgggtcgtcaaagtcctacattttagctttcagtgctgaacttccttctcccttaaattattataaacttttgctgctgtttaataaacgtgaagatgtctcgcagtcctgatgcgaaggaagaccctgtggagtgccctctttgcatggagcccttggagatagatgatatcaactttttcccttgcacctgtggctaccagatttgccgattttgttggcatcgaattcgcactgatgaaaatgggctttgtcctgcatgtagaaagccatatccagaagacccagcagtttataaaccactctcccaggaagagctgcaaaggataaagaatgagaaaaaacagaaacaaaatgagagaaaacagaaaatatcagaaaatcgcaaacatttggctagtgtacgtgtcgtacaaaaaaacctcgtctttgttgtaggtttatctcagcgcctagcagacccagaggttttaaaacgaccagaatattttgggaagtttggtaaaatacataaagttgtcatcaataatagcacatcatatgcaggctcacagggtccaagtgccagtgcttatgtaacctatatccggtcagaagacgctctcagagccatacagtgtgtcaacaatgtggtagtagatggcagaacacttaaggcatctctaggtacaacaaaatactgcagttacttcttaaagaatatgcagtgtccaaaacctgactgcatgtatcttcatgaattgggggatgaggcggccagcttcacaaaagaggaaatgcaggcgggtaaacaccaagaatatgaacagaagctacttcaagaattatataaattaaatcccaattttcttcagctatctacgggttcagttgataaaaataagaacaaagtgacaccactgcagaggtatgatacccccattgacaaaccttcagattctctcagtatagggaacggtgataattcccagcagatatctaacagtgatacgccttcaccaccacctggtttgtcaaaatccaatccagtcatccccatcagttcatccaatcacagtgcacggtccccttttgaaggggcagtaacagagtcacagtcgttattctcagacaattttcgccatcccaaccctatcccaagtgggcttcctcctttccccagctccccacagacatccagtgactggcctacagcaccagaaccacagagcctcttcacatcagaaacaatcccagtatcatcctctacagactggcaagcagcttttggctttggttcttctaaacaaccagaggatgacttgggttttgatcccttcgatgtcactcgaaaagccttagcagacctgattgagaaggaactgtccgttcaagaccaaccttccctttcgcccacatctcttcagaactcctcttcacacactacaaccgccaaaggtccaggctctggattcctgcatcctgctgcagctacaaatgccaattctctcaatagtaccttttcagtcttgccccagaggttccctcaatttcagcagcaccgagcggtttataattcattcagttttccaggccaggcagcccgctatccttggatggcctttccacgcaatagcatcatgcacttgaaccacacagcaaaccccacctcaaatagtaatttcttggacttgaatctcccgccacagcacaacacaggtctgggagggatccctgtagcaggggaagaagaggtgaaggtttcgaccatgccactgtcaacctcttcccattcattacaacaaggacagcagcctacaagtctccacactactgtggcctgacaacagaactgagaggagaggattagactctggggtgcttgcatgggcaactggatttttgcatgattcctttatgattttgcttttaatgtatacacccagaagagccaatataaacgttcctcatgcctacagctagcgtgttacctcatagttgttgaagtatttcttcattaggcctttaacataatttattagtgtaataattttggcattgtttctcatgagtgatactatttctaactcataaaaataaacttgtagtactaagatcccaggtgagattagctagaattgttgttattttggctctattattgaaaaattatacaaaggtaatggtagtatcttgttttctggtttgtgaaaaaataatatcctaatctcctgaaaaatttgcaaattaacaagataatgtctattgcattctttgaatacttgagaagaaagaatacatataaaacaaaattggtggtgtcatttaatgctcagaaggatattgttggcgattgtttttagttgtctagatttatatcctataatatgcattacatgtgtagaaactgttttgttctctctcttttgcacttttgcactttctttttgaatggttgttaattatgcatagatggttaaaagataattattgtagcctaaatgcaatataatctcttttctaatgcactgcctagtataccaggaaatgcctcaaaaacagaacttcagtttatagttgacttatctgaaacttgaatacggagtaaacattgtatgtgaaaagcaaccatagtagtgtaacattgttactgaacaaacagtaattctgtgggatattgttttggaaatttcattgtttaataattaaaatgtgataataagataatattataagtacctgaccagaatgagactaaggcagaagagaagagattggatgtcctctaaaattaggccacctaaattgtaacagataattttaatcaagagaatagtggagtactttattaggacataatgtgaagtgatatttctgaaaacacatttcttgaaatagttttaaaactgataataaaggaaaagaaactgtacttagtttggagcagtggacaaaagctgattcagaaaacatgaccatattctgcctacatgaagcatctgggaagaaagggaaagtcacacctcctcttgagattttaaccattatgataaaaggtatgctttaatttgttaaaaaaaaaagtatgaaaggggataatgtgaatacaaaaaagaagcctagagattgaaaataataataatagaacatgttattaggagatggtacttaatgtcatgttggagttggagttttcaaggttacctctatataaaattggattattttctgttagatataatgtgacaaattaaatgactttatcccaaggtacagtgaggtaaacaaaaatctattcttagatatccttagatttggttaactgaggctgtagaagcagcgaattgtctagccatttaagttatttttgtaaaattcagcataaacatcaatctctaatttctatctagaagtgactttaagacattacaagaacattgccaatttggaaaatgccaataaaatactgtagacttattaatattgtagacttattatcagtcttttactatagcttaatttaattatggttttcatttttactgtaagaggccaagacttcacttatgtctcctgtggagctgaggctcctgggccttgttattataacaaactctggctccttgtaatgatgcttactagctcaaagccttctccagcattcagtgttagcctttcattgcctggatcttcttacaaagccatagcaagtggttagtgccatttgctccttggtgttgagagatatacctgttaaatgaggcttctttcctttctcattcatagccagcgtggaaaaatcatcaggtagtttgcccagatttgccagagccctaaataaaatggcaaaacgatctccctgcctgcttctcctccccacccccacttacatgcacaccgtaaatcaagaaatgctttttgggcaattagactttatcttctaaatttttgcatagaatggctaaacatgatcttttgcctcactttgtaattcctacaccttccttgtaagcttcaccttttgcttacctaatattttatttaaacatggttttttaaaaaacctgaagctttaaaatcatagtcataattaattttacactaaaggacagaagaaattatacaacacataaaagaagccactacttcacatagcaagcaaattgaaatcaaaatgacagaagaatgagaaattctttaaaagcttcaggttttttttgttgttgttgttaaattcctgcatgatgcatcatgtgcaagggaaacttaatatacttttacacccttaacctttataaagtgactagcttttcccttaacataggaatttttaacctggagcccagatttttgagagtacacacaaaattgtgggtttgtgtgcatgtacatatgtccatttttttctagggagaagatccatagttattagatttgtgaaggatttggtgatccccttctcccatc

SEQ ID NO: 4952 - DNA, 1609 bp, Homo sapiens
cggaggagtcttaccctaatgtaagatggtggcccgtctggctgtggaacccaccgaaagctgagagtctctctctcagccgtaaaggtcggactcgctgaagcaatcaggcccggttctgaagagttttttccccgacgctcgttcggtggtttcttgtgaggacgcggcagcccgtggagtcggctgagggaaaagcgaggcaaggcaggcgggtcgtcaaagtcctacattttagctttcagtgctgaacttccttctcccttaaattattataaacttttgctgctgtttaataaacgtgaagatgtctcgcagtcctgatgcgaaggaagaccctgtggagtgccctctttgcatggagcccttggagatagatgatatcaactttttcccttgcacctgtggctaccagatttgccgattttgttggcatcgaattcgcactgatgaaaatgggctttgtcctgcatgtagaaagccatatccagaagacccagcagtttataaaccactctcccaggaagagctgcaaaggataaagaatgagaaaaaacagaaacaaaatgagagaaaacagaaaatatcagaaaatcgcaaacatttggctagtgtacgtgtcgtacaaaaaaacctcgtctttgttgtaggtttatctcagcgcctagcagacccagaggttttaaaacgaccagaatattttgggaagtttggtaaaatacataaagttgtcatcaataatagcacatcatatgcaggctcacagggtccaagtgccagtgcttatgtaacctatatccggtcagaagacgctctcagagccatacagtgtgtcaacaatgtggtagtagatggcagaacacttaaggcatctctaggtacaacaaaatactgcagttacttcttaaagaatatgcagtgtccaaaacctgactgcatgtatcttcatgaattgggggatgaggcggccagcttcacaaaagaggaaatgcaggcgggtaaacaccaagaatatgaacagaagctacttcaagaattatataaattaaatcccaattttcttcagctatctacgggttcagttgataaaaataagaacaaagtgacaccactgcagaggtatgatacccccattgacaaaccttcagattctctcagtatagggaacggtgataattcccagcagatatctaacagtgatacgccttcaccaccacctggtttgtcaaaatccaatccagtcatccccatcagttcatccaatcacagtgcacggtccccttttgaaggggcagtaacagagtcacagtcgttattctcagacaattttcgccatcccaaccctatcccaagtgggcttcctcctttccccagctccccacagacatccagtgactggcctacagcaccagaaccacagagcctcttcacatcagaaacaatcccagtatcatcctctacagactggcaagcagcttttggctttggttcttctaaacaaccagaggatgacttgggttttgatcccttcgatgtcactcgaaaagccttagcagaccttacagagccaattgagaggaagagactggcagtgctgaagagaagatag

SEQ ID NO: 4953 - DNA, 2215 bp, Homo sapiens
accctaatgtaagatggtggcccgtctggctgtggaacccaccgaaagctgagagtctctctctcagccgtaaaggtcggactcgctgaagcaatcaggcccggttctgaagagttttttccccgacgctcgttcggtggtttcttgtgaggacgcggcagcccgtggagtcggctgagggaaaagcgaggcaaggcaggcgggtcgtcaaagtcctacattttagctttcagtgctgaacttccttctcccttaaattattataaacttttgctgctgtttaataaacgtgaagatgtctcgcagtcctgatgcgaaggaagaccctgtggagtgccctctttgcatggagcccttggagatagatgatatcaactttttcccttgcacctgtggctaccagatttgccgattttgttggcatcgaattcgcactgatgaaaatgggctttgtcctgcatgtagaaagccatatccagaagacccagcagtttataaaccactctcccaggaagagctgcaaaggataaagaatgagaaaaaacagaaacaaaatgagagaaaacagaaaatatcagaaaatcgcaaacatttggctagtgtacgtgtcgtacaaaaaaacctcgtctttgttgtaggtttatctcagcgcctagcagacccagaggttttaaaacgaccagaatattttgggaagtttggtaaaatacataaagttgtcatcaataatagcacatcatatgcaggctcacagggtccaagtgccagtgcttatgtaacctatatccggtcagaagacgctctcagagccatacagtgtgtcaacaatgtggtagtagatggcagaacacttaaggcatctctaggtacaacaaaatactgcagttacttcttaaagaatatgcagtgtccaaaacctgactgcatgtatcttcatgaattgggggatgaggcggccagcttcacaaaagaggaaatgcaggcgggtaaacaccaagaatatgaacagaagctacttcaagaattatataaattaaatcccaattttcttcagctatctacgggttcagttgataaaaataagaacaaagtgacaccactgcagagccccattgacaaaccttcagattctctcagtatagggaacggtgataattcccagcagatatctaacagtgatacgccttcaccaccacctggtttgtcaaaatccaatccagtcatccccatcagttcatccaatcacagtgcacggtccccttttgaaggggcagtaacagagtcacagtcgttattctcagacaattttcgccatcccaaccctatcccaagtgggcttcctcctttccccagctccccacagacatccagtgactggcctacagcaccagaaccacagagcctcttcacatcagaaacaatcccagtatcatcctctacagactggcaagcagcttttggctttggttcttctaaacaaccagaggatgacttgggttttgatcccttcgatgtcactcgaaaagccttagcagacctgattgagaaggaactgtccgttcaagaccaaccttccctttcgcccacatctcttcagaactcctcttcacacactacaaccgccaaaggtccaggctctggattcctgcatcctgctgcagctacaaatgccaattctctcaatagtaccttttcagtcttgccccagaggttccctcaatttcagcagcaccgagcggtttataattcattcagttttccaggccaggcagcccgctatccttggatggcctttccacgcaatagcatcatgcacttgaaccacacagcaaaccccacctcaaatagtaatttcttggacttgaatctcccgccacagcacaacacaggtctgggagggatccctgtagcaggtattccagcgtcttcaggaaacagtttagactctcttcaagatgacaatcctccacactggctaaaatcccttcaggccctcacagagatggacggccccagcgctgctccatcacagacccaccacagcgcccccttcagcacacagatcccgctgcacagagccagttggaatccctaccctcctccttcaaacccttccagcttccactccccacccccaggctttcagacagccttcagaccccccagcaaaacccccacagatttactacagagttcaacactggaccgccattag

SEQ ID NO: 4954 - DNA, 1687 bp, Homo sapiens
atgtctcgcagtcctgatgcgaaggaagaccctgtggagtgccctctttgcatggagcccttggagatagatgatatcaactttttcccttgcacctgtggctaccagatttgccgattttgttggcatcgaattcgcactgatgaaaatgggctttgtcctgcatgtagaaagccatatccagaagacccagcagtttataaaccactctcccaggaagagctgcaaaggataaagaatgagaaaaaacagaaacaaaatgagagaaaacagaaaatatcagaaaatcgcaaacatttggctagtgtacgtgtcgtacaaaaaaacctcgtctttgttgtaggtttatctcagcgcctagcagacccagaggttttaaaacgaccagaatattttgggaagtttggtaaaatacataaagttgtcatcaataatagcacatcatatgcaggctcacagggtccaagtgccagtgcttatgtaacctatatccggtcagaagacgctctcagagccatacagtgtgtcaacaatgtggtagtagatggcagaacacttaaggcatctctaggtacaacaaaatactgcagttacttcttaaagaatatgcagtgtccaaaacctgactgcatgtatcttcatgaattgggggatgaggcggccagcttcacaaaagaggaaatgcaggcgggtaaacaccaagaatatgaacagaagctacttcaagaattatataaattaaatcccaattttcttcagctatctacgggttcagttgataaaaataagaacaaagtgacaccactgcagaggtatgatacccccattgacaaaccttcagattctctcagtatagggaacggtgataattcccagcagatatctaacagtgatacgccttcaccaccacctggtttgtcaaaatccaatccagtcatccccatcagttcatccaatcacagtgcacggtccccttttgaaggggcagtaacagagtcacagtcgttattctcagacaattttcgccatcccaaccctatcccaagtgggcttcctcctttccccagctccccacagacatccagtgactggcctacagcaccagaaccacagagcctcttcacatcagaaacaatcccagtatcatcctctacagactggcaagcagcttttggctttggttcttctaaacaaccagaggatgacttgggttttgatcccttcgatgtcactcgaaaagccttagcagaccttacagagccaattgagaggaagagactggcagtgctgaagagaagataggctcattcagtaggataatagatgtcgttgggtggtgggaagagataagctcctgagacgagcatgtggtatagcttaagagaggtgggtggccaggcgcggtggctcacgcctgtaatcccaacactttgggaggccaaggcaggcagatcacaaggtcaggagatcgagaccatcctggctaacacggtgaaaccccgtctctactaaaaatacaaaaaaattagctgggcgtggtggcgggcacctgtagccccagctactcgggaggctgaggcaggagaatggcgcgaacccaggaggtggagcttgcagtgagccgagatggtgccactgtgctccagcctgggcaacagagcgagactccgtctaaaaaaaaaaaaaa

SEQ ID NO: 4955 - DNA, 3297 bp, Homo sapiens
tggtggcccgtctggctgtggaacccaccgaaagctgagagtctctctctcagccgtaaaggtcggactcgctgaagcaatcaggcccggttctgaagagttttttccccgacgctcgttcggtggtttcttgtgaggacgcggcagcccgtggagtcggctgagggaaaagcgaggcaaggcaggcgggtcgtcaaagtcctacattttagctttcagtgctgaacttccttctcccttaaattattataaacttttgctgctgtttaataaacgtgaagatgtctcgcagtcctgatgcgaaggaagaccctgtggagtgccctctttgcatggagcccttggagatagatgatatcaactttttcccttgcacctgtggctaccagatttgccgattttgttggcatcgaattcgcactgatgaaaatgggctttgtcctgcatgtagaaagccatatccagaagacccagcagtttataaaccactctcccaggaagagctgcaaaggataaagaatgagaaaaaacagaaacaaaatgagagaaaacagaaaatatcagaaaatcgcaaacatttggctagtgtacgtgtcgtacaaaaaaacctcgtctttgttgtaggtttatctcagcgcctagcagacccagaggttttaaaacgaccagaatattttgggaagtttggtaaaatacataaagttgtcatcaataatagcacatcatatgcaggctcacagggtccaagtgccagtgcttatgtaacctatatccggtcagaagacgctctcagagccatacagtgtgtcaacaatgtggtagtagatggcagaacacttaaggcatctctaggtacaacaaaatactgcagttacttcttaaagaatatgcagtgtccaaaacctgactgcatgtatcttcatgaattgggggatgaggcggccagcttcacaaaagaggaaatgcaggcgggtaaacaccaagaatatgaacagaagctacttcaagaattatataaattaaatcccaattttcttcagctatctacgggttcagttgataaaaataagaacaaagtgacaccactgcagaggtatgatacccccattgacaaaccttcagattctctcagtatagggaacggtgataattcccagcagatatctaacagtgatacgccttcaccaccacctggtttgtcaaaatccaatccagtcatccccatcagttcatccaatcacagtgcacggtccccttttgaaggggcagtaacagagtcacagtcgttattctcagacaattttcgccatcccaaccctatcccaagtgggcttcctcctttccccagctccccacagacatccagtgactggcctacagcaccagaaccacagagcctcttcacatcagaaacaatcccagtatcatcctctacagactggcaagcagcttttggctttggttcttctaaacaaccagaggatgacttgggttttgatcccttcgatgtcactcgaaaagccttagcagacctgattgagaaggaactgtccgttcaagaccaaccttccctttcgcccacatctcttcagaactcctcttcacacactacaaccgccaaaggtccaggctctggattcctgcatcctgctgcagctacaaatgccaattctctcaatagtaccttttcagtcttgccccagaggttccctcaatttcagcagcaccgagcggtttataattcattcagttttccaggccaggcagcccgctatccttggatggcctttccacgcaatagcatcatgcacttgaaccacacagcaaaccccacctcaaatagtaatttcttggacttgaatctcccgccacagcacaacacaggtctgggagggatccctgtagcaggtattccagcgtcttcaggaaacagtttagactctcttcaagatgacaatcctccacactggctaaaatcccttcaggccctcacagagatggacggccccagcgctgctccatcacagacccaccacagcgcccccttcagcacacagatcccgctgcacagagccagttggaatccctaccctcctccttcaaacccttccagcttccactccccacccccaggctttcagacagccttcagaccccccagcaaaacccccacagatttactacagagttcaacactggaccgccattaggcaaagaggagcaaccattagaaaatgcaggatttgtcccactctgttttctccctctcagcccaccacccacagctcccttctcatctcttatgttctgaagaatccagtacctgatcaattttttttctccctaaccccagatgcaatgcgatcacagggtcattaccatctctttattaattgtaaaaatttttgttgatccagcatttgagtgacactgttgaatgtttctaaaaatgcctttttaaggagagaaaaaaaaatcaaagggcagtctcaatacttagaaaattattgtttgtctgttgcgcataataatgacataatctgcttagcagaaaatgacgattaatctataggaaagctcaagtaaatgcattatcaactgcagaagtttgaaaaccaggttcatttacgtgagattgctaaatgcatgggggaaagcagtggtcctagcatccatcttgtattcagcttatcattattgcagggaaaatgcttttaatttaaattaatttttaattcttttggcaagttgatggcaaggacttgattgtgtcattaagcaaaagaatgtattggaagttgatggaaagacaaattcatctgtagtagtaactggccgattgctaaagagttcataaggaggtgagaagtaatttttttaaaggagaaaaattttttggctttagatttaaagtaaattgaaatgttttaaagaaaaaagtattcacagatttaatacctattaataatataagagctgaaatgtaagtcatttcttcagtccttctcctctgtcggaatcttttttgttttaccataaattcacctgacgagggcactctgagatagcactgctctggggccatctgatcaccatcgggagcaaatctctgacctccttgcctgcagcttttacttaaccctgtagtttctggacgtttgtgcagtattgaaaagacaggagaaaagaaaacagaaacctggttataacctgacgctaaaactaaaaacaaggaaatgtacctctttcttcagaattaaaactaaaatcttaaataaaacagaaaacttgatggtg

SEQ ID NO: 4956 - DNA, 4642 bp, Homo sapiens
ggtggcccgtctggctgtggaacccaccgaaagctgagagtctctctctcagccgtaaaggtcggactcgctgaagcaatcaggcccggttctgaagagttttttccccgacgctcgttcggtggtttcttgtgaggacgcggcagcccgtggagtcggctgagggaaaagcgaggcaaggcaggcgggtcgtcaaagtcctacattttagctttcagtgctgaacttccttctcccttaaattattataaacttttgctgctgtttaataaacgtgaagatgtctcgcagtcctgatgcgaaggaagaccctgtggagtgccctctttgcatggagcccttggagatagatgatatcaactttttcccttgcacctgtggctaccagatttgccgattttgttggcatcgaattcgcactgatgaaaatgggctttgtcctgcatgtagaaagccatatccagaagacccagcagtttataaaccactctcccaggaagagctgcaaaggataaagaatgagaaaaaacagaaacaaaatgagagaaaacagaaaatatcagaaaatcgcaaacatttggctagtgtacgtgtcgtacaaaaaaacctcgtctttgttgtaggtttatctcagcgcctagcagacccagaggttttaaaacgaccagaatattttgggaagtttggtaaaatacataaagttgtcatcaataatagcacatcatatgcaggctcacagggtccaagtgccagtgcttatgtaacctatatccggtcagaagacgctctcagagccatacagtgtgtcaacaatgtggtagtagatggcagaacacttaaggcatctctaggtacaacaaaatactgcagttacttcttaaagaatatgcagtgtccaaaacctgactgcatgtatcttcatgaattgggggatgaggcggccagcttcacaaaagaggaaatgcaggcgggtaaacaccaagaatatgaacagaagctacttcaagaattatataaattaaatcccaattttcttcagctatctacgggttcagttgataaaaataagaacaaagtgacaccactgcagagccccattgacaaaccttcagattctctcagtatagggaacggtgataattcccagcagatatctaacagtgatacgccttcaccaccacctggtttgtcaaaatccaatccagtcatccccatcagttcatccaatcacagtgcacggtccccttttgaaggggcagtaacagagtcacagtcgttattctcagacaattttcgccatcccaaccctatcccaagtgggcttcctcctttccccagctccccacagacatccagtgactggcctacagcaccagaaccacagagcctcttcacatcagaaacaatcccagtatcatcctctacagactggcaagcagcttttggctttggttcttctaaacaaccagaggatgacttgggttttgatcccttcgatgtcactcgaaaagccttagcagacctgattgagaaggaactgtccgttcaagaccaaccttccctttcgcccacatctcttcagaactcctcttcacacactacaaccgccaaaggtccaggctctggattcctgcatcctgctgcagctacaaatgccaattctctcaatagtaccttttcagtcttgccccagaggttccctcaatttcagcagcaccgagcggtttataattcattcagttttccaggccaggcagcccgctatccttggatggcctttccacgcaatagcatcatgcacttgaaccacacagcaaaccccacctcaaatagtaatttcttggacttgaatctcccgccacagcacaacacaggtctgggagggatccctgtagcaggggaagaagaggtgaaggtttcgaccatgccactgtcaacctcttcccattcattacaacaaggacagcagcctacaagtctccacactactgtggcctgacaacagaactgagaggagaggattagactctggggtgcttgcatgggcaactggatttttgcatgattcctttatgattttgcttttaatgtatacacccagaagagccaatataaacgttcctcatgcctacagctagcgtgttacctcatagttgttgaagtatttcttcattaggcctttaacataatttattagtgtaataattttggcattgtttctcatgagtgatactatttctaactcataaaaataaacttgtagtactaagatcccaggtgagattagctagaattgttgttattttggctctattattgaaaaattatacaaaggtaatggtagtatcttgttttctggtttgtgaaaaaataatatcctaatctcctgaaaaatttgcaaattaacaagataatgtctattgcattctttgaatacttgagaagaaagaatacatataaaacaaaattggtggtgtcatttaatgctcagaaggatattgttggcgattgtttttagttgtctagatttatatcctataatatgcattacatgtgtagaaactgttttgttctctctcttttgcacttttgcactttctttttgaatggttgttaattatgcatagatggttaaaagataattattgtagcctaaatgcaatataatctcttttctaatgcactgcctagtataccaggaaatgcctcaaaaacagaacttcagtttatagttgacttatctgaaacttgaatacggagtaaacattgtatgtgaaaagcaaccatagtagtgtaacattgttactgaacaaacagtaattctgtgggatattgttttggaaatttcattgtttaataattaaaatgtgataataagataatattataagtacctgaccagaatgagactaaggcagaagagaagagattggatgtcctctaaaattaggccacctaaattgtaacagataattttaatcaagagaatagtggagtactttattaggacataatgtgaagtgatatttctgaaaacacatttcttgaaatagttttaaaactgataataaaggaaaagaaactgtacttagtttggagcagtggacaaaagctgattcagaaaacatgaccatattctgcctacatgaagcatctgggaagaaagggaaagtcacacctcctcttgagattttaaccattatgataaaaggtatgctttaatttgttaaaaaaaaaagtatgaaaggggataatgtgaatacaaaaaagaagcctagagattgaaaataataataatagaacatgttattaggagatggtacttaatgtcatgttggagttggagttttcaaggttacctctatataaaattggattattttctgttagatataatgtgacaaattaaatgactttatcccaaggtacagtgaggtaaacaaaaatctattcttagatatccttagatttggttaactgaggctgtagaagcagcgaattgtctagccatttaagttatttttgtaaaattcagcataaacatcaatctctaatttctatctagaagtgactttaagacattacaagaacattgccaatttggaaaatgccaataaaatactgtagacttattaatattgtagacttattatcagtcttttactatagcttaatttaattatggttttcatttttactgtaagaggccaagacttcacttatgtctcctgtggagctgaggctcctgggccttgttattataacaaactctggctccttgtaatgatgcttactagctcaaagccttctccagcattcagtgttagcctttcattgcctggatcttcttacaaagccatagcaagtggttagtgccatttgctccttggtgttgagagatatacctgttaaatgaggcttctttcctttctcattcatagccagcgtggaaaaatcatcaggtagtttgcccagatttgccagagccctaaataaaatggcaaaacgatctccctgcctgcttctcctccccacccccacttacatgcacaccgtaaatcaagaaatgctttttgggcaattagactttatcttctaaatttttgcatagaatggctaaacatgatcttttgcctcactttgtaattcctacaccttccttgtaagcttcaccttttgcttacctaatattttatttaaacatggttttttaaaaaacctgaagctttaaaatcatagtcataattaattttacactaaaggacagaagaaattatacaacacataaaagaagccactacttcacatagcaagcaaattgaaatcaaaatgacagaagaatgagaaattctttaaaagcttcaggttttttttgttgttgttgttaaattcctgcatgatgcatcatgtgcaagggaaacttaatatacttttacacccttaacctttataaagtgactagcttttcccttaacataggaatttttaacctggagcccagatttttgagagtacacacaaaattgtgggtttgtgtgcatgtacatatgtccatttttttctagggagaagatccatagttattagatttgtgaaggatttggtgatccccttctcccatcaaaaaaaaaaaaaaaaagaa

SEQ ID NO: 4957 - DNA, 3563 bp, Homo sapiens
agcgtgcgcctgcgcacgggaggccggaggagtcttaccctaatgtaagatggtggcccgtctggctgtggaacccaccgaaagctgagagtctctctctcagccgtaaaggtcggactcgctgaagcaatcaggcccggttctgaagagttttttccccgacgctcgttcggtggtttcttgtgaggacgcggcagcccgtggagtcggctgagggaaaagcgaggcaaggcaggcgggtcgtcaaagtcctacattttagctttcagtgctgaacttccttctcccttaaattattataaacttttgctgctgtttaataaacgtgaagatgtctcgcagtcctgatgcgaaggaagaccctgtggagtgccctctttgcatggagcccttggagatagatgatatcaactttttcccttgcacctgtggctaccagatttgccgattttgttggcatcgaattcgcactgatgaaaatgggctttgtcctgcatgtagaaagccatatccagaagacccagcagtttataaaccactctcccaggaagagctgcaaaggataaagaatgagaaaaaacagaaacaaaatgagagaaaacagaaaatatcagaaaatcgcaaacatttggctagtgtacgtgtcgtacaaaaaaacctcgtctttgttgtaggtttatctcagcgcctagcagacccagaggttttaaaacgaccagaatattttgggaagtttggtaaaatacataaagttgtcatcaataatagcacatcatatgcaggctcacagggtccaagtgccagtgcttatgtaacctatatccggtcagaagacgctctcagagccatacagtgtgtcaacaatgtggtagtagatggcagaacacttaaggcatctctaggtacaacaaaatactgcagttacttcttaaagaatatgcagtgtccaaaacctgactgcatgtatcttcatgaattgggggatgaggcggccagcttcacaaaagaggaaatgcaggcgggtaaacaccaagaatatgaacagaagctacttcaagaattatataaattaaatcccaattttcttcagctatctacgggttcagttgataaaaataagaacaaagtgacaccactgcagaggtatgatacccccattgacaaaccttcagattctctcagtatagggaacggtgataattcccagcagatatctaacagtgatacgccttcaccaccacctggtttgtcaaaatccaatccagtcatccccatcagttcatccaatcacagtgcacggtccccttttgaaggggcagtaacagagtcacagtcgttattctcagacaattttcgccatcccaaccctatcccaagtgggcttcctcctttccccagctccccacagacatccagtgactggcctacagcaccagaaccacagagcctcttcacatcagaaacaatcccagtatcatcctctacagactggcaagcagcttttggctttggttcttctaaacaaccagaggatgacttgggttttgatcccttcgatgtcactcgaaaagccttagcagacctgattgagaaggaactgtccgttcaagaccaaccttccctttcgcccacatctcttcagaactcctcttcacacactacaaccgccaaaggtccaggctctggattcctgcatcctgctgcagctacaaatgccaattctctcaatagtaccttttcagtcttgccccagaggttccctcaatttcagcagcaccgagcggtttataattcattcagttttccaggccaggcagcccgctatccttggatggcctttccacgcaatagcatcatgcacttgaaccacacagcaaaccccacctcaaatagtaatttcttggacttgaatctcccgccacagcacaacacaggtctgggagggatccctgtagcagacaacagcagttctgtagagagtttaaatatgaaggaatggcaggacgggctaagggcacttctacccaacattaacatcaactttggtggactgcccaattcttcttccccctccaacgccaaccacagtgcaccaacgtccaacactgccaccaccgacagcctgagttgggacagccctggcagctggacagacccagccatcatcacaggtattccagcgtcttcaggaaacagtttagactctcttcaagatgacaatcctccacactggctaaaatcccttcaggccctcacagagatggacggccccagcgctgctccatcacagacccaccacagcgcccccttcagcacacagatcccgctgcacagagccagttggaatccctaccctcctccttcaaacccttccagcttccactccccacccccaggctttcagacagccttcagaccccccagcaaaacccccacagatttactacagagttcaacactggaccgccattaggcaaagaggagcaaccattagaaaatgcaggatttgtcccactctgttttctccctctcagcccaccacccacagctcccttctcatctcttatgttctgaagaatccagtacctgatcaattttttttctccctaaccccagatgcaatgcgatcacagggtcattaccatctctttattaattgtaaaaatttttgttgatccagcatttgagtgacactgttgaatgtttctaaaaatgcctttttaaggagagaaaaaaaaatcaaagggcagtctcaatacttagaaaattattgtttgtctgttgcgcataataatgacataatctgcttagcagaaaatgacgattaatctataggaaagctcaagtaaatgcattatcaactgcagaagtttgaaaaccaggttcatttacgtgagattgctaaatgcatgggggaaagcagtggtcctagcatccatcttgtattcagcttatcattattgcagggaaaatgcttttaatttaaattaatttttaattcttttggcaagttgatggcaaggacttgattgtgtcattaagcaaaagaatgtattggaagttgatggaaagacaaattcatctgtagtagtaactggccgattgctaaagagttcataaggaggtgagaagtaatttttttaaaggagaaaaattttttggctttagatttaaagtaaattgaaatgttttaaagaaaaaagtattcacagatttaatacctattaataatataagagctgaaatgtaagtcatttcttcagtccttctcctctgtcggaatcttttttgttttaccataaattcacctgacgagggcactctgagatagcactgctctggggccatctgatcaccatcgggagcaaatctctgacctccttgcctgcagcttttacttaaccctgtagtttctggacgtttgtgcagtattgaaaagacaggagaaaagaaaacagaaacctggttataacctgacgctaaaactaaaaacaaggaaatgtacctctttcttcagaattaaaactaaaatcttaaataaaacagaaaacttgatggtgaca

SEQ ID NO: 4958 - DNA, 6176 bp, Homo sapiens
caatgaaaacgaggggggcgcggaggaggaggcggcggcgtcggtggcggcggcgacggcggcgcggaggcgaaggcagcggcgggcgcagcgaggagggcgaggccgggggccgagagggcgggagggcgtagtggcggcccgtcggggcggctgaggcgggcagccgaagcagtggctctcggagggggaacaaagagcagcgactaaggcggcagaggagcggcggcggtggcggcgctgcagcagcgggcgggactggtatggtggttccacagggcagaccccgctgcactcacagggaggaggaggcggcagcggcggaggaaggcggcgcaccccgagaggcatgcccaaagaaaaatacgagccccctgaccctcggaggatgtatacaattatgtcttctgaggaagcagcaaatggaaagaaatcccactgggcagagcttgaaataagtggaaaagtaagaagcttaagcgcatctttgtggtcactaactcacctgacagctttgcatttgagtgacaattccctgtcccgaattccttcagacattgccaagcttcacaatctggtgtatttggacctgtcatctaataaaattcgtagcttacccgcagaactcggaaacatggtatcactcagggagctccatttaaataacaacctgttacgagttctaccttttgagctgggaaaactgtttcagttgcagactttaggcctgaaaggaaatccccttacccaggatatattgaacctttatcaggaaccagatggaacaagacggctgctgaactatttgcttgataatttgtcaggtactgcaaaaagaattacaacagaacaaccacctccaaggtcttggattatgttacaagaaccagataggacaaggccaactgccttgttttctgtcatgtgctataatgttctttgtgataaatatgcgacccggcagttatacggctactgtccatcatgggcgctaaactgggactacaggaaaaaggccattattcaagaaatcttgagctgcaatgctgatatcgtaagtcttcaggaggttgaaacggaacagtattacagtttttttctggtagagctgaaagaacgtggctataatggattcttcagtcctaagtctagagctaggacaatgtcagaacaagaaaggaaacatgttgatggctgtgcaatattcttcaagacagaaaaatttactttggttcagaaacacactgttgaatttaatcagctagccatggcaaattctgaggggtctgaagctatgctgaacagagtcatgacaaaagataacattggggttgcagtactgctagaacttcggaaggaatcgattgaaatgccgtccggaaagccacatcttggaacagaaaaacaacttattcttgtggctaacgcccacatgcattgggaccctgaatactctgatgtgaagttggtacaaactatgatgttcctctcagaagtgaagaacattattgataaagcctctcgcaacctcaaatccagtgttttgggagaatttggaactattccacttgtgttatgtgcagatcttaattctttgccagactctggtgttgtagaatatttgagcacaggtggagtagaaacaaatcacaaagactttaaggagttgaggtataatgaaagtctcacaaacttcagctgtcatgggaagaatggaaccaccaatggaaggatcactcatggtttcaagttacagagtgcctatgagagtggcctgatgccttacacgaattacacatttgatttcaagggtataatagactacattttctattctaaacctcagctgaacaccttaggcatcctgggccctctggaccaccactggctggttgagaataacatcagtggctgcccgcaccccctcatcccctctgaccacttctcactttttgcacaactggagctcttactgcctttcctgccccaagtcaacggcatccaccttcctggcaggaggtagtcaagcaccttcagaggacagccttgattcacttgtaaacttgtgaaaatctgaacataggggagtgaggtatggccactgaggatttttgcttgcttaagaatgatttggactttcaatctgattatttgataaggatatagtatgaaagccaggtgctagcaacagacaaattctgagcccaatatgctttatactgctagacagggattggtgtgtttgcacctgtctttcatttgtcataagagattttcctatttcttctacccaatagaatattttcatgcctggaaataggaaaatgtgtgaacagcgtattctcttcacacagaaatctgtagcactgcttttttgaggccagtagcaacatccagagatcattcttccatactttactccctcctttttcagacttgtttgtaaagtacagaatctgaatttagcctttatgattgtatatgatccacagaagacctgatttatgaaattttgtactaaaatcatttggaaatgattgtattgtaaactgaggctaaatttttttttaaacctgtttcatgtgttataaaggccagcttgtaaaagaagctgcaacagactttctctgctcatgatttgcactcttagggttttgttagcccttttgtactactttctttttaaattgagaacatggttctttacatataaatctgcttcaaccttaggatgttttcagaccagaggcaacttattcatgaatttttatgaaaactatctactaggacagataagctgaacagtgatgatctgtagacatttatggactgaatgtaatggttgatatatgtacattctgatatttttaaatctttaactttttaaagttaaaaacctacagctgcttaggtccagcttcttaactctttttgagacacttcctgtcctatctccactgtgcctgcctaaatttgttctcaccaagcactgcctgtgcatgcagagaaaatctgtgcatcctcttttatatttttaaaatactgtttaacatttgtgagaattttatgaaaatgcttttgtatgagctgtggctttttcccattgtgaagcattgaatatcacattttggaacatgttatagggtgagtccctggatctttgctcaccagatccaagcactgcttctcggtgtcattgcagtgtgctgcttgtcacccagaatactactatcatgtgaattctttttgtcgtcagtgtcttttccttagtctttttgttgttgttgttgttgttgttttaatcattccttttttaagaagaagtaattttccatttatgaagcagtatgaattagatgtattttcaaaacaggtccctaagacaattcttcagatcatttttaaaatgactaagtcattttagtatgtcaagcaagataaaaattacatcataccgtctattttgcccatagtgccatttagagatgaaaaccagctttaactttgcaaagtgaacatgtacatggtctgctctcatttattcattcttctctcaaaagtcaaatgaatgcagagggagcttggtcaaactgcttttgtttcaactgcaggcaggggagcaaaaggacgccatgtgagcattaggaaaaaaaatactcactcttactaacaatttttatacagaaaatgagtcattttggaaatgattcttatgttttttttttttctccttttagaaaattctccaaaaggttttgatgttgaatcttggtcttggacctgttttttcctttgagggttttttgttttttgttttttctaggatttcattgtgatgttttggttttgttttttgctttttgtttaagttgtgctgacaccaaacacatccagtttataatcagtacattggaaagctggtattgatgtagaaccagtgcataactttttatggggttttgttattggtttttttttgtaaagtgtgaataaaaggtatgtttactcatttttcctgaacactgtgttggtaatgtgcatcatgacaatttccagtgaaggtgagctggagctggttggactaatgagactgaggaagcagcttttcctacgatctgcattatgtaatcacaggtccagagagctttatggaagcgggagaggaggagcacttactcatgttgtatttgttaatggaggatgtcatcttttcatagatgctggaactagagtgcacttgttagatgctaaaggtttgagctttacacaaaatgtcttcatctgtatttgttattgtctacaatatatttgaatttggggcagcatattaagatgtaatggcctgttatgtcttgaaaatacttgttttgcctcttccaggcatactgcattctgtggatcagtttgaacagcttctccaccttatttggacagtgataaattgaaccaagagtgtagatttacaagtgtaaccttcaaaagaggaagaactatttggggtctgtaggtaatgaacagtcacaccaaaatagactatgatgcttttgttaagaaaggtttcatgttttagatattttccgtgtcctaaataattttcaataatctataatccctaaaatgcaataaaaactagtatgttttcacggtgtatattttttttcaaaaattctgtaacaaatatatttaatgtgttgccataatgtcatttcagtatttttgctggataaatccattttagaaatgtcttacaaaaagtttagggcatgttttctgttttaaagaccagaagtttgaaggcacccaaatccttgtcgccaatctcctgaagtacagctttaccatattagtggtcattatttatgctttgagagtttcaatattgttcgtcaagttaacttatggcataatttaagctaaagttgtagaaatgaattgttgagtgcaactttcatagtcccaaagataggcagagaacatctccagaaatgtgtgtgtgtgtgtgtgtgtgtgtgtgtgtgtttaatatgatttagtgacaaccaggaaaacttacttgggattattagcactttcaaacttagggacattattaaattggatggaatgcacttctaaatgtttaaattaaaatttcaaagctctttcgagattcaggttctcaataataatattcaagttttagagtttcactttgtactatttaaatttatggaactagtttccatactgacttgtaaggttttggggtcatatataaggactaaagccaagctaggcaaaacaatgacagcaccgttttttcagtgaagctctcagaatgtccagtacagatgttgcagataattccaagaactccttcagcaggtgttcttcaccattcgtaaacagtattttaagatgttcactttgctcttctttttggttacatacattttaataactggtatgttgaagtagtgtctaaaagtatctagtctttattcacagtacattatattgtgtgatgcactggactaactcttgtttaccattcatgtaacaaaacccagcacattatctgcactataagctcaaagaatgtcacatccgcccagacagctctttgatgagggtgatgggaactgaataaaccatacggactggcagtaacaagggcttttactgttctgttcagtggaaccttcttggtcaaattgtaattagctagcattatatttatatacagggtcttttttctttaccgatgtattttcctactcatagccaaccaataaattcagtatctgtttcaaatattttagaagtgtagtttgtatagctgtagtactgaggtttgaggaaaaataaatgttgatcagcagaccacgtatttaaaattctgaatcttctgggacagggttgtaactcagccttccaaagggaagagtgcagggggacggggccatgatatggggaaatggtgtaaactaatgtatttctttattggctgttattctgtataacactcatatctttgccaaagttcaattttatatttaggcaactgatggtccttttgcatttaggattttcgttgttgttaccttatacctcatgatataaggaatgggctcatgtgtcttccgtcttttggaaggaggttgacatattttaaataaatgcttttaaatacagta

SEQ ID NO: 4959 - DNA, 6303 bp, Homo sapiens
ggcgcggaggaggaggcggcggcgtcggtggcggcggcgacggcggcgcggaggcgaaggcagcggcgggcagccgaagcagtggctctcggagggggaacaaagagcagcgactaaggcggcagaggagcggcggcggtggcggcgctgcagcagcgggcgggactggtatggtggttccacagggcagaccccgctgcactcacagggaggaggaggcggcagcggcggaggaaggcggcgcaccccgagagcactaatcgctattttctttggaaacttcctttgattctttacctccttcaccttccccgaagagcctgctaaccaacacctgtggccttctgtttttaactgttgttgccattgacagcgttgtgaatggtcatctcgctcgagctctttggatttgttgttactgtgcatgcccaaagaaaaatacgagccccctgaccctcggaggatgtatacaattatgtcttctgaggaagcagcaaatggaaagaaatcccactgggcagagcttgaaataagtggaaaagtaagaagcttaagcgcatctttgtggtcactaactcacctgacagctttgcatttgagtgacaattccctgtcccgaattccttcagacattgccaagcttcacaatctggtgtatttggacctgtcatctaataaaattcgtagcttacccgcagaactcggaaacatggtatcactcagggagctccatttaaataacaacctgttacgagttctaccttttgagctgggaaaactgtttcagttgcagactttaggcctgaaaggaaatccccttacccaggatatattgaacctttatcaggaaccagatggaacaagacggctgctgaactatttgcttgataatttgtcaggtactgcaaaaagaattacaacagaacaaccacctccaaggtcttggattatgttacaagaaccagataggacaaggccaactgccttgttttctgtcatgtgctataatgttctttgtgataaatatgcgacccggcagttatacggctactgtccatcatgggcgctaaactgggactacaggaaaaaggccattattcaagaaatcttgagctgcaatgctgatatcgtaagtcttcaggaggttgaaacggaacagtattacagtttttttctggtagagctgaaagaacgtggctataatggattcttcagtcctaagtctagagctaggacaatgtcagaacaagaaaggaaacatgttgatggctgtgcaatattcttcaagacagaaaaatttactttggttcagaaacacactgttgaatttaatcagctagccatggcaaattctgaggggtctgaagctatgctgaacagagtcatgacaaaagataacattggggttgcagtactgctagaacttcggaaggaatcgattgaaatgccgtccggaaagccacatcttggaacagaaaaacaacttattcttgtggctaacgcccacatgcattgggaccctgaatactctgatgtgaagttggtacaaactatgatgttcctctcagaagtgaagaacattattgataaagcctctcgcaacctcaaatccagtgttttgggagaatttggaactattccacttgtgttatgtgcagatcttaattctttgccagactctggtgttgtagaatatttgagcacaggtggagtagaaacaaatcacaaagactttaaggagttgaggtataatgaaagtctcacaaacttcagctgtcatgggaagaatggaaccaccaatggaaggatcactcatggtttcaagttacagagtgcctatgagagtggcctgatgccttacacgaattacacatttgatttcaagggtataatagactacattttctattctaaacctcagctgaacaccttaggcatcctgggccctctggaccaccactggctggttgagaataacatcagtggctgcccgcaccccctcatcccctctgaccacttctcactttttgcacaactggagctcttactgcctttcctgccccaagtcaacggcatccaccttcctggcaggaggtagtcaagcaccttcagaggacagccttgattcacttgtaaacttgtgaaaatctgaacataggggagtgaggtatggccactgaggatttttgcttgcttaagaatgatttggactttcaatctgattatttgataaggatatagtatgaaagccaggtgctagcaacagacaaattctgagcccaatatgctttatactgctagacagggattggtgtgtttgcacctgtctttcatttgtcataagagattttcctatttcttctacccaatagaatattttcatgcctggaaataggaaaatgtgtgaacagcgtattctcttcacacagaaatctgtagcactgcttttttgaggccagtagcaacatccagagatcattcttccatactttactccctcctttttcagacttgtttgtaaagtacagaatctgaatttagcctttatgattgtatatgatccacagaagacctgatttatgaaattttgtactaaaatcatttggaaatgattgtattgtaaactgaggctaaatttttttttaaacctgtttcatgtgttataaaggccagcttgtaaaagaagctgcaacagactttctctgctcatgatttgcactcttagggttttgttagcccttttgtactactttctttttaaattgagaacatggttctttacatataaatctgcttcaaccttaggatgttttcagaccagaggcaacttattcatgaatttttatgaaaactatctactaggacagataagctgaacagtgatgatctgtagacatttatggactgaatgtaatggttgatatatgtacattctgatatttttaaatctttaactttttaaagttaaaaacctacagctgcttaggtccagcttcttaactctttttgagacacttcctgtcctatctccactgtgcctgcctaaatttgttctcaccaagcactgcctgtgcatgcagagaaaatctgtgcatcctcttttatatttttaaaatactgtttaacatttgtgagaattttatgaaaatgcttttgtatgagctgtggctttttcccattgtgaagcattgaatatcacattttggaacatgttatagggtgagtccctggatctttgctcaccagatccaagcactgcttctcggtgtcattgcagtgtgctgcttgtcacccagaatactactatcatgtgaattctttttgtcgtcagtgtcttttccttagtctttttgttgttgttgttgttgttgttttaatcattccttttttaagaagaagtaattttccatttatgaagcagtatgaattagatgtattttcaaaacaggtccctaagacaattcttcagatcatttttaaaatgactaagtcattttagtatgtcaagcaagataaaaattacatcataccgtctattttgcccatagtgccatttagagatgaaaaccagctttaactttgcaaagtgaacatgtacatggtctgctctcatttattcattcttctctcaaaagtcaaatgaatgcagagggagcttggtcaaactgcttttgtttcaactgcaggcaggggagcaaaaggacgccatgtgagcattaggaaaaaaaatactcactcttactaacaatttttatacagaaaatgagtcattttggaaatgattcttatgttttttttttttctccttttagaaaattctccaaaaggttttgatgttgaatcttggtcttggacctgttttttcctttgagggttttttgttttttgttttttctaggatttcattgtgatgttttggttttgttttttgctttttgtttaagttgtgctgacaccaaacacatccagtttataatcagtacattggaaagctggtattgatgtagaaccagtgcataactttttatggggttttgttattggtttttttttgtaaagtgtgaataaaaggtatgtttactcatttttcctgaacactgtgttggtaatgtgcatcatgacaatttccagtgaaggtgagctggagctggttggactaatgagactgaggaagcagcttttcctacgatctgcattatgtaatcacaggtccagagagctttatggaagcgggagaggaggagcacttactcatgttgtatttgttaatggaggatgtcatcttttcatagatgctggaactagagtgcacttgttagatgctaaaggtttgagctttacacaaaatgtcttcatctgtatttgttattgtctacaatatatttgaatttggggcagcatattaagatgtaatggcctgttatgtcttgaaaatacttgttttgcctcttccaggcatactgcattctgtggatcagtttgaacagcttctccaccttatttggacagtgataaattgaaccaagagtgtagatttacaagtgtaaccttcaaaagaggaagaactatttggggtctgtaggtaatgaacagtcacaccaaaatagactatgatgcttttgttaagaaaggtttcatgttttagatattttccgtgtcctaaataattttcaataatctataatccctaaaatgcaataaaaactagtatgttttcacggtgtatattttttttcaaaaattctgtaacaaatatatttaatgtgttgccataatgtcatttcagtatttttgctggataaatccattttagaaatgtcttacaaaaagtttagggcatgttttctgttttaaagaccagaagtttgaaggcacccaaatccttgtcgccaatctcctgaagtacagctttaccatattagtggtcattatttatgctttgagagtttcaatattgttcgtcaagttaacttatggcataatttaagctaaagttgtagaaatgaattgttgagtgcaactttcatagtcccaaagataggcagagaacatctccagaaatgtgtgtgtgtgtgtgtgtgtgtgtgtgtgtgtttaatatgatttagtgacaaccaggaaaacttacttgggattattagcactttcaaacttagggacattattaaattggatggaatgcacttctaaatgtttaaattaaaatttcaaagctctttcgagattcaggttctcaataataatattcaagttttagagtttcactttgtactatttaaatttatggaactagtttccatactgacttgtaaggttttggggtcatatataaggactaaagccaagctaggcaaaacaatgacagcaccgttttttcagtgaagctctcagaatgtccagtacagatgttgcagataattccaagaactccttcagcaggtgttcttcaccattcgtaaacagtattttaagatgttcactttgctcttctttttggttacatacattttaataactggtatgttgaagtagtgtctaaaagtatctagtctttattcacagtacattatattgtgtgatgcactggactaactcttgtttaccattcatgtaacaaaacccagcacattatctgcactataagctcaaagaatgtcacatccgcccagacagctctttgatgagggtgatgggaactgaataaaccatacggactggcagtaacaagggcttttactgttctgttcagtggaaccttcttggtcaaattgtaattagctagcattatatttatatacagggtcttttttctttaccgatgtattttcctactcatagccaaccaataaattcagtatctgtttcaaatattttagaagtgtagtttgtatagctgtagtactgaggtttgaggaaaaataaatgttgatcagcagaccacgtatttaaaattctgaatcttctgggacagggttgtaactcagccttccaaagggaagagtgcagggggacggggccatgatatggggaaatggtgtaaactaatgtatttctttattggctgttattctgtataacactcatatctttgccaaagttcaattttatatttaggcaactgatggtccttttgcatttaggattttcgttgttgttaccttatacctcatgatataaggaatgggctcatgtgtcttccgtcttttggaaggaggttgacatattttaaataaatgcttttaaatacagtagcaaacattgtgttggggttataataattcattaaatgtcttgttgcctgta

SEQ ID NO: 4960 - DNA, 2649 bp, Homo sapiens
atctagcgcccccgtcaggacgtgcgaaaagcgacggcgcagcacggtgcggcgcagctcctgctcgcctttcccttcgctgggcgagaggtgtctatggggcacccgctgccgccgccgctaccgccaccgccaccgccaccgccgccgagtgctgtctctatggcgaggaggaggaggaggagcgcgagctcagcgacacaagtacataaataaaggataaaatattttatgaaacaaatcttcaatcaagtataacattttgatgcttggcatctagactcccttgtgccctcactatgccagcggcaactgtagatcatagccaaagaatttgtgaagtttgggcttgcaacttggatgaagagatgaagaaaattcgtcaagttatccgaaaatataattacgttgctatggacaccgagtttccaggtgtggttgcaagacccattggagaattcaggagcaatgctgactatcaataccaactattgcggtgtaatgtagacttgttaaagataattcagctaggactgacatttatgaatgagcaaggagaataccctccaggaacttcaacttggcagtttaattttaaatttaatttgacggaggacatgtatgcccaggactctatagagctactaacaacatctggtatccagtttaaaaaacatgaggaggaaggaattgaaacccagtactttgcagaacttcttatgacttctggagtggtcctctgtgaaggggtcaaatggttgtcatttcatagcggttacgactttggctacttaatcaaaatcctaaccaactctaacttgcctgaagaagaacttgacttctttgagatccttcgattgttttttcctgtcatttatgatgtgaagtacctcatgaagagctgcaaaaatctcaaaggtggattacaggaggtggcagaacagttagagctggaacggataggaccacaacatcaggcaggatctgattcattgctcacaggaatggcctttttcaaaatgagagaaatgttctttgaagatcatattgatgatgccaaatattgtggtcatttgtatggccttggttctggttcatcctatgtacagaatggcacagggaatgcatatgaagaggaagccaacaagcagtcatgacatgaaatagtccttttatttttatttcgagctacacacatgcttgtatataggttttatctctggttgaatccctcgaacaatagacagtacctttcccccccctttcatggcccattttattgtctgcctttcagtactaagtatgaccgttcctatctcagatcttaataaaaagaaaaaaaaaaacgcattcaggttaaatttggccttaatttaatatacttgttagcaagcgtgtgtgacagagagtggggaaagctacatcattgaatattttgataaactttaccgacttgagtttggtttatttttcccttttcctaaattaactagcactgactgtaatttatttccctgtttcacgtctctcccttccattctgcaggagttttagctatttgagatcgtggaccatcagttttgcactttagagagtgtttctgactctaaacctgttttatcagaaaatttgttttttcttgatcttagctggaaaaatctgccaactttacacagtatttacttggttttgacccacagaatatagcacgttgtgcaaactgtcgattcagcgaaacttaaaaaagacaagaaactactgaggagcttagtaactgctgtttctgtacgtagtgtttaatcttccaagcacatctagtgtctgtcagtttctaattggcatgtgtaggctgctctgtgactgaagaattttcaaaccagctttacacccttcaggaaaaatcccttgtgattggatgtttactatctgccaggaaactggtactcaagatgttgaagctacagttattttatgatagcacacttcccttgatctgcttatttttattccatcaccatttaccctttttttttttttaaattttgtagccattcttatgatgctcttgatttgttggttacacaaatcaattttattaaaaatccaaagataagtctttaggtatattttgtaccaaattaaattagaagacaaaaattgtgctttcatagttgctacaaaggtaaataatggagagatttggtacaaaacaacaaaatatatatatattctcatatatatatatatagctgataaaattacctgaggagtgtaatgcttatttttttgtgtatatctttgcaatctattttatatatattgacaaaagagactgtgaaatacttagccatgcagaatatgtgaccagaccagagcatgtgtaggaagactttacggtaatcattaactctaccccgaaatgatggactacaagttataatgtgtgttacctacacttcaatcagtaatattagcaaatctccaaatgttagtcacattggtttgtctcccttgtacattctttattcatgatattacagtgctgtaactgggtggtcctttttaaacaaaacattatttgcaaaacagagggtattatttgtttttaaagcttttgtaaataaaggcttcaaaatgttttcttataaa

SEQ ID NO: 4961 - DNA, 568 bp, Homo sapiens
agtgggacggaaattgggagtggagggcggtggcctagatcctcacctcttcgtattgtttcacgcggcagtgcttgggagtcagtgtagctccagtcagtgttatcagcaccttcgcactggcgctttgccagggaagagagttatctatggcttgaatacctcggtgccgtcctctcgtttctctgggaaactgcagtacggagatgctttctccagtaatgagaaggcctttggtgtctcttcggggcttctgggactgcagtagagagagagaaggatttgaaatttccctgcccaagaatcaacaggaactctgtttatagaccagaaatgtgacatctatctttggtacataaataaaggataaaatattttatgaaacaaatcttcaatcaagtataacattttgatgcttggcatctagactcccttgtgccctcactatgccagcggcaactgtagatcatagccaaagaatttgtgaagtttgggcttgcaacttggatgaagagatgaagaaaattcgtcaagttatccgaaaatataattacgttgctatggacac

SEQ ID NO: 4962 - DNA, 1885 bp, Homo sapiens
atctagcgcccccgtcaggacgtgcgaaaagcgacggcgcagcacggtgcggcgcagctcctgctcgcctttcccttcgctgggcgagaggtgtctatggggcacccgctgccgccgccgctaccgccaccgccaccgccaccgccgccgagtgctgtctctatggcgaggaggaggaggaggagcgcgagctcagcgacacaagtacataaataaaggataaaatattttatgaaacaaatcttcaatcaagtataacattttgatgcttggcatctagactcccttgtgccctcactatgccagcggcaactgtagatcatagccaaagaatttgtgaagtttgggcttgcaacttggatgaagagatgaagaaaattcgtcaagttatccgaaaatataattacgttgctatggacaccgagtttccaggtgtggttgcaagacccattggagaattcaggagcaatgctgactatcaataccaactattgcggtgtaatgtagacttgttaaagataattcagctaggactgacatttatgaatgagcaaggagaataccctccaggaacttcaacttggcagtttaattttaaatttaatttgacggaggacatgtatgcccaggactctatagagctactaacaacatctggtatccagtttaaaaaacatgaggaggaaggaattgaaacccagtactttgcagaacttcttatgacttctggagtggtcctctgtgaaggggtcaaatggttgtcatttcatagcggttacgactttggctacttaatcaaaatcctaaccaactctaacttgcctgaagaagaacttgacttctttgagatccttcgattgttttttcctgtcatttatgatgtgaagtacctcatgaagagctgcaaaaatctcaaaggtggattacaggaggtggcagaacagttagagctggaacggataggaccacaacatcaggcaggatctgattcattgctcacaggaatggcctttttcaaaatgagagaagtatgaagacatcactgcctttttctcagttggttgttaggttgagaacattaaaaatcttgtggccaaagattttgggcaacaagtacctactaagtaaagatataattagagataccatatgagtcacatccaccacacttaaaagtattcaaaaataagtcatcttgaaatgtagttcagaaggaactgggagaacatgttcatcatagaaccaacaattttaaaacataaactacctgagaagtcatgtaggtccaaccatattatttctcaggtgagaaaacaggctaataacttccatgattaaacacattactagtgggagaactccagagttcttttctgactcccattggtgctcctcctacaaggcaaggaatctttatattaggtttattctagcatgaccccttttaaggtttaaactggtgataaatatattatttgctcatgtcattcttcagtgctttgaagattttatagagaagaactcaggctcttttactgcattgagtcttaaaaggggggttgaattccgaagggatcaaataaatccaacgtagtagttgcatcagaaaccatattaggaaaaccctccttaaacggcaaaaggcagagatcagttccttgagtataaagtgttagggatggaagaatgaaactaaatgaacccattatctactcctaagtaattaagtgatgtgcacagatacacctagctataggtaaacaggaaaattggttgtgcaaaaaacaagtgaggtttttcttgactataagttttcccttttggaaaaattcgctgtggatttgagtatattttctcttagacattaaattgagactgagaattt

SEQ ID NO: 4963 - DNA, 700 bp, Homo sapiens
gggacgatgaacctgagagggtgcgcgatggcgccagctggagtgcggctggcggaggaaggagcctggcggcgggttgggggctggaaggatttgaaatttccctgcccaagaatcaacaggaactctgtttatagaccagaaatgtgacatctatctttggtacataaataaaggataaaatattttatgaaacaaatcttcaatcaagtataacattttgatgcttggcatctagactcccttgtgccctcactatgccagcggcaactgtagatcatagccaaagaatttgtgaagtttgggcttgcaacttggatgaagagatgaagaaaattcgtcaagttatccgaaaatataattacgttgctatggacaccgagtttccaggtgtggttgcaagacccattggagaattcaggagcaatgctgactatcaataccaactattgcggtgtaatgtagacttgttaaagataattcagctaggactgacatttatgaatgagcaaggagaataccctccaggaacttcaacttggcagtttaattttaaatttaatttgacggaggacatgtatgcccaggactctatagagctactaacaacatctggtatccagtttaaaaaacatgaggaggaaggaattgaaacccagtactttgcagaacttcttatgacttctggagtggtcctctg

SEQ ID NO: 4964 - DNA, 2528 bp, Homo sapiens
gggtagagtggtgccgtccggttgtttggtgggaggcacgtaagaccgctctgggcacgggggcgctcacctcactggctcgttcggttctaggagcagatccggggtagagggaaaagagctccgggccaggggctgccgtcgccgccgtcggggagtcagcccgccagcccgccagctcgtcagcccgccagccagcgcttcgcgggccctgtcggtcccgatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttacagaggacatgtactcccaggattccatagatctccttgctaactcaggactacagtttcagaagcatgaagaggaagggattgacacactgcactttgcagagctgcttatgacatcaggagtggttctctgtgacaatgtcaaatggctttcatttcatagtggctatgattttggctatatggtaaagttgcttacagattctcgtttgccagaagaggaacatgaattctttcatattctgaaccttttcttcccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaagagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgcagggtgggcctgatcccagagtggtgcttactgtgctgactgtgtacttatcttccccaagagaaaatgcttcttttgagcacactgtacctaccatctgcattgagcagaaagacttttgttttactgaagacaaaagatgtttttattttagacccagaagagaggagtttgctctgaatttgtaaataagtcttccccattcctcatactcgagcctctcctctctggttgcctcctgccaccagcatccatggctcatttgacacctttttaaatatcaggacaagtctgaaacaaagtagtaaaatgtatataactcttacctgttgtcattctttttcttttaaatttgttgctaatctctgataatgaagattcttactctgattctcagctgagctgtgagggcttccagggaaaatggaacaaaatggtgttcttaggtaatgggttgtagatactgagtcttcctttccttttctgacccttctcgaggacatttgctttcctcacacttttgtagtctctctttacatattactatatggaaatgaattgctctgtgctgaaatttgaagaccagataatgaaactgaaaagcaaacaattttactgaatctgtctacccttcattcatgagaactccagaatgagtgttgaccactgaagcatcttttaagtctgtgttccattgtgccattcaggtttgctgtcacatatgcatcatctgaaatcatttgaaatttttgtacaataaaatatcctggatttgatcctgaaggaaactagtaagatcagatttttgggtcatgtctgttgtattttcagtaatgtgatttcagatggtcatctggattctcccacttctctactccattatttctctacttttccttccagcaaacctgaaacgtgagggagatggattaatgtgagtaacaggaatgtgtctttaaaaagctagagtggttacatttaatcaggcagtaagataatttgggttcttgagttgttttggagtaatatcccacaactggggtaggaagctcaggacttttttctttaaagctagtcatttcaaaagcatattgtatttttttgaatgactacagtatggacaatttcaaaaaccaaaacccactttggattggtggaagtaaaaactggtaactcactcaagtgaatgaatggtcttgcattttaaaagcttatgggaaactcaatttgaaatgattagaaaatgtcaagtattataagctggtatttaagatgcttgtaaatactatttatgtttttaattttgtaaaataaagatttctttttaaccactggcat

SEQ ID NO: 4965 - DNA, 2604 bp, Homo sapiens
agagagcaggcgagtcgggcggatcgggtgggtagagtggtgccgtccggttgtttggtgggaggcacgtaagaccgctctgggcacgggggcgctcacctcactggctcgttcggttctaggagcagatccggggtagagggaaaagagctccgggccaggggctgccgtcgccgccgtcggggagtcagcccgccagcccgccagctcgtcagcccgccagccagcgcttcgcgggccctgtcggtcccggtaagcgggcctgcgcttaccggaaagaggagcgtaagatgaaagagtatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttacagaggacatgtactcccaggattccatagatctccttgctaactcaggactacagtttcagaagcatgaagaggaagggattgacacactgcactttgcagagctgcttatgacatcaggagtggttctctgtgacaatgtcaaatggctttcatttcatagtggctatgattttggctatatggtaaagttgcttacagattctcgtttgccagaagaggaacatgaattctttcatattctgaaccttttcttcccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaagagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgcagggtgggcctgatcccagagtggtgcttactgtgctgactgtgtacttatcttccccaagagaaaatgcttcttttgagcacactgtacctaccatctgcattgagcagaaagacttttgttttactgaagacaaaagatgtttttattttagacccagaagagaggagtttgctctgaatttgtaaataagtcttccccattcctcatactcgagcctctcctctctggttgcctcctgccaccagcatccatggctcatttgacacctttttaaatatcaggacaagtctgaaacaaagtagtaaaatgtatataactcttacctgttgtcattctttttcttttaaatttgttgctaatctctgataatgaagattcttactctgattctcagctgagctgtgagggcttccagggaaaatggaacaaaatggtgttcttaggtaatgggttgtagatactgagtcttcctttccttttctgacccttctcgaggacatttgctttcctcacacttttgtagtctctctttacatattactatatggaaatgaattgctctgtgctgaaatttgaagaccagataatgaaactgaaaagcaaacaattttactgaatctgtctacccttcattcatgagaactccagaatgagtgttgaccactgaagcatcttttaagtctgtgttccattgtgccattcaggtttgctgtcacatatgcatcatctgaaatcatttgaaatttttgtacaataaaatatcctggatttgatcctgaaggaaactagtaagatcagatttttgggtcatgtctgttgtattttcagtaatgtgatttcagatggtcatctggattctcccacttctctactccattatttctctacttttccttccagcaaacctgaaacgtgagggagatggattaatgtgagtaacaggaatgtgtctttaaaaagctagagtggttacatttaatcaggcagtaagataatttgggttcttgagttgttttggagtaatatcccacaactggggtaggaagctcaggacttttttctttaaagctagtcatttcaaaagcatattgtatttttttgaatgactacagtatggacaatttcaaaaaccaaaacccactttggattggtggaagtaaaaactggtaactcactcaagtgaatgaatggtcttgcattttaaaagcttatgggaaactcaatttgaaatgattagaaaatgtcaagtattataagctggtatttaagatgcttgtaaatactatttatgtttttaattttgtaaaataaagatttctttttaaccactggca

SEQ ID NO: 4966 - DNA, 692 bp, Homo sapiens
ggatcgggtgggtagagtggtgccgtccggttgtttggtgggaggcacgtaagaccgctctgggcacgggggcgctcacctcactggctcgttcggttctaggagcagatccggggtagagggaaaagagctccgggccaggggctgccgtcgccgccgtcggggagtcagcccgccagcccgccagctcgtcagcccgccagccagcgcttcgcgggccctgtcggtcccggtaagcgggcctgcgcttaccggaaagaggagcatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttacagaggacatgtactcccaggattccatagatctccttgctaact

SEQ ID NO: 4967 - DNA, 2708 bp, Homo sapiens
gaggaccaaaatggaggagtaagaatcatgattaaattgagcgagcgcaactaatcacgcgaagagggccgcaggcgggccgtcttccgcaagcgtgcttccaggcctccactccccacctattcggcggcaccctgttacttctgctcctgcgcgctgcttcccgcgacctcacaggcagagcgaacacgcacggagtcgcaggggcgcgcaaagggggaggagcgggcgtgaccaggcgcgcgcgcgcgtctggagtgactctagagagcaggagcagatccggggtagagggaaaagagctccgggccaggggctgccgtcgccgccgtcggggagtcagcccgccagcccgccagctcgtcagcccgccagccagcgcttcgcgggccctgtcggtcccgatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttacagaggacatgtactcccaggattccatagatctccttgctaactcaggactacagtttcagaagcatgaagaggaagggattgacacactgcactttgcagagctgcttatgacatcaggagtggttctctgtgacaatgtcaaatggctttcatttcatagtggctatgattttggctatatggtaaagttgcttacagattctcgtttgccagaagaggaacatgaattctttcatattctgaaccttttcttcccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaagagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgcagggtgggcctgatcccagagtggtgcttactgtgctgactgtgtacttatcttccccaagagaaaatgcttcttttgagcacactgtacctaccatctgcattgagcagaaagacttttgttttactgaagacaaaagatgtttttattttagacccagaagagaggagtttgctctgaatttgtaaataagtcttccccattcctcatactcgagcctctcctctctggttgcctcctgccaccagcatccatggctcatttgacacctttttaaatatcaggacaagtctgaaacaaagtagtaaaatgtatataactcttacctgttgtcattctttttcttttaaatttgttgctaatctctgataatgaagattcttactctgattctcagctgagctgtgagggcttccagggaaaatggaacaaaatggtgttcttaggtaatgggttgtagatactgagtcttcctttccttttctgacccttctcgaggacatttgctttcctcacacttttgtagtctctctttacatattactatatggaaatgaattgctctgtgctgaaatttgaagaccagataatgaaactgaaaagcaaacaattttactgaatctgtctacccttcattcatgagaactccagaatgagtgttgaccactgaagcatcttttaagtctgtgttccattgtgccattcaggtttgctgtcacatatgcatcatctgaaatcatttgaaatttttgtacaataaaatatcctggatttgatcctgaaggaaactagtaagatcagatttttgggtcatgtctgttgtattttcagtaatgtgatttcagatggtcatctggattctcccacttctctactccattatttctctacttttccttccagcaaacctgaaacgtgagggagatggattaatgtgagtaacaggaatgtgtctttaaaaagctagagtggttacatttaatcaggcagtaagataatttgggttcttgagttgttttggagtaatatcccacaactggggtaggaagctcaggacttttttctttaaagctagtcatttcaaaagcatattgtatttttttgaatgactacagtatggacaatttcaaaaaccaaaacccactttggattggtggaagtaaaaactggtaactcactcaagtgaatgaatggtcttgcattttaaaagcttatgggaaactcaatttgaaatgattagaaaatgtcaagtattataagctggtatttaagatgcttgtaaatactatttatgtttttaattttgtaaaataaagatttctttttaaccactggca

SEQ ID NO: 4968 - DNA, 516 bp, Homo sapiens
ctaggagcagatccggggtagagggaaaagagctccgggccaggggctgccgtcgccgccgtcggggagtcagcccgccagcccgccagctcgtcagcccgccagccagcgcttcgcgggccctgtcggtcccgttcttgcggccccataactttttcttggtgttctatggctttatgaatggaggagccaactcacagacctgggccattcgggtggttttaagaagtttgaactgcggttcaatccagggcagtgccttgagacactgtttggagatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatggacacagaatttccaggtgttgtggtgcgaccaattggtgaatttcgta

SEQ ID NO: 4969 - DNA, 920 bp, Homo sapiens
aagagctccgggccaggggctgccgtcgccgccgtcggggagtcagcccgccagcccgccagctcgtcagcccgccagccagcgcttcgcgggccctgtcggtcccggtaagcgggcctgcgcttaccggaaagaggagcgtaagatgaaagagtgtgagagaccattggggatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttactggctatgattttggctatatggtaaagttgcttacagattctcgtttgccagaagaggaacatgaattctttcatattctgaaccttttcttcccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaagagttgttttttgaggacagcattgatgatgccaagtactgtgggcggctctatggcttaggcacaggagtggcccagaagcagaatgaggatgtggactctgcccaggaga

SEQ ID NO: 4970 - DNA, 620 bp, Homo sapiens
gtgaccaggcgcgcgcgcgcgtctggagtgactctagagagcaggcgagtcgggcggatcgggagcagatccggggtagagggaaaagagctccgggccaggggctgccgtcgccgccgtcggggagtcagcccgccagcccgccagctcgtcagcccgccagccagcgcttcgcgggccctgtcggtcccgatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttacagaggacatgtactcccaggattccatagatctccttgctaactc

SEQ ID NO: 4971 - DNA, 945 bp, Homo sapiens
gtagagggaaaagagctccgggccaggggctgccgtcgccgccgtcggggagtcagcccgccagcccgccagctcgtcagcccgccagccagcgcttcgcgggccctgtcggtcccgatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttactggctatgattttggctatatggtaaagttgcttacagattctcgtttgccagaagaggaacatgaattctttcatattctgaaccttttcttcccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaagagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgcagggtgggcctgatcccagagtg

SEQ ID NO: 4972 - DNA, 562 bp, Homo sapiens
tcgttcggttctaggagcagatccggggtagagggaaaagagctccgggccaggggctgccgtcgccgccgtcggggagtcagcccgccagcccgccagctcgtcagcccgccagccagcgcttcgcgggccctgtcggtcccggccttgattgcttgcagagaaaactttcctgtggctttatcattagttgcccttcagagctttcctgtgtaaataagaagctatgttttggagaagtttacaccgtagatgaacgggagcgatctgaacatactgcactgcaggtcaacacagagcagggacttcagtaattcataggtatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatggacacagaatttccaggtgttgtggtgcgaccaattggtgaatttcgtag

SEQ ID NO: 4973 - DNA, 648 bp, Homo sapiens
agagagcaggcgagtcgggcggatcgggagcagatccggggtagagggaaaagagctccgggccaggggctgccgtcgccgccgtcggggagtcagcccgccagcccgccagctcgtcagcccgccagccagcgcttcgcgggccctgtcggtcccggtaagcgggcctgcgcttaccggaaagaggagcgacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttacagaggacatgtactcccaggattccatagatctccttgctaactcaggactacagtttcagaagcatgaagaggaagggattgacacactgcactttgcagagctgcttatgacatcaggagtggttctctgtgacaatgtcaaatggctttcatttcatagtggctatgattttggctatatggtaaagttgcttacagattctcgtttgccagaagaggaacatgaattctttcatattctgaaccttttcttcccatccat

SEQ ID NO: 4974 - DNA, 912 bp, Homo sapiens
atggaggagtaagaatcatgattaaattgagcgagcgcaactaatcacgcgaagagggccgcaggcgggccgtcttccgcaagcgtgcttccaggcctccactccccacctattcggcggcaccctgttacttctgctcctgcgcgctgcttcccgcgacctcacaggcagagcgaacacgcacggagtcgcaggggcgcgcaaagggggaggagcgggcgtgaccaggcgcgcgcgcgcgtctggagtgactctagagagcaggagcagatccggggtagagggaaaagagctccgggccaggggctgccgtcgccgccgtcggggagtcagcccgccagcccgccagctcgtcagcccgccagccagcgcttcgcgggccctgtcggtcccggtaagcgggcctgcgcttaccggaaagaggagcgtaagatgaaagagtatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttacagaggacatgtactcccaggattccatagatctccttgctaactcaggactacagtttcagaagcatgaagaggaagggattgacac

SEQ ID NO: 4975 - DNA, 923 bp, Homo sapiens
gttcggttctaggagcagatccggggtagagggaaaagagctccgggccaggggctgccgtcgccgccgtcggggagtcagcccgccagcccgccagctcgtcagcccgccagccagcgcttcgcgggccctgtcggtcccggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttacagaggacatgtactcccaggattccatagatctccttgctaactcaggactacagtttcagaagcatgaagaggaagggattgacacactgcactttgcagagctgcttatgacatcaggagtggttctctgtgacaatgtcaaatggctttcatttcatagtggctatgattttggctatatggtaaagttgcttacagattctcgtttgccagaagaggaacatgaattctttcatattctgaaccttttcttcccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaagagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgcagg

SEQ ID NO: 4976 - DNA, 1158 bp, Homo sapiens
agagagcaggcgagtcgggcggatcgggagcagatccggggtagagggaaaagagctccgggccaggggctgccgtcgccgccgtcggggagtcagcccgccagcccgccagctcgtcagcccgccagccagcgcttcgcgggccctgtcggtcccgagaggacatgtactcccaggattccatagatctccttgctaactcaggactacagtttcagaagcatgaagaggaagggattgacacactgcactttgcagagctgcttatgacatcaggagtggttctctgtgacaatgtcaaatggctttcatttcatagtggctatgattttggctatatggtaaagttgcttacagattctcgtttgccagaagaggaacatgaattctttcatattctgaaccttttcttcccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaagagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgcagggtgggcctgatcccagagtggtgcttactgtgctgactgtgtacttatcttccccaagagaaaatgcttcttttgagcacactgtacctaccatctgcattgagcagaaagacttttgttttactgaagacaaaagatgtttttattttagacccagaagagaggagtttgctctgaatttgtaaataagtcttccccattcctcatactcgagcctctcctctctggttgcctcctgccaccagcatccatggctcatttgacacctttttaaatatcaggacaagtctgaaacaaagtagtaaaatgtatataactcttacctgttgtcattctttttcttttaaatttgttgctaatctctgataatgaagattcttactctgattctcagctgagctgtgagggcttcca

SEQ ID NO: 4977 - DNA, 1151 bp, Homo sapiens
gttcggttctaggagcagatccggggtagagggaaaagagctccgggccaggggctgccgtcgccgccgtcggggagtcagcccgccagcccgccagctcgtcagcccgccagccagcgcttcgcgggccctgtcggtcccggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttacatataagaaagaaaaagtcaacaataatacatgtgttgcttgagctaaaagacataggagaacagacaacacatacccattacatttctaggaaatacgagagaggacatgtactcccaggattccatagatctccttgctaactcaggactacagtttcagaagcatgaagaggaagggattgacacactgcactttgcagagctgcttatgacatcaggagtggttctctgtgacaatgtcaaatggctttcatttcatagtggctatgattttggctatatggtaaagttgcttacagattctcgtttgccagaagaggaacatgaattctttcatattctgaaccttttcttcccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaagagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgcagggtgggcctgatcccagagtggtgcttactgtgctgactgtgtacttatcttccccaagagaaaatgcttcttttgagcacactgtacctaccatctgcattgagcagaaagacttttgttttactga

SEQ ID NO: 4978 - DNA, 623 bp, Homo sapiens
ctagagagcaggcgagtcgggcggatcgggagcagatccggggtagagggaaaagagctccgggccaggggctgccgtcgccgccgtcggggagtcagcccgccagcccgccagctcgtcagcccgccagccagcgcttcgcgggccctgtcggtcccggtaagcgggcctgcgcttaccggaaagagatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttactggctatgattttggctatatggtaaagttgcttacagattctcgtttgcca

SEQ ID NO: 4979 - DNA, 862 bp, Homo sapiens
aaagaggaccaaaatggaggagtaagaatcatgattaaattgagcgagcgcaactaatcacgcgaagagggccgcaggcgggccgtcttccgcaagcgtgcttccaggcctccactccccacctattcggcggcaccctgttacttctgctcctgcgcgctgcttcccgcgacctcacaggcagagcgaacacgcacggagtcgcaggggcgcgcaaagggggaggagcgggcgtgaccaggcgcgcgcgcgcgtctggagtgactctagagagcagagaggacatgtactcccaggattccatagatctccttgctaactcaggactacagtttcagaagcatgaagaggaagggattgacacactgcactttgcagagctgcttatgacatcaggagtggttctctgtgacaatgtcaaatggctttcatttcatagtggctatgattttggctatatggtaaagttgcttacagattctcgtttgccagaagaggaacatgaattctttcatattctgaaccttttcttcccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaagagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgca

SEQ ID NO: 4980 - DNA, 904 bp, Homo sapiens
atcgggtgggtagagtggtgccgtccggttgtttggtgggaggcacgtaagaccgctctgggcacgggggcgctcacctcactggctcgttcggttctaggagcagatccggggtagagggaaaagagctccgggccaggggctgccgtcgccgccgtcggggagtcagcccgccagcccgccagctcgtcagcccgccagccagcgcttcgcgggccctgtcggtcccggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttactggctatgattttggctatatggtaaagttgcttacagattctcgtttgccagaagaggaacatgaattctttcatattctgaaccttttcttcccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaagagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgcagggtgggcctgatcccagagtggtgcttactgtgctgactgtgtacttatcttcccc

SEQ ID NO: 4981 - DNA, 1605 bp, Homo sapiens
agagtggtgccgtccggttgtttggtgggaggcacgtaagaccgctctgggcacgggggcgctcacctcactggctcgttcggttctaggagcagatccggggtagagggaaaagagctccgggccaggggctgccgtcgccgccgtcggggagtcagcccgccagcccgccagctcgtcagcccgccagccagcgcttcgcgggccctgtcggtcccgatcagaccaaacattgtctggcttgcactgtaaaactagttagctgaagagatgaggaagatccgagaaatcgtgctcagttacagttatattgccatggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttacagaggacatgtactcccaggattccatagatctccttgctaactcaggactacagtttcagaagcatgaagaggaagggattgacacactgcactttgcagagctgcttatgacatcaggagtggttctctgtgacaatgtcaaatggctttcatttcatagtggctatgattttggctatatggtaaagttgcttacagattctcgtttgccagaagaggaacatgaattctttcatattctgaaccttttcttcccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaagagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgcagggtgggcctgatcccagagtggtgcttactgtgctgactgtgtacttatcttccccaagagaaaatgcttcttttgagcacactgtacctaccatctgcattgagcagaaagacttttgttttactgaagacaaaagatgtttttattttagacccagaagagaggagtttgctctgaatttgtaaataagtcttccccattcctcatactcgagcctctcctctctggttgcctcctgccaccagcatccatggctcatttgacacctttttaaatatcaggacaagtctgaaacaaagtagtaaaatgtatataactcttacctgttgtcattctttttcttttaaatttgttgctaatctctgataatgaagattcttactctgattctcagctgagctgtgagggcttccagggaaaatggaacaaaatggtgttcttaggtaatgggttgtagatactgagtcttcctttccttttctgacccttctcgaggacatttgctt

SEQ ID NO: 4982 - DNA, 5882 bp, Homo sapiens
ctaaactcgaattaagagggaaaaaaaatcagggaggaggtggcaagccacaccccacggtgcccgcgaacttccccggcagcggactgtagcccaggcagacgccgtcgagatgcagggcccaccgctcctgaccgccgcccacctcctctgcgtgtgcaccgccgcgctggccgtggctcccgggcctcggtttctggtgacagccccagggatcatcaggcccggaggaaatgtgactattggggtggagcttctggaacactgcccttcacaggtgactgtgaaggcggagctgctcaagacagcatcaaacctcactgtctctgtcctggaagcagaaggagtctttgaaaaaggctcttttaagacacttactcttccatcactacctctgaacagtgcagatgagatttatgagctacgtgtaaccggacgtacccaggatgagattttattctctaatagtacccgcttatcatttgagaccaagagaatatctgtcttcattcaaacagacaaggccttatacaagccaaagcaagaagtgaagtttcgcattgttacactcttctcagattttaagccttacaaaacctctttaaacattctcattaaggaccccaaatcaaatttgatccaacagtggttgtcacaacaaagtgatcttggagtcatttccaaaacttttcagctatcttcccatccaatacttggtgactggtctattcaagttcaagtgaatgaccagacatactatcaatcatttcaggtttcagaatatgtattaccaaaatttgaagtgactttgcagacaccattatattgttctatgaattctaagcatttaaatggtaccatcacggcaaagtatacatatgggaagccagtgaaaggagacgtaacgcttacatttttacctttatccttttggggaaagaagaaaaatattacaaaaacatttaagataaatggatctgcaaacttctcttttaatgatgaagagatgaaaaatgtaatggattcttcaaatggactttctgaatacctggatctatcttcccctggaccagtagaaattttaaccacagtgacagaatcagttacaggtatttcaagaaatgtaagcactaatgtgttcttcaagcaacatgattacatcattgagttttttgattatactactgtcttgaagccatctctcaacttcacagccactgtgaaggtaactcgtgctgatggcaaccaactgactcttgaagaaagaagaaataatgtagtcataacagtgacacagagaaactatactgagtactggagcggatctaacagtggaaatcagaaaatggaagctgttcagaaaataaattatactgtcccccaaagtggaacttttaagattgaattcccaatcctggaggattccagtgagctacagttgaaggcctatttccttggtagtaaaagtagcatggcagttcatagtctgtttaagtctcctagtaagacatacatccaactaaaaacaagagatgaaaatataaaggtgggatcgccttttgagttggtggttagtggcaacaaacgattgaaggagttaagctatatggtagtatccaggggacagttggtggctgtaggaaaacaaaattcaacaatgttctctttaacaccagaaaattcttggactccaaaagcctgtgtaattgtgtattatattgaagatgatggggaaattataagtgatgttctaaaaattcctgttcagcttgtttttaaaaataagataaagctatattggagtaaagtgaaagctgaaccatctgagaaagtctctcttaggatctctgtgacacagcctgactccatagttgggattgtagctgttgacaaaagtgtgaatctgatgaatgcctctaatgatattacaatggaaaatgtggtccatgagttggaactttataacacaggatattatttaggcatgttcatgaattcttttgcagtctttcaggaatgtggactctgggtattgacagatgcaaacctcacgaaggattatattgatggtgtttatgacaatgcagaatatgctgagaggtttatggaggaaaatgaaggacatattgtagatattcatgacttttctttgggtagcagtccacatgtccgaaagcattttccagagacttggatttggctagacaccaacatgggttacaggatttaccaagaatttgaagtaactgtacctgattctatcacttcttgggtggctactggttttgtgatctctgaggacctgggtcttggactaacaactactccagtggagctccaagccttccaaccatttttcatttttttgaatcttccctactctgttatcagaggtgaagaatttgctttggaaataactatattcaattatttgaaagatgccactgaggttaaggtaatcattgagaaaagtgacaaatttgatattctaatgacttcaaatgaaataaatgccacaggccaccagcagacccttctggttcccagtgaggatggggcaactgttctttttcccatcaggccaacacatctgggagaaattcctatcacagtcacagctctttcacccactgcttctgatgctgtcacccagatgattttagtaaaggctgaaggaatagaaaaatcatattcacaatccatcttattagacttgactgacaataggctacagagtaccctgaaaactttgagtttctcatttcctcctaatacagtgactggcagtgaaagagttcagatcactgcaattggagatgttcttggtccttccatcaatggcttagcctcattgattcggatgccttatggctgtggtgaacagaacatgataaattttgctccaaatatttacattttggattatctgactaaaaagaaacaactgacagataatttgaaagaaaaagctctttcatttatgaggcaaggttaccagagagaacttctctatcagagggaagatggctctttcagtgcttttgggaattatgacccttctgggagcacttggttgtcagcttttgttttaagatgtttccttgaagccgatccttacatagatattgatcagaatgtgttacacagaacatacacttggcttaaaggacatcagaaatccaacggtgaattttgggatccaggaagagtgattcatagtgagcttcaaggtggcaataaaagtccagtaacacttacagcctatattgtaacttctctcctgggatatagaaagtatcagcctaacattgatgtgcaagagtctatccattttttggagtctgaattcagtagaggaatttcagacaattatactctagcccttataacttatgcattgtcatcagtggggagtcctaaagcgaaggaagctttgaatatgctgacttggagagcagaacaagaaggtggcatgcaattctgggtgtcatcagagtccaaactttctgactcctggcagccacgctccctggatattgaagttgcagcctatgcactgctctcacacttcttacaatttcagacttctgagggaatcccaattatgaggtggctaagcaggcaaagaaatagcttgggtggttttgcatctactcaggataccactgtggctttaaaggctctgtctgaatttgcagccctaatgaatacagaaaggacaaatatccaagtgaccgtgacggggcctagctcaccaagtcctgtaaagtttctgattgacacacacaaccgcttactccttcagacagcagagcttgctgtggtacagccaacggcagttaatatttccgcaaatggttttggatttgctatttgtcagctcaatgttgtatataatgtgaaggcttctgggtcttctagaagacgaagatctatccaaaatcaagaagcctttgatttagatgttgctgtaaaagaaaataaagatgatctcaatcatgtggatttgaatgtgtgtacaagcttttcgggcccgggtaggagtggcatggctcttatggaagttaacctattaagtggctttatggtgccttcagaagcaatttctctgagcgagacagtgaagaaagtggaatatgatcatggaaaactcaacctctatttagattctgtaaatgaaacccagttttgtgttaatattcctgctgtgagaaactttaaagtttcaaatacccaagatgcttcagtgtccatagtggattactatgagccaaggagacaggctgtgagaagttacaactctgaagtgaagctgtcctcctgtgacctttgcagtgatgtccagggctgccgtccttgtgaggatggagcttcaggctcccatcatcactcttcagtcatttttattttctgtttcaagcttctgtactttatggaactttggctgtgatttatttttaaaggactctgtgtaacactaacatttccagtagtcacatgtgattgttttgttttcgtagaagaatactgcttctattttgaaaaaagagttttttttctttctatggggttgcagggatggtgtacaacaggtcctagcatgtatagctgcatagatttcttcacctgatctttgtgtggaagatcagaatgaatgcagttgtgtgtctatattttcccctctcaaaatcttttagaatttttttggaggtgtttgttttctccagaataaaggtattactttagaataggtattctcctcattttgtgaaagaaatgaacctagattcttaagcattattacacatccatgtttgcttaaagatggatttccctgggaatgggagaaaacagccagcaggaggagcttcatctgttcccttcccacctccaacctagccctactgcccaccccaccccaacccaccccatgcccagtggtctcagtagatacttcttaactggaaattctttcttttcagaatctaggtggtgaattttttttaagtggcacggtctttttctgcttgaaatctgatcacaccccccagccattgccctccctctctttttcctctgtagagaaatgtgaggggcagtacatttactgtgcttttcacaccatctcagaggttgaggagcatactgaaaattgccctggggggtgctgggtgtgctatctccttcccacatcctcagccccacaccagctctatttcaggggtgagagtcagagagcactgcaatatgtgcttcatgggatttcgattcgaagatcctagaccagggagacactgtgagccagggatacaacaaaatactaggtaagtcactgcagaccgacctccctgcagtttgggaaagaagctgggtttgtggagaatcagagcatcttgacatgactgctgacctaaagatccctggcattggccagggatcctgtggaacctcttctagttcaggggtgtgagcattagactgccagttgtctagtgacatctgatgcttgctgtgaacttttaagatccccgaatcctgagcacctcaatctttaattgccctgtattccgaagggtaatataatttatctggatggaaattttaaagatgaatcccccttttttcttttcttctctcttttctttccttctccctttcttctttgccttctaaatatactgaaatgatttagatatgtgtcaacaattaatgatcttttattcaatctaagaaatggtttagtttttctctttagctctatggcatttcactcaagtggacaggggaaaaagtaattgccatgggctccaaagaatttgctttatgtttttagctatttaaaaataaatccatcaaaaataaagtatgcaaatgtatctttt

SEQ ID NO: 4983 - DNA, 9221 bp, Homo sapiens
atagttgctatgaatttctcctcacaaggatgggcctgtttactcaccctgggcatcgttggtagagcgctagtgtaaacagcctgaggaacccggtgggccggggaagtgggcgcgctctgttctccgcggccagctgggacgccgggccaggtggggccgcctgcgtttagcaactgctttctcaccccctggatttgcgatgtttgccacagcagcgagaagcgccattgtaatggggatgggaggggtggagcctccaagtcctgtctcaatttagatctctcactctgctgttaggcgcgcccatttcagattactaaactcgaattaagagggaaaaaaaatcagggaggaggtggcaagccacaccccacggtgcccgcgaacttccccggcagcggactgtagcccaggcagacgccgtcgagatgcagggcccaccgctcctgaccgccgcccacctcctctgcgtgtgcaccgccgcgctggccgtggctcccgggcctcggtttctggtgacagccccagggatcatcaggcccggaggaaatgtgactattggggtggagcttctggaacactgcccttcacaggtgactgtgaaggcggagctgctcaagacagcatcaaacctcactgtctctgtcctggaagcagaaggagtctttgaaaaaggctcttttaagacacttactcttccatcagaccccaaatcaaatttgatccaacagtggttgtcacaacaaagtgatcttggagtcatttccaaaacttttcagctatcttcccatccaatacttggtgactggtctattcaagttcaagtgaatgaccagacatactatcaatcatttcaggtttcagaatatgtattaccaaaatttgaagtgactttgcagacaccattatattgttctatgaattctaagcatttaaatggtaccatcacggcaaagtatacatatgggaagccagtgaaaggagacgtaacgcttacatttttacctttatccttttggggaaagaagaaaaatattacaaaaacatttaagataaatggatctgcaaacttctcttttaatgatgaagagatgaaaaatgtaatggattcttcaaatggactttctgaatacctggatctatcttcccctggaccagtagaaattttaaccacagtgacagaatcagttacaggtatttcaagaaatgtaagcactaatgtgttcttcaagcaacatgattacatcattgagttttttgattatactactgtcttgaagccatctctcaacttcacagccactgtgaaggtaactcgtgctgatggcaaccaactgactcttgaagaaagaagaaataatgtagtcataacagtgacacagagaaactatactgagtactggagcggatctaacagtggaaatcagaaaatggaagctgttcagaaaataaattatactgtcccccaaagtggaacttttaagattgaattcccaatcctggaggattccagtgagctacagttgaaggcctatttccttggtagtaaaagtagcatggcagttcatagtctgtttaagtctcctagtaagacatacatccaactaaaaacaagagatgaaaatataaaggtgggatcgccttttgagttggtggttagtggcaacaaacgattgaaggagttaagctatatggtagtatccaggggacagttggtggctgtaggaaaacaaaattcaacaatgttctctttaacaccagaaaattcttggactccaaaagcctgtgtaattgtgtattatattgaagatgatggggaaattataagtgatgttctaaaaattcctgttcagcttgtttttaaaaataagataaagctatattggagtaaagtgaaagctgaaccatctgagaaagtctctcttaggatctctgtgacacagcctgactccatagttgggattgtagctgttgacaaaagtgtgaatctgatgaatgcctctaatgatattacaatggaaaatgtggtccatgagttggaactttataacacaggatattatttaggcatgttcatgaattcttttgcagtctttcaggaatgtggactctgggtattgacagatgcaaacctcacgaaggattatattgatggtgtttatgacaatgcagaatatgctgagaggtttatggaggaaaatgaaggacatattgtagatattcatgacttttctttgggtagcagtccacatgtccgaaagcattttccagagacttggatttggctagacaccaacatgggttacaggatttaccaagaatttgaagtaactgtacctgattctatcacttcttgggtggctactggttttgtgatctctgaggacctgggtcttggactaacaactactccagtggagctccaagccttccaaccatttttcatttttttgaatcttccctactctgttatcagaggtgaagaatttgctttggaaataactatattcaattatttgaaagatgccactgaggttaaggtaatcattgagaaaagtgacaaatttgatattctaatgacttcaaatgaaataaatgccacaggccaccagcagacccttctggttcccagtgaggatggggcaactgttctttttcccatcaggccaacacatctgggagaaattcctatcacagtcacagctctttcacccactgcttctgatgctgtcacccagatgattttagtaaaggctgaaggaatagaaaaatcatattcacaatccatcttattagacttgactgacaataggctacagagtaccctgaaaactttgagtttctcatttcctcctaatacagtgactggcagtgaaagagttcagatcactgcaattggagatgttcttggtccttccatcaatggcttagcctcattgattcggatgccttatggctgtggtgaacagaacatgataaattttgctccaaatatttacattttggattatctgactaaaaagaaacaactgacagataatttgaaagaaaaagctctttcatttatgaggcaaggttaccagagagaacttctctatcagagggaagatggctctttcagtgcttttgggaattatgacccttctgggagcacttggttgtcagcttttgttttaagatgtttccttgaagccgatccttacatagatattgatcagaatgtgttacacagaacatacacttggcttaaaggacatcagaaatccaacggtgaattttgggatccaggaagagtgattcatagtgagcttcaaggtggcaataaaagtccagtaacacttacagcctatattgtaacttctctcctgggatatagaaagtatcagcctaacattgatgtgcaagagtctatccattttttggagtctgaattcagtagaggaatttcagacaattatactctagcccttataacttatgcattgtcatcagtggggagtcctaaagcgaaggaagctttgaatatgctgacttggagagcagaacaagaaggtggcatgcaattctgggtgtcatcagagtccaaactttctgactcctggcagccacgctccctggatattgaagttgcagcctatgcactgctctcacacttcttacaatttcagacttctgagggaatcccaattatgaggtggctaagcaggcaaagaaatagcttgggtggttttgcatctactcaggataccactgtggctttaaaggctctgtctgaatttgcagccctaatgaatacagaaaggacaaatatccaagtgaccgtgacggggcctagctcaccaagtcctgtaaagtttctgattgacacacacaaccgcttactccttcagacagcagagcttgctgtggtacagccaacggcagttaatatttccgcaaatggttttggatttgctatttgtcagctcaatgttgtatataatgtgaaggcttctgggtcttctagaagacgaagatctatccaaaatcaagaagcctttgatttagatgttgctgtaaaagaaaataaagatgatctcaatcatgtggatttgaatgtgtgtacaagcttttcgggcccgggtaggagtggcatggctcttatggaagttaacctattaagtggctttatggtgccttcagaagcaatttctctgagcgagacagtgaagaaagtggaatatgatcatggaaaactcaacctctatttagattctgtaaatgaaacccagttttgtgttaatattcctgctgtgagaaactttaaagtttcaaatacccaagatgcttcagtgtccatagtggattactatgagccaaggagacaggctgtgagaagttacaactctgaagtgaagctgtcctcctgtgacctttgcagtgatgtccagggctgccgtccttgtgaggatggagcttcaggctcccatcatcactcttcagtcatttttattttctgtttcaagcttctgtactttatggaactttggctgtgatttatttttaaaggactctgtgtaacactaacatttccagtagtcacatgtgattgttttgttttcgtagaagaatactgcttctattttgaaaaaagagttttttttctttctatggggttgcagggatggtgtacaacaggtcctagcatgtatagctgcatagatttcttcacctgatctttgtgtggaagatcagaatgaatgcagttgtgtgtctatattttcccctctcaaaatcttttagaatttttttggaggtgtttgttttctccagaataaaggtattactttagaataggtattctcctcattttgtgaaagaaatgaacctagattcttaagcattattacacatccatgtttgcttaaagatggatttccctgggaatgggagaaaacagccagcaggaggagcttcatctgttcccttcccacctccaacctagccctactgcccaccccaccccaacccaccccatgcccagtggtctcagtagatacttcttaactggaaattctttcttttcagaatctaggtggtgaattttttttaagtggcacggtctttttctgcttgaaatctgatcacaccccccagccattgccctccctctctttttcctctgtagagaaatgtgaggggcagtacatttactgtgcttttcacaccatctcagaggttgaggagcatactgaaaattgccctggggggtgctgggtgtgctatctccttcccacatcctcagccccacaccagctctatttcaggggtgagagtcagagagcactgcaatatgtgcttcatgggatttcgattcgaagatcctagaccagggagacactgtgagccagggatacaacaaaatactaggtaagtcactgcagaccgacctccctgcagtttgggaaagaagctgggtttgtggagaatcagagcatcttgacatgactgctgacctaaagatccctggcattggccagggatcctgtggaacctcttctagttcaggggtgtgagcattagactgccagttgtctagtgacatctgatgcttgctgtgaacttttaagatccccgaatcctgagcacctcaatctttaattgccctgtattccgaagggtaatataatttatctggatggaaattttaaagatgaatcccccttttttcttttcttctctcttttctttccttctccctttcttctttgccttctaaatatactgaaatgatttagatatgtgtcaacaattaatgatcttttattcaatctaagaaatggtttagtttttctctttagctctatggcatttcactcaagtggacaggggaaaaagtaattgccatgggctccaaagaatttgctttatgtttttagctatttaaaaataaatccatcaaaaataaagtatgcaaatgtatcttttaaagttaatttttaaaaatgctcttattttagtgaattttcagaaattatagtggaatggatgctcatatattgcttatggatattttggataccaaagtaggaataactgacattcagtattttaaagctggcaaacctgtacatagaaaatagatccccagacagtggtctatgaagagggcagttaagtatcaaatacttaattttcttgcctttttttcttaagtggggaaaagtttctagatctcttacacctctgacacaatctgttctaaaacaggcacttgtaatgttggggcctccttgtaaacgtgtttttgccctttactctctgggagttctttaaaggtgaaatcatcttacaaagaaattgggggagggtcttggcaaaggactttcccctcctctttcctggcctgggaaccttatactgacaatcaatactttatattttaaagtatataatttatagttaacttctagtgtaatatattaggaaacactagaatggaaaggccattggaagacaggttgtatcttttttagaccatatttccttgtttaaaaactatcatttgaatacttttttggtgaagaactccatgttttcaagttaaaggtcacctcgtaggccaggcgcagtggctcatgcctgtaatcccagcactctgggaggctgaggcgggtgaatcacaaggttaggagtttgagaccagcctggccaatatggtgaaaccccgtccctactaaaaatacaaaatttagccaggcgtggtggcatgcacctgtagtcccacctactcgggaggctgaggcaggagaatcacttgaacctgagagacagaggttgcagtgagccgagatcacgccactgcactccagcctgggggacagagtgagattctgtctcaaaaaacaaaaaacaaaaaagtcaccttgtaactcatctctttttattgtaagtttattaaaaatgaagaggacaacaatgagaaggaacataaagggttagctagcactgtctcctggtgcatggggctgtgcagatgtcccggccacttcttccttcatacttcccttagagaacttgctctgctacaagcagtgggcttggactaaaagtgattaaaataccacaggcataaggagaaaaggagtatatgtagtagtaataattactagtataaattattttcttcacatgctatgagtaataatattaaaaaactcattttaccattaagattccttatgctgaagctcttccatttagaatactgtcaatgtcatttactggtatgaactaaagtcccccttcttttccactcactgggaaccttagtaaaacaccagcatatcttacctctctttctgactggccgatgcttccagagactgaatgttgggaaaacctagtagccaaacaattctaggacagaataacatttttatatttggttccaccatcttattacatttagttatagttttaaaaaagaaattcaagcccattaaaatatgtctggtcaatgaaatgcttccttttattgtgttgtgctattgtgctttgtttttcaaaacattgtaaaaatagtatctttggtttagtattttggattatatattataatctgaggagtgttttgcttatgtagaatccagatatatttctgttacctaggagatgttacttacatatgtaatactgtatcctgcacatggaaatattcagaattgtagatagcataactctccctgctcctattcttttgagcctaggtataattttttttttttttttagaaaaagacatatttagctttaatttctatttatgctaaacatatttataagtagtctgtcaatataataccaactatttttatttttacataattcaattatttcatttgacatgtctggcagactcaagacattaagtaaaaaattggaactatgatttttctttgtcattttttaaaaaagaattattttattaacctgctggcatataatctggagttcttttcacaaccttactttttctgatttgctttattgaatgattgaatactcatttctttctaaaaatatgttgtaaattctcccttggcaagatttctccctatgagggtagttattatttgagtctgccaagtggttaccatggggcaaggtgccatgatgtattcttgggtgcattggttttttgcgcattgtaaatttaagacacttatagtaagtggactcattcatagatgagtttcagaaccttttacgttctcggtagaggcttctgtcggacaggcagaagagtgtattcctcacttttttttttgtcttcaaattccagtaaggcatagcacttttaagaaattagaatttttctatcatctatgcaaatgatatttatgttaatattaaatatcttatgttacactgggagtaatttgaggtgcaattatttttattactactttgaatagaggaccattatccttctttcttcagaaaactaagaagtaagtgtaacttttaaagtaagtatatatcagtgagagtaggcttgttttacaactatttctagccagtgagttgtgttttcatgtctcatcaaaagacaataccacattgcatcattttacaaaatatgttgtcattttcatttcagttgtaacataggaaaatagatatttcctagatgatttctgagtttcttactgcaaagaacagttataaattggtatacatgtgtctctgtaatagggataatattgatatatctgttgctacatatttaagaatcattctatcttatgttgtcttgaggccaagatttaccacgtttgcccagtgtattgaattggtggtagaaggtagttccatgttccatttgtagatctttaagattttatctttgataactttaatagaatgtggctcagttctggtccttcaagcctgtatggtttggattttcagtaggggacagttgatgtggagtcaatctctttggtacacaggaagctttataaaatttcattcacgaatctcttattttgggaagctgttttgcatatgagaagaacactgttgaaataaggaactaaagctttatatattgatcaaggtgattctgaaagttttaatttttaatgttgtaatgttatgttattgttaattgtactttattatgtattcaatagaaaatcatgatttattaataaaagcttaaattctcatctattt

SEQ ID NO: 4984 - DNA, 9401 bp, Homo sapiens
atagttgctatgaatttctcctcacaaggatgggcctgtttactcaccctgggcatcgttggtagagcgctagtgtaaacagcctgaggaacccggtgggccggggaagtgggcgcgctctgttctccgcggccagctgggacgccgggccaggtggggccgcctgcgtttagcaactgctttctcaccccctggatttgcgatgtttgccacagcagcgagaagcgccattgtaatggggatgggaggggtggagcctccaagtcctgtctcaatttagatctctcactctgctgttaggcgcgcccatttcagattactaaactcgaattaagagggaaaaaaaatcagggaggaggtggcaagccacaccccacggtgcccgcgaacttccccggcagcggactgtagcccaggcagacgccgtcgagatgcagggcccaccgctcctgaccgccgcccacctcctctgcgtgtgcaccgccgcgctggccgtggctcccgggcctcggtttctggtgacagccccagggatcatcaggcccggaggaaatgtgactattggggtggagcttctggaacactgcccttcacaggtgactgtgaaggcggagctgctcaagacagcatcaaacctcactgtctctgtcctggaagcagaaggagtctttgaaaaaggctcttttaagacacttactcttccatcactacctctgaacagtgcagatgagatttatgagctacgtgtaaccggacgtacccaggatgagattttattctctaatagtacccgcttatcatttgagaccaagagaatatctgtcttcattcaaacagacaaggccttatacaagccaaagcaagaagtgaagtttcgcattgttacactcttctcagattttaagccttacaaaacctctttaaacattctcattaaggaccccaaatcaaatttgatccaacagtggttgtcacaacaaagtgatcttggagtcatttccaaaacttttcagctatcttcccatccaatacttggtgactggtctattcaagttcaagtgaatgaccagacatactatcaatcatttcaggtttcagaatatgtattaccaaaatttgaagtgactttgcagacaccattatattgttctatgaattctaagcatttaaatggtaccatcacggcaaagtatacatatgggaagccagtgaaaggagacgtaacgcttacatttttacctttatccttttggggaaagaagaaaaatattacaaaaacatttaagataaatggatctgcaaacttctcttttaatgatgaagagatgaaaaatgtaatggattcttcaaatggactttctgaatacctggatctatcttcccctggaccagtagaaattttaaccacagtgacagaatcagttacaggtatttcaagaaatgtaagcactaatgtgttcttcaagcaacatgattacatcattgagttttttgattatactactgtcttgaagccatctctcaacttcacagccactgtgaaggtaactcgtgctgatggcaaccaactgactcttgaagaaagaagaaataatgtagtcataacagtgacacagagaaactatactgagtactggagcggatctaacagtggaaatcagaaaatggaagctgttcagaaaataaattatactgtcccccaaagtggaacttttaagattgaattcccaatcctggaggattccagtgagctacagttgaaggcctatttccttggtagtaaaagtagcatggcagttcatagtctgtttaagtctcctagtaagacatacatccaactaaaaacaagagatgaaaatataaaggtgggatcgccttttgagttggtggttagtggcaacaaacgattgaaggagttaagctatatggtagtatccaggggacagttggtggctgtaggaaaacaaaattcaacaatgttctctttaacaccagaaaattcttggactccaaaagcctgtgtaattgtgtattatattgaagatgatggggaaattataagtgatgttctaaaaattcctgttcagcttgtttttaaaaataagataaagctatattggagtaaagtgaaagctgaaccatctgagaaagtctctcttaggatctctgtgacacagcctgactccatagttgggattgtagctgttgacaaaagtgtgaatctgatgaatgcctctaatgatattacaatggaaaatgtggtccatgagttggaactttataacacaggatattatttaggcatgttcatgaattcttttgcagtctttcaggaatgtggactctgggtattgacagatgcaaacctcacgaaggattatattgatggtgtttatgacaatgcagaatatgctgagaggtttatggaggaaaatgaaggacatattgtagatattcatgacttttctttgggtagcagtccacatgtccgaaagcattttccagagacttggatttggctagacaccaacatgggttacaggatttaccaagaatttgaagtaactgtacctgattctatcacttcttgggtggctactggttttgtgatctctgaggacctgggtcttggactaacaactactccagtggagctccaagccttccaaccatttttcatttttttgaatcttccctactctgttatcagaggtgaagaatttgctttggaaataactatattcaattatttgaaagatgccactgaggttaaggtaatcattgagaaaagtgacaaatttgatattctaatgacttcaaatgaaataaatgccacaggccaccagcagacccttctggttcccagtgaggatggggcaactgttctttttcccatcaggccaacacatctgggagaaattcctatcacagtcacagctctttcacccactgcttctgatgctgtcacccagatgattttagtaaaggctgaaggaatagaaaaatcatattcacaatccatcttattagacttgactgacaataggctacagagtaccctgaaaactttgagtttctcatttcctcctaatacagtgactggcagtgaaagagttcagatcactgcaattggagatgttcttggtccttccatcaatggcttagcctcattgattcggatgccttatggctgtggtgaacagaacatgataaattttgctccaaatatttacattttggattatctgactaaaaagaaacaactgacagataatttgaaagaaaaagctctttcatttatgaggcaaggttaccagagagaacttctctatcagagggaagatggctctttcagtgcttttgggaattatgacccttctgggagcacttggttgtcagcttttgttttaagatgtttccttgaagccgatccttacatagatattgatcagaatgtgttacacagaacatacacttggcttaaaggacatcagaaatccaacggtgaattttgggatccaggaagagtgattcatagtgagcttcaaggtggcaataaaagtccagtaacacttacagcctatattgtaacttctctcctgggatatagaaagtatcagcctaacattgatgtgcaagagtctatccattttttggagtctgaattcagtagaggaatttcagacaattatactctagcccttataacttatgcattgtcatcagtggggagtcctaaagcgaaggaagctttgaatatgctgacttggagagcagaacaagaaggtggcatgcaattctgggtgtcatcagagtccaaactttctgactcctggcagccacgctccctggatattgaagttgcagcctatgcactgctctcacacttcttacaatttcagacttctgagggaatcccaattatgaggtggctaagcaggcaaagaaatagcttgggtggttttgcatctactcaggataccactgtggctttaaaggctctgtctgaatttgcagccctaatgaatacagaaaggacaaatatccaagtgaccgtgacggggcctagctcaccaagtcctcttgctgtggtacagccaacggcagttaatatttccgcaaatggttttggatttgctatttgtcagctcaatgttgtatataatgtgaaggcttctgggtcttctagaagacgaagatctatccaaaatcaagaagcctttgatttagatgttgctgtaaaagaaaataaagatgatctcaatcatgtggatttgaatgtgtgtacaagcttttcgggcccgggtaggagtggcatggctcttatggaagttaacctattaagtggctttatggtgccttcagaagcaatttctctgagcgagacagtgaagaaagtggaatatgatcatggaaaactcaacctctatttagattctgtaaatgaaacccagttttgtgttaatattcctgctgtgagaaactttaaagtttcaaatacccaagatgcttcagtgtccatagtggattactatgagccaaggagacaggctgtgagaagttacaactctgaagtgaagctgtcctcctgtgacctttgcagtgatgtccagggctgccgtccttgtgaggatggagcttcaggctcccatcatcactcttcagtcatttttattttctgtttcaagcttctgtactttatggaactttggctgtgatttatttttaaaggactctgtgtaacactaacatttccagtagtcacatgtgattgttttgttttcgtagaagaatactgcttctattttgaaaaaagagttttttttctttctatggggttgcagggatggtgtacaacaggtcctagcatgtatagctgcatagatttcttcacctgatctttgtgtggaagatcagaatgaatgcagttgtgtgtctatattttcccctctcaaaatcttttagaatttttttggaggtgtttgttttctccagaataaaggtattactttagaataggtattctcctcattttgtgaaagaaatgaacctagattcttaagcattattacacatccatgtttgcttaaagatggatttccctgggaatgggagaaaacagccagcaggaggagcttcatctgttcccttcccacctccaacctagccctactgcccaccccaccccaacccaccccatgcccagtggtctcagtagatacttcttaactggaaattctttcttttcagaatctaggtggtgaattttttttaagtggcacggtctttttctgcttgaaatctgatcacaccccccagccattgccctccctctctttttcctctgtagagaaatgtgaggggcagtacatttactgtgcttttcacaccatctcagaggttgaggagcatactgaaaattgccctggggggtgctgggtgtgctatctccttcccacatcctcagccccacaccagctctatttcaggggtgagagtcagagagcactgcaatatgtgcttcatgggatttcgattcgaagatcctagaccagggagacactgtgagccagggatacaacaaaatactaggtaagtcactgcagaccgacctccctgcagtttgggaaagaagctgggtttgtggagaatcagagcatcttgacatgactgctgacctaaagatccctggcattggccagggatcctgtggaacctcttctagttcaggggtgtgagcattagactgccagttgtctagtgacatctgatgcttgctgtgaacttttaagatccccgaatcctgagcacctcaatctttaattgccctgtattccgaagggtaatataatttatctggatggaaattttaaagatgaatcccccttttttcttttcttctctcttttctttccttctccctttcttctttgccttctaaatatactgaaatgatttagatatgtgtcaacaattaatgatcttttattcaatctaagaaatggtttagtttttctctttagctctatggcatttcactcaagtggacaggggaaaaagtaattgccatgggctccaaagaatttgctttatgtttttagctatttaaaaataaatccatcaaaaataaagtatgcaaatgtatcttttaaagttaatttttaaaaatgctcttattttagtgaattttcagaaattatagtggaatggatgctcatatattgcttatggatattttggataccaaagtaggaataactgacattcagtattttaaagctggcaaacctgtacatagaaaatagatccccagacagtggtctatgaagagggcagttaagtatcaaatacttaattttcttgcctttttttcttaagtggggaaaagtttctagatctcttacacctctgacacaatctgttctaaaacaggcacttgtaatgttggggcctccttgtaaacgtgtttttgccctttactctctgggagttctttaaaggtgaaatcatcttacaaagaaattgggggagggtcttggcaaaggactttcccctcctctttcctggcctgggaaccttatactgacaatcaatactttatattttaaagtatataatttatagttaacttctagtgtaatatattaggaaacactagaatggaaaggccattggaagacaggttgtatcttttttagaccatatttccttgtttaaaaactatcatttgaatacttttttggtgaagaactccatgttttcaagttaaaggtcacctcgtaggccaggcgcagtggctcatgcctgtaatcccagcactctgggaggctgaggcgggtgaatcacaaggttaggagtttgagaccagcctggccaatatggtgaaaccccgtccctactaaaaatacaaaatttagccaggcgtggtggcatgcacctgtagtcccacctactcgggaggctgaggcaggagaatcacttgaacctgagagacagaggttgcagtgagccgagatcacgccactgcactccagcctgggggacagagtgagattctgtctcaaaaaacaaaaaacaaaaaagtcaccttgtaactcatctctttttattgtaagtttattaaaaatgaagaggacaacaatgagaaggaacataaagggttagctagcactgtctcctggtgcatggggctgtgcagatgtcccggccacttcttccttcatacttcccttagagaacttgctctgctacaagcagtgggcttggactaaaagtgattaaaataccacaggcataaggagaaaaggagtatatgtagtagtaataattactagtataaattattttcttcacatgctatgagtaataatattaaaaaactcattttaccattaagattccttatgctgaagctcttccatttagaatactgtcaatgtcatttactggtatgaactaaagtcccccttcttttccactcactgggaaccttagtaaaacaccagcatatcttacctctctttctgactggccgatgcttccagagactgaatgttgggaaaacctagtagccaaacaattctaggacagaataacatttttatatttggttccaccatcttattacatttagttatagttttaaaaaagaaattcaagcccattaaaatatgtctggtcaatgaaatgcttccttttattgtgttgtgctattgtgctttgtttttcaaaacattgtaaaaatagtatctttggtttagtattttggattatatattataatctgaggagtgttttgcttatgtagaatccagatatatttctgttacctaggagatgttacttacatatgtaatactgtatcctgcacatggaaatattcagaattgtagatagcataactctccctgctcctattcttttgagcctaggtataattttttttttttttttagaaaaagacatatttagctttaatttctatttatgctaaacatatttataagtagtctgtcaatataataccaactatttttatttttacataattcaattatttcatttgacatgtctggcagactcaagacattaagtaaaaaattggaactatgatttttctttgtcattttttaaaaaagaattattttattaacctgctggcatataatctggagttcttttcacaaccttactttttctgatttgctttattgaatgattgaatactcatttctttctaaaaatatgttgtaaattctcccttggcaagatttctccctatgagggtagttattatttgagtctgccaagtggttaccatggggcaaggtgccatgatgtattcttgggtgcattggttttttgcgcattgtaaatttaagacacttatagtaagtggactcattcatagatgagtttcagaaccttttacgttctcggtagaggcttctgtcggacaggcagaagagtgtattcctcacttttttttttgtcttcaaattccagtaaggcatagcacttttaagaaattagaatttttctatcatctatgcaaatgatatttatgttaatattaaatatcttatgttacactgggagtaatttgaggtgcaattatttttattactactttgaatagaggaccattatccttctttcttcagaaaactaagaagtaagtgtaacttttaaagtaagtatatatcagtgagagtaggcttgttttacaactatttctagccagtgagttgtgttttcatgtctcatcaaaagacaataccacattgcatcattttacaaaatatgttgtcattttcatttcagttgtaacataggaaaatagatatttcctagatgatttctgagtttcttactgcaaagaacagttataaattggtatacatgtgtctctgtaatagggataatattgatatatctgttgctacatatttaagaatcattctatcttatgttgtcttgaggccaagatttaccacgtttgcccagtgtattgaattggtggtagaaggtagttccatgttccatttgtagatctttaagattttatctttgataactttaatagaatgtggctcagttctggtccttcaagcctgtatggtttggattttcagtaggggacagttgatgtggagtcaatctctttggtacacaggaagctttataaaatttcattcacgaatctcttattttgggaagctgttttgcatatgagaagaacactgttgaaataaggaactaaagctttatatattgatcaaggtgattctgaaagttttaatttttaatgttgtaatgttatgttattgttaattgtactttattatgtattcaatagaaaatcatgatttattaataaaagcttaaattctcatctattt

SEQ ID NO: 4985 - DNA, 1548 bp, Homo sapiens
attctcagcgctgggagccgccgcccccgcagctgctgccgccgccgccagggcccggactcggacgcgtggtagcctagagtcctggggagcttctgtccacctgtcctgcagaggagtcgtttccagcccggctgccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtgggcagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttgctgcgcaccaatgcccagcaggggaggtgaggggggctggcggggcgaagtttggggggtgttttgtggggctccccagacacactctctgcctggtggtcagatgcaggttggaaggggccttgctgagtggcgcaaggccgagcgttcccagcagggggagaaacccttcacaccccaggcccttcaggaactggggccttgccttgcagccacatggccccatcccagttggggaagccaggtgagctctgacccttgggcctgggcctctgcccctcccaacccagccctcgtctccctcgacagcgcccctgctgtcttccccaccgcagtcaccaccacccgaaatgccacgtggtcactgtgcactgccctgttcatgtgcctctgcggggcagggccttcctggttttgttcactgctgtacccagatgcctacaaccatccctgccacatacaggtgctcaataaacacttgtagagcagatgg

SEQ ID NO: 4986 - DNA, 1648 bp, Homo sapiens
cgcgggttcagacctgccgagcgcccgccgccgcgggaggggcttgaggccggggcggggccggggcggggcggggcggggcgtccccctcgtaggctccgggccgcgcattctcagcgctgggagccgccgcccccgcagctgctgccgccgccgccagggcccggactcggacgcgtgcctagagtcctggggagcttctgtccacctgtcctgcagaggagtcgtttccagcccggctgccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtgggcagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttgctgcgcaccaatgcccagcaggggaggtgaggggggctggcggggcgaagtttggggggtgttttgtggggctccccagacacactctctgcctggtggtcagatgcaggttggaaggggccttgctgagtggcgcaaggccgagcgttcccagcagggggagaaacccttcacaccccaggcccttcaggaactggggccttgccttgcagccacatggccccatcccagttggggaagccaggtgagctctgacccttgggcctgggcctctgcccctcccaacccagccctcgtctccctcgacagcgcccctgctgtcttccccaccgcagtcaccaccacccgaaatgccacgtggtcactgtgcactgccctgttcatgtgcctctgcggggcagggccttcctggttttgttcactgctgtacccagatgcctacaaccatccctgccacatacaggtgctcaataaacacttgtagagca

SEQ ID NO: 4987 - DNA, 1486 bp, Homo sapiens
attctcagcgctgggagccgccgcccccgcagctgctgccgccgccgccagggcccggactcggacgcgtggtagccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtgggcagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttgctgcgcaccaatgcccagcaggggaggtgaggggggctggcggggcgaagtttggggggtgttttgtggggctccccagacacactctctgcctggtggtcagatgcaggttggaaggggccttgctgagtggcgcaaggccgagcgttcccagcagggggagaaacccttcacaccccaggcccttcaggaactggggccttgccttgcagccacatggccccatcccagttggggaagccaggtgagctctgacccttgggcctgggcctctgcccctcccaacccagccctcgtctccctcgacagcgcccctgctgtcttccccaccgcagtcaccaccacccgaaatgccacgtggtcactgtgcactgccctgttcatgtgcctctgcggggcagggccttcctggttttgttcactgctgtacccagatgcctacaaccatccctgccacatacaggtgctcaataaacacttgtagagcagatgg

SEQ ID NO: 4988 - DNA, 793 bp, Homo sapiens
cgccgccagggcccggactcggacgcgtgcctagagtcctggggagcttctgtccacctgtcctgcagaggagtcgtttccagcccggctggtgagtgctggccagggtggggcagagcaggcggggcggcgaaagtccagacctggctgtgctgtctggaaacgtggcccagggcgctcagctgctgtctgcaccccacgccctccctggcttccccatgctcacagcttgcccactgctgcagccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcc

SEQ ID NO: 4989 - DNA, 561 bp, Homo sapiens
gctgccgccgccgccagggcccggactcggacgcgtggtagcctagagtcctggggagcttctgtccacctgtcctgcagaggagtcgtttccagcccggctggtgagtgctggccagggtggggcagagcaggcggggcggcgaaagtccagacctggctgtgctgtctggaaacgtggcccagggcgctcagctgctgtctgcaccccacgccctccctggcttccccatgctcacagcttgcccactgctgcaggtcgggcgggcacggggcatctggggaggggcatagcctgtctgtgctgccccctcagccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctg

SEQ ID NO: 4990 - DNA, 565 bp, Homo sapiens
tgaggccggggcggggccggggcggggcggggcggggcgtccccctcgtaggctccgggccgcgcattctcagcgctgggagccgccgcccccgcagctgctgccgccgccgccagggcccggactcggacgcgtggtaggctgtagctgccgctgtttgtgggggaagggccagtgatgggtctggagcgaaggccaagagtggggcacctgggggaagcctagagtcctggggagcttctgtccacctgtcctgcagaggagtcgtttccagcccggctgccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctg

SEQ ID NO: 4991 - DNA, 713 bp, Homo sapiens
ggctggttgtgaactcccgacctcaagtgattgcacctgccttggcctcccaaagtgctggcattataggcatgagacaccgcacctggactcctttcctctactttctttgggttaatttgctagtctctttttattatttatttatttattttgagatggagtctcactctgtcgcccaggctggagtgcagtggcaccatctcggctcactgcaagcttcgcctcccgggttcacgccattctcctgcctcagcctcccaagtagctgggactacaggcgcccgccaccacgcccggctaattttttgtatttctagtacagacggggtttcaccgtgttagccaggatggtcttgatctcctgaccttgtgatctgcctgccttggccccccaaagtgctgggattacaggcgtgagccaccgcgcctggccctgtgtcccctcctatccgtctcccagtcaggggcccggtgctgtggccccgctgacccctcccctgcctcctcagccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggt

SEQ ID NO: 4992 - DNA, 771 bp, Homo sapiens
ccgccgcccccgcagctgctgccgccgccgccagggcccggactcggacgcgtgcctagagtcctggggagcttctgtccacctgtcctgcagaggagtcgtttccagcccggctggcccataggctcctgccagcctgtgacgtgcggccccgggaatgccgtggggagcgggcaggctggcatgagctcaccggaggtacccgctagggcttcctcccccggccgctagcagggccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggt

SEQ ID NO: 4993 - DNA, 797 bp, Homo sapiens
cgccgccagggcccggactcggacgcgtggtagcctagagtcctggggagcttctgtccacctgtcctgcagaggagtcgtttccagcccggctggtgagtgctggccagggtggggcagagcaggcggggcggcgaaagtccagacctggctgtgctgtctggaaacgtggcccagggcgctcagctgctgtctgcaccccacgccctccctggcttccccatgctcacagcttgcccactgctgcagccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcc

SEQ ID NO: 4994 - DNA, 545 bp, Homo sapiens
attctccccaccccggccaggatgaaggaagggctgccctttaacagaccgtaaacaggcctggagagcttaggaaggggctgagctggggcctgtctgagcccctacccctctgctgtctgagtggcctcctccgcccttactgcaggcccataggctcctgccagcctgtgacgtgcggccccgggaatgccgtggggagcgggcaggctggcatgagctcaccggaggtacccgctagggcttcctcccccggccgctagcagggccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctg

SEQ ID NO: 4995 - DNA, 648 bp, Homo sapiens
caccaggggtctgtcctggctgtcagggctcctgagtcgctaggaagtgacacgtcctgttcccacaggggctcattcacaggcctcccaggacagtggctggctctgccccgacttctgggctggcttggccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatc

SEQ ID NO: 4996 - DNA, 1407 bp, Homo sapiens
gactcggacgcgtgcctagagtcctggggagcttctgtccacctgtcctgcagaggagtcgtttccagcccggctgccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtgggcagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttgctgcgcaccaatgcccagcaggggagatgcaggttggaaggggccttgctgagtggcgcaaggccgagcgttcccagcagggggagaaacccttcacaccccaggcccttcaggaactggggccttgccttgcagccacatggccccatcccagttggggaagccaggtgagctctgacccttgggcctgggcctctgcccctcccaacccagccctcgtctccctcgacagcgcccctgctgtcttccccaccgcagtcaccaccacccgaaatgccacgtggtcactgtgcactgccctgttcatgtgcctctgcggggcagggccttcctggttttgttcactgctgtacccagatgcctacaaccatccctgccacatacaggtgctcaataaacacttgtagagcaga

SEQ ID NO: 4997 - DNA, 4268 bp, Homo sapiens
attgaagaaaacatgagtatgaaatggaacctcagctctttcaatgacttccctttttgagttgactccgcctccatatgtagccttttcattttcatgaaagtgaagtgatttttagaattcttagttgttttctttagaagaacatttctagggaataatacaagaagatttaggaatcattgaagttataaatctttggaatgagcaaactcagaatggtgctacttgaagactctggatctgctgacttcagaagacattttgtcaacttgagtcccttcaccattactgtggtcttacttctcagtgcctgttttgtcaccagttctcttggaggaacagacaaggagctgaggctagtggatggtgaaaacaagtgtagcgggagagtggaagtgaaagtccaggaggagtggggaacggtgtgtaataatggctggagcatggaagcggtctctgtgatttgtaaccagctgggatgtccaactgctatcaaagcccctggatgggctaattccagtgcaggttctggacgcatttggatggatcatgtttcttgtcgtgggaatgagtcagctctttgggattgcaaacatgatggatggggaaagcatagtaactgtactcaccaacaagatgctggagtgacctgctcagatggatccaatttggaaatgaggctgacgcgtggagggaatatgtgttctggaagaatagagatcaaattccaaggacggtggggaacagtgtgtgatgataacttcaacatagatcatgcatctgtcatttgtagacaacttgaatgtggaagtgctgtcagtttctctggttcatctaattttggagaaggctctggaccaatctggtttgatgatcttatatgcaacggaaatgagtcagctctctggaactgcaaacatcaaggatggggaaagcataactgtgatcatgctgaggatgctggagtgatttgctcaaagggagcagatctgagcctgagactggtagatggagtcactgaatgttcaggaagattagaagtgagattccaaggagaatgggggacaatatgtgatgacggctgggacagttacgatgctgctgtggcatgcaagcaactgggatgtccaactgccgtcacagccattggtcgagttaacgccagtaagggatttggacacatctggcttgacagcgtttcttgccagggacatgaacctgctatctggcaatgtaaacaccatgaatggggaaagcattattgcaatcacaatgaagatgctggcgtgacatgttctgatggatcagatctggagctaagacttagaggtggaggcagccgctgtgctgggacagttgaggtggagattcagagactgttagggaaggtgtgtgacagaggctggggactgaaagaagctgatgtggtttgcaggcagctgggatgtggatctgcactcaaaacatcttatcaagtgtactccaaaatccaggcaacaaacacatggctgtttctaagtagctgtaacggaaatgaaacttctctttgggactgcaagaactggcaatggggtggacttacctgtgatcactatgaagaagccaaaattacctgctcagcccacagggaacccagactggttggaggggacattccctgttctggacgtgttgaagtgaagcatggtgacacgtggggctccatctgtgattcggacttctctctggaagctgccagcgttctatgcagggaattacagtgtggcacagttgtctctatcctggggggagctcactttggagagggaaatggacagatctgggctgaagaattccagtgtgagggacatgagtcccatctttcactctgcccagtagcaccccgcccagaaggaacttgtagccacagcagggatgttggagtagtctgctcaagatacacagaaattcgcttggtgaatggcaagaccccgtgtgagggcagagtggagctcaaaacgcttggtgcctggggatccctctgtaactctcactgggacatagaagatgcccatgttctttgccagcagcttaaatgtggagttgccctttctaccccaggaggagcacgttttggaaaaggaaatggtcagatctggaggcatatgtttcactgcactgggactgagcagcacatgggagattgtcctgtaactgctctaggtgcttcattatgtccttcagagcaagtggcctctgtaatctgctcaggaaaccagtcccaaacactgtcctcgtgcaattcatcgtctttgggcccaacaaggcctaccattccagaagaaagtgctgtggcctgcatagagagtggtcaacttcgcctggtaaatggaggaggtcgctgtgctgggagagtagagatctatcatgagggctcctggggcaccatctgtgatgacagctgggacctgagtgatgcccacgtggtttgcagacagctgggctgtggagaggccattaatgccactggttctgctcattttggggaaggaacagggcccatctggctggatgagatgaaatgcaatggaaaagaatcccgcatttggcagtgccattcacacggctgggggcagcaaaattgcaggcacaaggaggatgcgggagttatctgctcagaattcatgtctctgagactgaccagtgaagccagcagagaggcctgtgcagggcgtctggaagttttttacaatggagcttggggcactgttggcaagagtagcatgtctgaaaccactgtgggtgtggtgtgcaggcagctgggctgtgcagacaaagggaaaatcaaccctgcatctttagacaaggccatgtccattcccatgtgggtggacaatgttcagtgtccaaaaggacctgacacgctgtggcagtgcccatcatctccatgggagaagagactggccagcccctcggaggagacctggatcacatgtgacaacaagataagacttcaggaaggacccacttcctgttctggacgtgtggagatctggcatggaggttcctgggggacagtgtgtgatgactcttgggacttggacgatgctcaggtggtgtgtcaacaacttggctgtggtccagctttgaaagcattcaaagaagcagagtttggtcaggggactggaccgatatggctcaatgaagtgaagtgcaaagggaatgagtcttccttgtgggattgtcctgccagacgctggggccatagtgagtgtgggcacaaggaagacgctgcagtgaattgcacagatatttcagtgcagaaaaccccacaaaaagccacaacaggtcgctcatcccgtcagtcatcctttattgcagtcgggatccttggggttgttctgttggccattttcgtcgcattattcttcttgactaaaaagcgaagacagagacagcggcttgcagtttcctcaagaggagagaacttagtccaccaaattcaataccgggagatgaattcttgcctgaatgcagatgatctggacctaatgaattcctcagaaaattcccatgagtcagctgatttcagtgctgctgaactaatttctgtgtctaaatttcttcctatttctggaatggaaaaggaggccattctgagccacactgaaaaggaaaatgggaatttataacccagtgagttcagcctttaagataccttgatgaagacctggactattgaatggagcagaaattcacctctctcactgactattacagttgcatttttatggagttcttcttctcctaggattcctaagactgctgctgaatttataaaaattaagtttgtgaatgtgactacttagtggtgtatatgagactttcaagggaattaaataaataaataagaatgttattgatttgagtttgctttaattacttgtccttaattctattaatttctaaatgggcttcctaattttttgtagagtttcctagatgtattataatgtgttttatttgacagtgtttcaatttgcatatacagtactgtatattttttcttatttggtttgaataattttcctattaccaaataaaaataaatttatttttactttagtttttctaagacaggaaaagttaatgatattgaagggtctgtaaataatatatggctaactttataaggcatgactcacaacgattctttaactgctttttgttactgtaattctgttcactagaataaaatgcagagccacacctggtgagggcacaaa

SEQ ID NO: 4998 - DNA, 3800 bp, Homo sapiens
gaattcttagttgttttctttagaagaacatttctagggaataatacaagaagatttaggaatcattgaagttataaatctttggaatgagcaaactcagaatggtgctacttgaagactctggatctgctgacttcagaagacattttgtcaacttgagtcccttcaccattactgtggtcttacttctcagtgcctgttttgtcaccagttctcttggaggaacagacaaggagctgaggctagtggatggtgaaaacaagtgtagcgggagagtggaagtgaaagtccaggaggagtggggaacggtgtgtaataatggctggagcatggaagcggtctctgtgatttgtaaccagctgggatgtccaactgctatcaaagcccctggatgggctaattccagtgcaggttctggacgcatttggatggatcatgtttcttgtcgtgggaatgagtcagctctttgggattgcaaacatgatggatggggaaagcatagtaactgtactcaccaacaagatgctggagtgacctgctcagatggatccaatttggaaatgaggctgacgcgtggagggaatatgtgttctggaagaatagagatcaaattccaaggacggtggggaacagtgtgtgatgataacttcaacatagatcatgcatctgtcatttgtagacaacttgaatgtggaagtgctgtcagtttctctggttcatctaattttggagaaggctctggaccaatctggtttgatgatcttatatgcaacggaaatgagtcagctctctggaactgcaaacatcaaggatggggaaagcataactgtgatcatgctgaggatgctggagtgatttgctcaaagggagcagatctgagcctgagactggtagatggagtcactgaatgttcaggaagattagaagtgagattccaaggagaatgggggacaatatgtgatgacggctgggacagttacgatgctgctgtggcatgcaagcaactgggatgtccaactgccgtcacagccattggtcgagttaacgccagtaagggatttggacacatctggcttgacagcgtttcttgccagggacatgaacctgctatctggcaatgtaaacaccatgaatggggaaagcattattgcaatcacaatgaagatgctggcgtgacatgttctgatggatcagatctggagctaagacttagaggtggaggcagccgctgtgctgggacagttgaggtggagattcagagactgttagggaaggtgtgtgacagaggctggggactgaaagaagctgatgtggtttgcaggcagctgggatgtggatctgcactcaaaacatcttatcaagtgtactccaaaatccaggcaacaaacacatggctgtttctaagtagctgtaacggaaatgaaacttctctttgggactgcaagaactggcaatggggtggacttacctgtgatcactatgaagaagccaaaattacctgctcagcccacagggaacccagactggttggaggggacattccctgttctggacgtgttgaagtgaagcatggtgacacgtggggctccatctgtgattcggacttctctctggaagctgccagcgttctatgcagggaattacagtgtggcacagttgtctctatcctggggggagctcactttggagagggaaatggacagatctgggctgaagaattccagtgtgagggacatgagtcccatctttcactctgcccagtagcaccccgcccagaaggaacttgtagccacagcagggatgttggagtagtctgctcaagtaagacccagaaaacatctttaattggttctcatactgtgaaagggacagggttagggagtcatagctgtctttttctaaagccctgtctccttccaggatacacagaaattcgcttggtgaatggcaagaccccgtgtgagggcagagtggagctcaaaacgcttggtgcctggggatccctctgtaactctcactgggacatagaagatgcccatgttctttgccagcagcttaaatgtggagttgccctttctaccccaggaggagcacgttttggaaaaggaaatggtcagatctggaggcatatgtttcactgcactgggactgagcagcacatgggagattgtcctgtaactgctctaggtgcttcattatgtccttcagagcaagtggcctctgtaatctgctcaggaaaccagtcccaaacactgtcctcgtgcaattcatcgtctttgggcccaacaaggcctaccattccagaagaaagtgctgtggcctgcatagagagtggtcaacttcgcctggtaaatggaggaggtcgctgtgctgggagagtagagatctatcatgagggctcctggggcaccatctgtgatgacagctgggacctgagtgatgcccacgtggtttgcagacagctgggctgtggagaggccattaatgccactggttctgctcattttggggaaggaacagggcccatctggctggatgagatgaaatgcaatggaaaagaatcccgcatttggcagtgccattcacacggctgggggcagcaaaattgcaggcacaaggaggatgcgggagttatctgctcagaattcatgtctctgagactgaccagtgaagccagcagagaggcctgtgcagggcgtctggaagttttttacaatggagcttggggcactgttggcaagagtagcatgtctgaaaccactgtgggtgtggtgtgcaggcagctgggctgtgcagacaaagggaaaatcaaccctgcatctttagacaaggccatgtccattcccatgtgggtggacaatgttcagtgtccaaaaggacctgacacgctgtggcagtgcccatcatctccatgggagaagagactggccagcccctcggaggagacctggatcacatgtgacaacaagataagacttcaggaaggacccacttcctgttctggacgtgtggagatctggcatggaggttcctgggggacagtgtgtgatgactcttgggacttggacgatgctcaggtggtgtgtcaacaacttggctgtggtccagctttgaaagcattcaaagaagcagagtttggtcaggggactggaccgatatggctcaatgaagtgaagtgcaaagggaatgagtcttccttgtgggattgtcctgccagacgctggggccatagtgagtgtgggcacaaggaagacgctgcagtgaattgcacagatatttcagtgcagaaaaccccacaaaaagccacaacaggtcgctcatcccgtcagtcatcctttattgcagtcgggatccttggggttgttctgttggccattttcgtcgcattattcttcttgactaaaaagcgaagacagagacagcggcttgcagtttcctcaagaggagagaacttagtccaccaaattcaataccgggagatgaattcttgcctgaatgcagatgatctggacctaatgaattcctcaggaggccattctgagccacactgaaaaggaaaatgggaatttataacccagtgagttcagcctttaagataccttgatgaagacctggactattgaatggagcagaaattcacctctctcactgactattacagttgcatttttatggagttcttcttctcctaggattcctaagactgctgctgaatttataaaaattaagtttgtgaatgtgactacttagtggtgtatatgagactttcaagggaattaaataaataaataagaatgtta

SEQ ID NO: 4999 - DNA, 3701 bp, Homo sapiens
gaattcttagttgttttctttagaagaacatttctagggaataatacaagaagatttaggaatcattgaagttataaatctttggaatgagcaaactcagaatggtgctacttgaagactctggatctgctgacttcagaagacattttgtcaacttgagtcccttcaccattactgtggtcttacttctcagtgcctgttttgtcaccagttctcttggaggaacagacaaggagctgaggctagtggatggtgaaaacaagtgtagcgggagagtggaagtgaaagtccaggaggagtggggaacggtgtgtaataatggctggagcatggaagcggtctctgtgatttgtaaccagctgggatgtccaactgctatcaaagcccctggatgggctaattccagtgcaggttctggacgcatttggatggatcatgtttcttgtcgtgggaatgagtcagctctttgggattgcaaacatgatggatggggaaagcatagtaactgtactcaccaacaagatgctggagtgacctgctcagatggatccaatttggaaatgaggctgacgcgtggagggaatatgtgttctggaagaatagagatcaaattccaaggacggtggggaacagtgtgtgatgataacttcaacatagatcatgcatctgtcatttgtagacaacttgaatgtggaagtgctgtcagtttctctggttcatctaattttggagaaggctctggaccaatctggtttgatgatcttatatgcaacggaaatgagtcagctctctggaactgcaaacatcaaggatggggaaagcataactgtgatcatgctgaggatgctggagtgatttgctcaaagggagcagatctgagcctgagactggtagatggagtcactgaatgttcaggaagattagaagtgagattccaaggagaatgggggacaatatgtgatgacggctgggacagttacgatgctgctgtggcatgcaagcaactgggatgtccaactgccgtcacagccattggtcgagttaacgccagtaagggatttggacacatctggcttgacagcgtttcttgccagggacatgaacctgctatctggcaatgtaaacaccatgaatggggaaagcattattgcaatcacaatgaagatgctggcgtgacatgttctgatggatcagatctggagctaagacttagaggtggaggcagccgctgtgctgggacagttgaggtggagattcagagactgttagggaaggtgtgtgacagaggctggggactgaaagaagctgatgtggtttgcaggcagctgggatgtggatctgcactcaaaacatcttatcaagtgtactccaaaatccaggcaacaaacacatggctgtttctaagtagctgtaacggaaatgaaacttctctttgggactgcaagaactggcaatggggtggacttacctgtgatcactatgaagaagccaaaattacctgctcagcccacagggaacccagactggttggaggggacattccctgttctggacgtgttgaagtgaagcatggtgacacgtggggctccatctgtgattcggacttctctctggaagctgccagcgttctatgcagggaattacagtgtggcacagttgtctctatcctggggggagctcactttggagagggaaatggacagatctgggctgaagaattccagtgtgagggacatgagtcccatctttcactctgcccagtagcaccccgcccagaaggaacttgtagccacagcagggatgttggagtagtctgctcaagatacacagaaattcgcttggtgaatggcaagaccccgtgtgagggcagagtggagctcaaaacgcttggtgcctggggatccctctgtaactctcactgggacatagaagatgcccatgttctttgccagcagcttaaatgtggagttgccctttctaccccaggaggagcacgttttggaaaaggaaatggtcagatctggaggcatatgtttcactgcactgggactgagcagcacatgggagattgtcctgtaactgctctaggtgcttcattatgtccttcagagcaagtggcctctgtaatctgctcaggaaaccagtcccaaacactgtcctcgtgcaattcatcgtctttgggcccaacaaggcctaccattccagaagaaagtgctgtggcctgcatagagagtggtcaacttcgcctggtaaatggaggaggtcgctgtgctgggagagtagagatctatcatgagggctcctggggcaccatctgtgatgacagctgggacctgagtgatgcccacgtggtttgcagacagctgggctgtggagaggccattaatgccactggttctgctcattttggggaaggaacagggcccatctggctggatgagatgaaatgcaatggaaaagaatcccgcatttggcagtgccattcacacggctgggggcagcaaaattgcaggcacaaggaggatgcgggagttatctgctcagaattcatgtctctgagactgaccagtgaagccagcagagaggcctgtgcagggcgtctggaagttttttacaatggagcttggggcactgttggcaagagtagcatgtctgaaaccactgtgggtgtggtgtgcaggcagctgggctgtgcagacaaagggaaaatcaaccctgcatctttagacaaggccatgtccattcccatgtgggtggacaatgttcagtgtccaaaaggacctgacacgctgtggcagtgcccatcatctccatgggagaagagactggccagcccctcggaggagacctggatcacatgtgacaacaagataagacttcaggaaggacccacttcctgttctggacgtgtggagatctggcatggaggttcctgggggacagtgtgtgatgactcttgggacttggacgatgctcaggtggtgtgtcaacaacttggctgtggtccagctttgaaagcattcaaagaagcagagtttggtcaggggactggaccgatatggctcaatgaagtgaagtgcaaagggaatgagtcttccttgtgggattgtcctgccagacgctggggccatagtgagtgtgggcacaaggaagacgctgcagtgaattgcacagatatttcagtgcagaaaaccccacaaaaagccacaacaggtcgctcatcccgtcagtcatcctttattgcagtcgggatccttggggttgttctgttggccattttcgtcgcattattcttcttgactaaaaagcgaagacagagacagcggcttgcagtttcctcaagaggagagaacttagtccaccaaattcaataccgggagatgaattcttgcctgaatgcagatgatctggacctaatgaattcctcaggaggccattctgagccacactgaaaaggaaaatgggaatttataacccagtgagttcagcctttaagataccttgatgaagacctggactattgaatggagcagaaattcacctctctcactgactattacagttgcatttttatggagttcttcttctcctaggattcctaagactgctgctgaatttataaaaattaagtttgtgaatgtgactacttagtggtgtatatgagactttcaagggaattaaataaataaataagaatgtta

SEQ ID NO: 5000 - DNA, 2954 bp, Homo sapiens
ggattgaggggttgactgagcgttgcgagccttagctttctcccgaacgccagcgctgaggacacgatgtcgcggctctcccgctcactgctttgggccgccacctgcctgggcgtgctctgcgtgctgtccgcggacaagaacacgacccagcacccgaacgtgacgactttagcgcccatctccaacgtaacctcggcgccggtgacgtccctcccgctggtcaccactccggcaccagaaacctgtgaaggtcgaaacagctgcgtttcctgttttaatgttagcgttgttaatactacctgcttttggatagaatgtaaagatgagagctattgttcacataactcaacagttagtgattgtcaagtggggaacacgacagacttctgttccgctaaacccacagttcagccctccccttctacaacttccaagacagttactacatcaggtacaacaaataacactgtgactccaacctcacaacctgtgcgaaagtctacctttgatgcagccagtttcattggaggaattgtcctggtcttgggtgtgcaggctgtaattttctttctttataaattctgcaaatctaaagaacgaaattaccacactctgtaaacagacccattgaattaataaggactggtgattcatttgtgtaactcactgaagccaaaatactatcttttaagatgtcccacatggaagacgctattccaggatctttaaatttccatggatgcatataggatgtttgggagcatcatccgtgaagaaaaaatcaattaaatcattgtgttcaacaggaatatttaaaatattctgcatgaatcctgtggctgtcttattttaaatagctgctgctgtgggattatattttttttccttaacatgccaaatataactttctgaaagtgatggaaaatgttgtcttgtgcagacaacatcatggctcttggcagtttaaatttagtaattttaatttagtgaacagaattgagaagaacgtgccaaatgagaatcaattaggtggatttttggctgtcatttcaaaagtggaataaatttattaatttagtagtactaaatggtatccttagattaaaattttgtgcttgataacagctgttttttctacattagaaataagatgccacacaaggaactacattccagatttaaagaaatgaaaggataccattagtgtgtataacagattattgttcatacttgtaaagcatcttatgtcattgagaatataaagaacagtgccttagaagacagtgaaaggtaagctctagcttaatgtctatgatttgttctttgacattaaggaaggtaaggattggtcagaggatgtaacttgatgtgagcagtagtaaacctgttttagatatcatactgttaatattttattgaaaatttatttcagagcggagaaacttaagctaaagtctgttatacagaattgaaagccttcgtatcttgaacctcccaacatttttcttatggctgttgaaaagtatagagctaaattgatttaattacactttcctttgtactttaaaaaaaagtatgctagcactattgtaccttgaaaggatttccaccagactgtcttgagtagtgacttctttggtgaggcaagaaggatatacattattttagaatcatttactatttaaatgagacaatcatattattttagaatcatttattttaaatgagacaatcattttaagttttaagataacagaagtgaccaatgtaatttcacaacacctaaggattttttggttgatcaggttactgtagatttttactgattgtcctggatgaatagactgtgctttttctttttctctcccttccttcttggtttcccatagtataataagcatgcatactttaacttctatagttttctcctttagagggtcgtcttcagttttagaggtttacttctcccttgcctttgactcattggactagtgcagaggctttaagtagtttaaaatgggcttttgcttttctaggtcattaacgttttttatttagtttctttagccaatagtggctgagtttcgcacttgattttcaatattttatagtaagaaatgacaaactgctttgtttcatttcataaacaaactctgcatttagataactattaaaggttgttaagatgaagatttactgtttctttgttactcgttggtacagctgtttgttttacttgcacatttgtacatatacttaatgttttcaagtgccttaattgtttaaaatctctggcttcaaagtttcttggggaaaggtcggtttacctcacattttttgtttccattagtaatattctaggtacctcacaaaatgtattatggtgccatggctgttagtttttagtgagtgctgtaggattaattcgaaaataggcagaattccattcctcccaaggtggcaaaaattagctatactgatgtaattgtcatttacctgggtatgaattccctgacacacattcatgtcaacatatgtagcaaattttgtgaaaacataacaatttgaagcttctgtaattttgagcactgctctaacaacaagcataatataaaattagttagattttgcaagtctacaaatgagctcttgcaacagaactcacagcctttttacttttttcccctaactttagcaatgtagtatcttgagccattaatttttgggtttttttaaaatccagaaggtatatagaaaccttttcagatttttcatctgatttgttcttgcagatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttattgaa

SEQ ID NO: 5001 - DNA, 2993 bp, Homo sapiens
ggattgaggggttgactgagcgttgcgagccttagctttctcccgaacgccagcgctgaggacacgatgtcgcggctctcccgctcactgctttgggccgccacctgcctgggcgtgctctgcgtgctgtccgcggacaagaacacgacccagcacccgaacgtgacgactttagcgcccatctccaacgtaacctcggcgccggtgacgtccctcccgctggtcaccactccggcaccagaaacctgtgaaggtcgaaacagctgcgtttcctgttttaatgttagcgttgttaatactacctgcttttggatagaatgtaaagatgagagctattgttcacataactcaacagttagtgattgtcaagtggggaacacgacagacttctgttccgtttccacggccactccagtgccaacagccaattctacagctaaacccacagttcagccctccccttctacaacttccaagacagttactacatcaggtacaacaaataacactgtgactccaacctcacaacctgtgcgaaagtctacctttgatgcagccagtttcattggaggaattgtcctggtcttgggtgtgcaggctgtaattttctttctttataaattctgcaaatctaaagaacgaaattaccacactctgtaaacagacccattgaattaataaggactggtgattcatttgtgtaactcactgaagccaaaatactatcttttaagatgtcccacatggaagacgctattccaggatctttaaatttccatggatgcatataggatgtttgggagcatcatccgtgaagaaaaaatcaattaaatcattgtgttcaacaggaatatttaaaatattctgcatgaatcctgtggctgtcttattttaaatagctgctgctgtgggattatattttttttccttaacatgccaaatataactttctgaaagtgatggaaaatgttgtcttgtgcagacaacatcatggctcttggcagtttaaatttagtaattttaatttagtgaacagaattgagaagaacgtgccaaatgagaatcaattaggtggatttttggctgtcatttcaaaagtggaataaatttattaatttagtagtactaaatggtatccttagattaaaattttgtgcttgataacagctgttttttctacattagaaataagatgccacacaaggaactacattccagatttaaagaaatgaaaggataccattagtgtgtataacagattattgttcatacttgtaaagcatcttatgtcattgagaatataaagaacagtgccttagaagacagtgaaaggtaagctctagcttaatgtctatgatttgttctttgacattaaggaaggtaaggattggtcagaggatgtaacttgatgtgagcagtagtaaacctgttttagatatcatactgttaatattttattgaaaatttatttcagagcggagaaacttaagctaaagtctgttatacagaattgaaagccttcgtatcttgaacctcccaacatttttcttatggctgttgaaaagtatagagctaaattgatttaattacactttcctttgtactttaaaaaaaagtatgctagcactattgtaccttgaaaggatttccaccagactgtcttgagtagtgacttctttggtgaggcaagaaggatatacattattttagaatcatttactatttaaatgagacaatcatattattttagaatcatttattttaaatgagacaatcattttaagttttaagataacagaagtgaccaatgtaatttcacaacacctaaggattttttggttgatcaggttactgtagatttttactgattgtcctggatgaatagactgtgctttttctttttctctcccttccttcttggtttcccatagtataataagcatgcatactttaacttctatagttttctcctttagagggtcgtcttcagttttagaggtttacttctcccttgcctttgactcattggactagtgcagaggctttaagtagtttaaaatgggcttttgcttttctaggtcattaacgttttttatttagtttctttagccaatagtggctgagtttcgcacttgattttcaatattttatagtaagaaatgacaaactgctttgtttcatttcataaacaaactctgcatttagataactattaaaggttgttaagatgaagatttactgtttctttgttactcgttggtacagctgtttgttttacttgcacatttgtacatatacttaatgttttcaagtgccttaattgtttaaaatctctggcttcaaagtttcttggggaaaggtcggtttacctcacattttttgtttccattagtaatattctaggtacctcacaaaatgtattatggtgccatggctgttagtttttagtgagtgctgtaggattaattcgaaaataggcagaattccattcctcccaaggtggcaaaaattagctatactgatgtaattgtcatttacctgggtatgaattccctgacacacattcatgtcaacatatgtagcaaattttgtgaaaacataacaatttgaagcttctgtaattttgagcactgctctaacaacaagcataatataaaattagttagattttgcaagtctacaaatgagctcttgcaacagaactcacagcctttttacttttttcccctaactttagcaatgtagtatcttgagccattaatttttgggtttttttaaaatccagaaggtatatagaaaccttttcagatttttcatctgatttgttcttgcagatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttattgaa

SEQ ID NO: 5002 - DNA, 2936 bp, Homo sapiens
ggattgaggggttgactgagcgttgcgagccttagctttctcccgaacgccagcgctgaggacacgatgtcgcggctctcccgctcactgctttgggccgccacctgcctgggcgtgctctgcgtgctgtccgcggacaagaacacgacccagcacccgaacgtgacgactttagcgcccatctccaacgtaacctcggcgccggtgacgtccctcccgctggtcaccactccggcaccagaaacctgtgaaggtcgaaacagctgcgtttcctgttttaatgttagcgttgttaatactacctgcttttggatagaatgtaaagatgagagctattgttcacataactcaacagttagtgattgtcaagtggggaacacgacagacttctgttccgtttccacggccactccagtgccaacagccaattctacaggtacaacaaataacactgtgactccaacctcacaacctgtgcgaaagtctacctttgatgcagccagtttcattggaggaattgtcctggtcttgggtgtgcaggctgtaattttctttctttataaattctgcaaatctaaagaacgaaattaccacactctgtaaacagacccattgaattaataaggactggtgattcatttgtgtaactcactgaagccaaaatactatcttttaagatgtcccacatggaagacgctattccaggatctttaaatttccatggatgcatataggatgtttgggagcatcatccgtgaagaaaaaatcaattaaatcattgtgttcaacaggaatatttaaaatattctgcatgaatcctgtggctgtcttattttaaatagctgctgctgtgggattatattttttttccttaacatgccaaatataactttctgaaagtgatggaaaatgttgtcttgtgcagacaacatcatggctcttggcagtttaaatttagtaattttaatttagtgaacagaattgagaagaacgtgccaaatgagaatcaattaggtggatttttggctgtcatttcaaaagtggaataaatttattaatttagtagtactaaatggtatccttagattaaaattttgtgcttgataacagctgttttttctacattagaaataagatgccacacaaggaactacattccagatttaaagaaatgaaaggataccattagtgtgtataacagattattgttcatacttgtaaagcatcttatgtcattgagaatataaagaacagtgccttagaagacagtgaaaggtaagctctagcttaatgtctatgatttgttctttgacattaaggaaggtaaggattggtcagaggatgtaacttgatgtgagcagtagtaaacctgttttagatatcatactgttaatattttattgaaaatttatttcagagcggagaaacttaagctaaagtctgttatacagaattgaaagccttcgtatcttgaacctcccaacatttttcttatggctgttgaaaagtatagagctaaattgatttaattacactttcctttgtactttaaaaaaaagtatgctagcactattgtaccttgaaaggatttccaccagactgtcttgagtagtgacttctttggtgaggcaagaaggatatacattattttagaatcatttactatttaaatgagacaatcatattattttagaatcatttattttaaatgagacaatcattttaagttttaagataacagaagtgaccaatgtaatttcacaacacctaaggattttttggttgatcaggttactgtagatttttactgattgtcctggatgaatagactgtgctttttctttttctctcccttccttcttggtttcccatagtataataagcatgcatactttaacttctatagttttctcctttagagggtcgtcttcagttttagaggtttacttctcccttgcctttgactcattggactagtgcagaggctttaagtagtttaaaatgggcttttgcttttctaggtcattaacgttttttatttagtttctttagccaatagtggctgagtttcgcacttgattttcaatattttatagtaagaaatgacaaactgctttgtttcatttcataaacaaactctgcatttagataactattaaaggttgttaagatgaagatttactgtttctttgttactcgttggtacagctgtttgttttacttgcacatttgtacatatacttaatgttttcaagtgccttaattgtttaaaatctctggcttcaaagtttcttggggaaaggtcggtttacctcacattttttgtttccattagtaatattctaggtacctcacaaaatgtattatggtgccatggctgttagtttttagtgagtgctgtaggattaattcgaaaataggcagaattccattcctcccaaggtggcaaaaattagctatactgatgtaattgtcatttacctgggtatgaattccctgacacacattcatgtcaacatatgtagcaaattttgtgaaaacataacaatttgaagcttctgtaattttgagcactgctctaacaacaagcataatataaaattagttagattttgcaagtctacaaatgagctcttgcaacagaactcacagcctttttacttttttcccctaactttagcaatgtagtatcttgagccattaatttttgggtttttttaaaatccagaaggtatatagaaaccttttcagatttttcatctgatttgttcttgcagatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttattgaa

SEQ ID NO: 5003 - DNA, 3014 bp, Homo sapiens
atcgtccgagccccacctccctcctcttcgcccccgcacgccgaaaacaggggcctctcacgtgacccctgcgcgctcccgcgggggagcgtagtctcggaggcggcgccgcaggggattgaggggttgactgagcgttgcgagccttagctttctcccgaacgccagcgctgaggacacgatgtcgcggctctcccgctcactgctttgggccgccacctgcctgggcgtgctctgcgtgctgtccgcggacaagaacacgacccagcacccgaacgtgacgactttagcgcccatctccaacgtaacctcggcgccggtgacgtccctcccgctggtcaccactccggcaccagaaacctgtgaaggtcgaaacagctgcgtttcctgttttaatgttagcgttgttaatactacctgcttttggatagaatgtaaagatgagagctattgttcacataactcaacagttagtgattgtcaagtggggaacacgacagacttctgttccggtacaacaaataacactgtgactccaacctcacaacctgtgcgaaagtctacctttgatgcagccagtttcattggaggaattgtcctggtcttgggtgtgcaggctgtaattttctttctttataaattctgcaaatctaaagaacgaaattaccacactctgtaaacagacccattgaattaataaggactggtgattcatttgtgtaactcactgaagccaaaatactatcttttaagatgtcccacatggaagacgctattccaggatctttaaatttccatggatgcatataggatgtttgggagcatcatccgtgaagaaaaaatcaattaaatcattgtgttcaacaggaatatttaaaatattctgcatgaatcctgtggctgtcttattttaaatagctgctgctgtgggattatattttttttccttaacatgccaaatataactttctgaaagtgatggaaaatgttgtcttgtgcagacaacatcatggctcttggcagtttaaatttagtaattttaatttagtgaacagaattgagaagaacgtgccaaatgagaatcaattaggtggatttttggctgtcatttcaaaagtggaataaatttattaatttagtagtactaaatggtatccttagattaaaattttgtgcttgataacagctgttttttctacattagaaataagatgccacacaaggaactacattccagatttaaagaaatgaaaggataccattagtgtgtataacagattattgttcatacttgtaaagcatcttatgtcattgagaatataaagaacagtgccttagaagacagtgaaaggtaagctctagcttaatgtctatgatttgttctttgacattaaggaaggtaaggattggtcagaggatgtaacttgatgtgagcagtagtaaacctgttttagatatcatactgttaatattttattgaaaatttatttcagagcggagaaacttaagctaaagtctgttatacagaattgaaagccttcgtatcttgaacctcccaacatttttcttatggctgttgaaaagtatagagctaaattgatttaattacactttcctttgtactttaaaaaaaagtatgctagcactattgtaccttgaaaggatttccaccagactgtcttgagtagtgacttctttggtgaggcaagaaggatatacattattttagaatcatttactatttaaatgagacaatcatattattttagaatcatttattttaaatgagacaatcattttaagttttaagataacagaagtgaccaatgtaatttcacaacacctaaggattttttggttgatcaggttactgtagatttttactgattgtcctggatgaatagactgtgctttttctttttctctcccttccttcttggtttcccatagtataataagcatgcatactttaacttctatagttttctcctttagagggtcgtcttcagttttagaggtttacttctcccttgcctttgactcattggactagtgcagaggctttaagtagtttaaaatgggcttttgcttttctaggtcattaacgttttttatttagtttctttagccaatagtggctgagtttcgcacttgattttcaatattttatagtaagaaatgacaaactgctttgtttcatttcataaacaaactctgcatttagataactattaaaggttgttaagatgaagatttactgtttctttgttactcgttggtacagctgtttgttttacttgcacatttgtacatatacttaatgttttcaagtgccttaattgtttaaaatctctggcttcaaagtttcttggggaaaggtcggtttacctcacattttttgtttccattagtaatattctaggtacctcacaaaatgtattatggtgccatggctgttagtttttagtgagtgctgtaggattaattcgaaaataggcagaattccattcctcccaaggtggcaaaaattagctatactgatgtaattgtcatttacctgggtatgaattccctgacacacattcatgtcaacatatgtagcaaattttgtgaaaacataacaatttgaagcttctgtaattttgagcactgctctaacaacaagcataatataaaattagttagattttgcaagtctacaaatgagctcttgcaacagaactcacagcctttttacttttttcccctaactttagcaatgtagtatcttgagccattaatttttgggtttttttaaaatccagaaggtatatagaaaccttttcagatttttcatctgatttgttcttgcagatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttattgaatt

SEQ ID NO: 5004 - DNA, 2414 bp, Homo sapiens
gcggcgccgcaggggattgaggggttgactgagcgttgcgagccttagctttctcccgaacgccagcgctgaggacacgatgtcgcggctctcccgctcactgctttgggccgccacctgcctgggcgtgctctgcgtgctgtccgcggacaagaacacgacccagcacccgaacgtgacgactttagcgcccatctccaacgtaacctcggcgccggtgacgtccctcccgctggtcaccactccggcaccagaaacctgtgaaggtcgaaacagctgcgtttcctgttttaatgttagcgttgttaatactacctgcttttggatagaatgtaaagatgagagctattgttcacataactcaacagttagtgattgtcaagtggggaacacgacagacttctgttccgtttccacggccactccagtgccaacagccaattctacagctaaacccacagttcagccctccccttctacaacttccaagacagttactacatcaggtacaacaaataacactgtgactccaacctcacaacctgtgcgaaagtctacctttgatgcagccagtttcattggaggaattgtcctggtcttggaaataagatgccacacaaggaactacattccagatttaaagaaatgaaaggataccattagtgtgtataacagattattgttcatacttgtaaagcatcttatgtcattgagaatataaagaacagtgccttagaagacagtgaaaggtaagctctagcttaatgtctatgatttgttctttgacattaaggaaggtaaggattggtcagaggatgtaacttgatgtgagcagtagtaaacctgttttagatatcatactgttaatattttattgaaaatttatttcagagcggagaaacttaagctaaagtctgttatacagaattgaaagccttcgtatcttgaacctcccaacatttttcttatggctgttgaaaagtatagagctaaattgatttaattacactttcctttgtactttaaaaaaaagtatgctagcactattgtaccttgaaaggatttccaccagactgtcttgagtagtgacttctttggtgaggcaagaaggatatacattattttagaatcatttactatttaaatgagacaatcatattattttagaatcatttattttaaatgagacaatcattttaagttttaagataacagaagtgaccaatgtaatttcacaacacctaaggattttttggttgatcaggttactgtagatttttactgattgtcctggatgaatagactgtgctttttctttttctctcccttccttcttggtttcccatagtataataagcatgcatactttaacttctatagttttctcctttagagggtcgtcttcagttttagaggtttacttctcccttgcctttgactcattggactagtgcagaggctttaagtagtttaaaatgggcttttgcttttctaggtcattaacgttttttatttagtttctttagccaatagtggctgagtttcgcacttgattttcaatattttatagtaagaaatgacaaactgctttgtttcatttcataaacaaactctgcatttagataactattaaaggttgttaagatgaagatttactgtttctttgttactcgttggtacagctgtttgttttacttgcacatttgtacatatacttaatgttttcaagtgccttaattgtttaaaatctctggcttcaaagtttcttggggaaaggtcggtttacctcacattttttgtttccattagtaatattctaggtacctcacaaaatgtattatggtgccatggctgttagtttttagtgagtgctgtaggattaattcgaaaataggcagaattccattcctcccaaggtggcaaaaattagctatactgatgtaattgtcatttacctgggtatgaattccctgacacacattcatgtcaacatatgtagcaaattttgtgaaaacataacaatttgaagcttctgtaattttgagcactgctctaacaacaagcataatataaaattagttagattttgcaagtctacaaatgagctcttgcaacagaactcacagcctttttacttttttcccctaactttagcaatgtagtatcttgagccattaatttttgggtttttttaaaatccagaaggtatatagaaaccttttcagatttttcatctgatttgttcttgcagatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttattgaattaa

SEQ ID NO: 5005 - DNA, 964 bp, Homo sapiens
gctttctcccgaacgccagcgctgaggacacgatgtcgcggctctcccgctcactgctttgggccgccacctgcctgggcgtgctctgcgtgctgtccgcggacaagaacacgacccagcacccgaacgtgacgactttagcgcccatctccaacgtaacctcggcgccggtgacgtccctcccgctggtcaccactccggcaccagaaacctgtgaaggtcgaaacagctgcgtttcctgttttaatgttagcgttgttaatactacctgcttttggatagaatgtaaagatgagagctattgttcacataactcaacagttagtgattgtcaagtggggaacacgacagacttctgttccgtttccacggccactccagtgccaacagccaattctacagctaaacccacagttcagccctccccttctacaacttccaagacagttactacatcagaaataagatgccacacaaggaactacattccagatttaaagaaatgaaaggataccattagtgtgtataacagattattgttcatacttgtaaagcatcttatgtcattgagaatataaagaacagtgccttagaagacagtgaaaggtaagctctagcttaatgtctatgatttgttctttgacattaaggaaggtaaggattggtcagaggatgtaacttgatgtgagcagtagtaaacctgttttagatatcatactgttaatattttattgaaaatttatttcagagcggagaaacttaagctaaagtctgttatacagaattgaaagccttcgtatcttgaacctcccaacatttttcttatggctgttgaaaagtatagagctaaattgatttaattacactttcctttgtactttaaaaaaaagtatgctagcactattgtaccttgaaaggatttccaccagactgtcttgagtagtgacttctttggtgaggcaag

SEQ ID NO: 5006 - DNA, 2483 bp, Homo sapiens
ctgctgaaaaagcagaaagagattaccagccacagacgggtcatgagcgcggtattactgctggccctcctggggttcatcctcccactgccaggagtgcaggcgctgctctgccagtttgggacagttcagcatgtgtggaaggtgtccgacctgccccggcaatggacccctaagaacaccagctgcgacagcggcttggggtgccaggacacgttgatgctcattgagagcggaccccaagtgagcctggtgctctccaagggctgcacggaggccaaggaccaggagccccgcgtcactgagcaccggatgggccccggcctctccctgatctcctacaccttcgtgtgccgccaggaggacttctgcaacaacctcgttaactccctcccgctttgggccccacagcccccagcagacccaggatccttgaggtgcccagtctgcttgtctatggaaggctgtctggaggggacaacagaagagatctgccccaaggggaccacacactgttatgatggcctcctcaggctcaggggaggaggcatcttctccaatctgagagtccagggatgcatgccccagccagtttgcaacctgctcaatgggacacaggaaattgggcccgtgggtatgactgagaactgcgatatgaaagattttctgcagctcaagccagtaggattacttgaggaacacaatgtgggagagaaagagcgtggtcaaggacaacaccaatgtgttcagctagactggcagaaacgagccgccacgggtattttctgacctgtcatcgggggaccaccattatgacacacggaaacttggctcaagaacccactgattggaccacatcgaataccgagatgtgcgaggtggggcaggtgtgtcaggagacgctgctgctcctagatgtaggactcacatcaaccctggtggcgacctaaagctgcagcgctgttggggctcaaaattcccagaagaccaccatccactcagcccctcctggggtgcttgtggcctcctatacccacttctgctcctcggacctgtgcaatagtgccagcagcagcagcgttctgctgaactccctccctcctcaagctgcccctgtcccaggagaccggcagtgtcctacctgtgtgcagccccttggaacctgttcaagtggctccccccgaatgacctgccccaggggcgccactcattgttatgatgggtacattcatctctcaggaggtgggctgtccaccaaaatgagcattcagggctgcgtggcccaaccttccagcttcttgttgaaccacaccagacaaatcgggatcttctctgcgcgtgagaagcgtgatgtgcagcctcctgcctctcagcatgagggaggtggggctgagggcctggagtctctcacttggggggtggggctggcactggccccagcgctgtggtggggagtggtttgcccttcctgctaactctattacccccacgattcttcaccgctgctgaccacccacactcaacctccctctgacctcataacctaatggccttggacaccagattctttcccattctgtccatgaatcatcttccccacacacaatcattcatatctactcacctaacagcaacactggggagagcctggagcatccggacttgccctatgggagaggggacgctggaggagtggctgcatgtatctgataatacagaccctgtcctttctcccagtgctgggatttctccatgtgagggggcagcaggacacccagggatctagcgtgggggaggagaggagcctaatgagaaaatgaccatctaaagcctgcccttcattggtctggttcacgtctccaaaccagcttggatggtagcagagacttcagggtgctccagccaaacgtatttgggcatcaccatgacctgggaggggaagatgcactgagacgtatgaggcttccagcctagcagccagggccctagcacaaacaggaggctcgccccatctgagcaactgcaggagaggttagtacagtcatgcattgcttaacgacagggacgtgtcgttagaaatgtgtcgttaggtgattttatgaccataggaacattgtagcgtgcacttacaccaacccagatggtacagcccaatacacacccaggatggacgctagagtcgactgctcctaggctacaagcctgcagtgcatgttatggtgtgaatactgcaggcaatcttaacaccacggcaagtatttgtgcatctacacacatctaaacatagaaaaggtacagcataaatacactattgtcatctcagcagaccaccgttctatacgcaattcgtcgctgacccaaacgttgctatgtagcatctgcgtatcgtgggataattgacatgagggcttgagagaactccagaaaaaaatgggttagcattttcccagagctgttatcattgggtctctcttaccaccata

SEQ ID NO: 5007 - DNA, 480 bp, Homo sapiens
ctgctgaaaaagcagaaagagattaccagccacagacgggtcatgagcgcggtattactgctggccctcctggggttcatcctcccactgccaggagtgcaggcgctgctctgccagtttgggacagttcagcatgtgtggaaggtgtccgacctgccccggcaatggacccctaagaacaccagctgcgacagcggcttggggtgccaggacacgttgatgctcattgagagcggaccccaagtgagcctggtgctctccaagggctgcacggaggccaaggaccaggagccccgcgtcactgagcaccggatgggccccggcctctccctgatctcctacaccttcgtgtgccgccaggaggacttctgcaacaacctcgttaactccctcccgctttgggccccacagcccccagcagatcccatgatgggagctgcagaaggcccctttgggaaggctgagcaggttgactcttga

SEQ ID NO: 5008 - DNA, 1512 bp, Homo sapiens
atgagcgcggtattactgctggccctcctggggttcatcctcccactgccaggagtgcaggcgctgctctgccagtttgggacagttcagcatgtgtggaaggtgtccgacctgccccggcaatggacccctaagaacaccagctgcgacagcggcttggggtgccaggacacgttgatgctcattgagagcggaccccaagtgagcctggtgctctccaagggctgcacggaggccaaggaccaggagccccgcgtcactgagcaccggatgggccccggcctctccctgatctcctacaccttcgtgtgccgccaggaggacttctgcaacaacctcgttaactccctcccgctttgggccccacagcccccagcagatcccatgatgggagctgcagaaggcccctttgggaaggctgagcaggttgactcttgaggccagcaaaagtggggtgcagagaaggtatctgatcaaatccagtgccctctcagtgccccctcactctgtctgtcactttcctagacccaggatccttgaggtgcccagtctgcttgtctatggaaggctgtctggaggggacaacagaagagatctgccccaaggggaccacacactgttatgatggcctcctcaggctcaggggaggaggcatcttctccaatctgagagtccagggatgcatgccccagccagtttgcaacctgctcaatgggacacaggaaattgggcccgtgggtatgactgagaactgcgatatgaaagattttctgacctgtcatcgggggaccaccattatgacacacggaaacttggctcaagaacccactgattggaccacatcgaataccgagatgtgcgaggtggggcaggtgtgtcaggagacgctgctgctcctagatgtaggactcacatcaaccctggtggcgacctaaagctgcagcgctgttggggctcaaaattcccagaagaccaccatccactcagcccctcctggggtgcttgtggcctcctatacccacttctgctcctcggacctgtgcaatagtgccagcagcagcagcgttctgctgaactccctccctcctcaagctgcccctgtcccaggagaccggcagtgtcctacctgtgtgcagccccttggaacctgttcaagtggctccccccgaatgacctgccccaggggcgccactcattgttatgatgggtacattcatctctcaggaggtgggctgtccaccaaaatgagcattcagggctgcgtggcccaaccttccagcttcttgttgaaccacaccagacaaatcgggatcttctctgcgcgtgagaagcgtgatgtgcagcctcctgcctctcagcatgagggaggtggggctgagggcctggagtctctcacttggggggtggggctggcactggccccagcgctgtggtggggagtggtttgcccttcctgctaactctattacccccacgattcttcaccgctgctgaccacccacactcaacctc

SEQ ID NO: 5009 - DNA, 1932 bp, Homo sapiens
gcatcccctgcgcgaagctgggtgccccggagagtctgaccaccatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgactgaccccaccaggagattcttcaaagtgacgcctcccccaggaagcgggccccagaaccagtacgggaacgtgctgtctctccccacacccacctcaggcctcggacgcgcccagcgttgggccgcaggcctggggggcactgccccgtcttatggaaacccgagcagcgacgtccaggcggatggagccttggggtcccggagcccgccgggagtgggcccagaagaagaggaaggggagggctatgaggaacctgacagtgaggaggactccgagttctatgagaacgactccaaccttgggcaggaccagctctcccaggatggcagcggctacgagaaccctgaggatgagcccctgggtcctgaggatgaagactccttctccaacgctgagtcttatgagaacgaggatgaagagctgacccagccggtcgccaggacaatggacttcctgagccctcatgggtcagcctgggaccccagccgggaagcaacctccctggggtcccagtcctatgaggatatgagaggaatcctgtatgcagccccccagctccgctccattcggggccagcctggacccaatcatgaggaagatgcagactcttatgagaacatggataatcccgatgggccagacccagcctggggaggagggggccgcatgggcacctggagcaccaggtgatcctcaggtggccagcctggatctcctcaagtccccaagattcacacctgactctgaaatctgaagacctcgagcagatgatgccaacctctggagcaatgttgcttaggatgtgtgcatgtgtgtaagtgtgtgtgtgtgtgtgtgtgtgtatacatgccagtgacacttccagtcccctttgtattccttaaataaactcaatgagctcttccaa

SEQ ID NO: 5010 - DNA, 1420 bp, Homo sapiens
aggcccctgcctgccccagcatcccctgcgcgaagctgggtgccccggagagtctgaccaccatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctgggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgactgaccccaccaggagattcttcaaagtgacgcctcccccaggaagcgggccccagaaccagtacgggaacgtgctgtctctccccacacccacctcaggcctcggacgcgcccagcgttgggccgcaggcctggggggcactgccccgtcttatggaaacccgagcagcgacgtccaggcggatggagccttggggtcccggagcccgccgggagtgggcccagaagaagaggaaggggagggctatgaggaacctgacagtgaggaggactccgagttctatgagaacgactccaaccttgggcaggaccagctctcccaggatggcagcggctacgagaaccctgaggatgagcccctgggtcctgaggatgaagactccttctccaacgctgagtcttatgagaacgaggatgaagagctgacccagccggtcgccaggacaatggacttcctgagccctcatgggtcagcctgggaccccagccgggaagcaacctccctggggtcccagtcctatgaggatatgagaggaatcctgtatgcagccccccagctccgctccattcggggccagcctggacccaatcatgaggaagatgcagactcttatgagaacatggataatcccgatgggccagacccagcctggggaggagggggccgcatgggcacctggagcaccaggtgatcctcaggtggccagcctggatctcctcaagtccccaagattcacacctgactctgaaatctgaagacctcgagcagatgatgccaacctctggagcaatgttgcttaggatgtgtgcatgtgtgtaagtgtgtgtgtgtgtgtgtgtgtgtatacatgccagtgacacttccagtcccctttgtattccttaaataaactcaatgagctcttccaatcct

SEQ ID NO: 5011 - DNA, 1732 bp, Homo sapiens
ttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgactgaccccaccaggagattcttcaaagtgacgcctcccccaggaagcgggccccagaaccagtacgggaacgtgctgtctctccccacacccacctcaggcctcggacgcgcccagcgttgggccgcaggcctggggggcactgccccgtcttatggaaacccgagcagcgacgtccaggcggatggagccttggggtcccggagcccgccgggagtgggcccagaagaagaggaaggggagggctatgaggaacctgacagtgaggaggactccgagttctatgagaacgactccaaccttgggcaggaccagctctcccaggatggcagcggctacgagaaccctgaggatgagcccctgggtcctgaggatgaagactccttctccaacgctgagtcttatgagaacgaggatgaagagctgacccagccggtcgccaggacaatggacttcctgagccctcatgggtcagcctgggaccccagccgggaagcaacctccctggggtcccagtcctatgaggatatgagaggaatcctgtatgcagccccccagctccgctccattcggggccagcctggacccaatcatgaggaagatgcagactcttatgagaacatggataatcccgatgggccagacccagcctggggaggagggggccgcatgggcacctggagcaccaggtgatcctcaggtggccagcctggatctcctcaagtccccaagattcacacctgactctgaaatctgaagacctcgagcagatgatgccaacctctggagcaatgttgcttaggatgtgtgcatgtgtgtaagtgtgtgtgtgtgtgtgtgtgtgtatacatgccagtgacacttccagtcccctttgtattccttaaataaactcaatgagctcttcc

SEQ ID NO: 5012 - DNA, 1957 bp, Homo sapiens
aggcccctgcctgccccagcatcccctgcgcgaagctgggtgccccggagagtctgaccaccatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgactgaccccaccaggagattcttcaaagtgacgcctcccccaggaagcgggccccagaaccagtacgggaacgtgctgtctctccccacacccacctcaggcctcggacgcgcccagcgttgggccgcaggcctggggggcactgccccgtcttatggaaacccgagcagcgacgtccaggcggatggagccttggggtcccggagcccgccgggagtgggcccagaagaagaggaaggggagggctatgaggaacctgacagtgaggaggactccgagttctatgagaacgactccaaccttgggcaggaccagctctcccaggatggcagcggctacgagaaccctgaggatgagcccctgggtcctgaggatgaagactccttctccaacgctgagtcttatgagaacgaggatgaagagctgacccagccggtcgccaggacaatggacttcctgagccctcatgggtcagcctgggaccccagccgggaagcaacctccctggcagggtcccagtcctatgaggatatgagaggaatcctgtatgcagccccccagctccgctccattcggggccagcctggacccaatcatgaggaagatgcagactcttatgagaacatggataatcccgatgggccagacccagcctggggaggagggggccgcatgggcacctggagcaccaggtgatcctcaggtggccagcctggatctcctcaagtccccaagattcacacctgactctgaaatctgaagacctcgagcagatgatgccaacctctggagcaatgttgcttaggatgtgtgcatgtgtgtaagtgtgtgtgtgtgtgtgtgtgtgtatacatgccagtgacacttccagtcccctttgtattccttaaataaactcaatgagctcttccaatcct

SEQ ID NO: 5013 - DNA, 2096 bp, Homo sapiens
gggcagtcgtaggagactctgaaaaagcaaataaatcaatgttaaatcagaaatgtgaatgtagtaaggggctgaagagacaggggaagagaatacatgggaaaatattgaaaaggacagagtgatcaaaaagagcagggacatgggagcattgggcagcacactgggagccatttcactttatgctcttattgtatgattgagaaaaaaatgtccttagtggttaagtggcttttcaatgccacatcagacttgttccatagcagttgaattaggggaaggtgaataagttggaggttggtgacaaggagagaagctggaacagagaggagagtcagaaccagagggaaatgagagactgagtaggcatctcagggtttttgaaggagtggattttctttgttgcagtcaggggaggtttgtctgttggctgcagaaagaagtcagaatagagatatcgtggggtaggtttgtttggaacagaaatcaaagaccaatttttctgagagaaggaaataacatctgcaaatgatatgctgtttttgctacttccattgttagctgttctcccaggtgatggcaatgcagacgggctcaaggagcctctctccttccatgtcacctggatcgcatccttttacaaccattcctggaaacaaaatctggtctcaggttggctgagtgatttgcagactcatacctgggacagcaattccagcaccatcgttttcctgtgcccctggtccaggggaaacttcagcaatgaggagtggaaggaactggaaacattattccgtatacgcaccattcggtcatttgagggaattcgtagatacgcccatgaattgcagtttgaatatccttttgagatacaggtgacaggaggctgtgagctgcactctggaaaggtctcaggaagcttcttgcagttagcttatcaaggatcagactttgtgagcttccagaacaattcatggttgccatatccagtggctgggaatatggccaagcatttctgcaaagtgctcaatcagaatcagcatgaaaatgacataacacacaatcttctcagtgacacctgcccacgtttcatcttgggtcttcttgatgcaggaaaggcacatctccagcggcaagtgaagcccgaggcctggctgtcccatggccccagtcctggccctggccatctgcagcttgtgtgccatgtctcaggattctacccaaagcccgtgtgggtgatgtggatgcggggtgagcaggagcagcagggcactcagcgaggggacatcttgcccagtgctgatgggacatggtatctccgcgcaaccctggaggtggccgctggggaggcagctgacctgtcctgtcgggtgaagcacagcagtctagagggccaggacatcgtcctctactgggagcatcacagttccgtgggcttcatcatcttggcggtgatagtgcctttacttcttctgataggtcttgcgctttggttcaggaaacgctgtttctgttaagacacaccatgagcctcctcgtcacccttctccttttggggtgagagaccagcagcccaagggctccagacacacctgaacacatcgtgatgatgacgtcctctcaactctctttgtaaaaattttgttatttttgcttgtttctgattaatgattgtttgtcaatataagctcaatttaattttgcaggatttgttgttctgacctgggttctgggacttttaaattcaaattttatctccagatggaatggggtcctagcaacctccacatgttcaactattaatggatcatcaggcctgttttagatatcccttactccagagggccttccctgacttacaagtgggaagcagtctcttcctggtctgaactcccgccacattttagccgtactttgctaactgtgctcctcacttcctcttcttcattgcagttatttagatcccccctttccttctaatttttcagctccttcaatgcaaagtacatgtatttttaatatatgcatccctggtgaaggatcttgcctgcatgaaacatgttctcaataaaactctgtgttgaatttatgccaaa

SEQ ID NO: 5014 - DNA, 1395 bp, Homo sapiens
ggcagttggaagagagaagaagtcactacagggtactgaggaaaagctttgctgaaattggagatcaaataccagctctgccagtaagaagttgcatctcccagtgaaatgctgctgctgccatttcaactgttagctgttctctttcctggtggtaacagtgaacatgccttccaggggccgacctcctttcatgttatccagacctcgtcctttaccaatagtacctgggcacaaactcaaggctcaggctggttggatgatttgcagattcatggctgggatagcgactcaggcactgccatattcctgaagccttggtctaaaggtaactttagtgataaggaggttgctgagttagaggagatattccgagtctacatctttggattcgctcgagaagtacaagactttgccggtgatttccagatgaaatacccctttgagatccagggcatagcaggctgtgagctacattctggaggtgccatagtaagcttcctgaggggagctctaggaggattggatttcctgagtgtcaagaatgcttcatgtgtgccttccccagaaggtggcagcagggcacagaaattctgtgcactaatcatacaatatcaaggtatcatggaaactgtgagaattctcctctatgaaacctgcccccgatatctcttgggcgtcctcaatgcaggaaaagcagatctgcaaagacaagtgaagcctgaggcctggctgtccagtggccccagtcctggacctggccgtctgcagcttgtgtgccatgtctcaggattctacccaaagcccgtgtgggtgatgtggatgcggggtgagcaggagcagcagggcactcagctaggggacatcctgcccaatgctaactggacatggtatctccgagcaaccctggatgtggcagatggggaggcggctggcctgtcctgtcgggtgaagcacagcagtttagagggccaggacatcatcctctactggagaaaccccacctccattggctcaattgttttggcaataatagtgccttccttgctccttttgctatgccttgcattatggtatatgaggcgccggtcatatcagaatatcccatgagccatcatcatgtctcctctcccattcgcaataagtaccaagaagcccaagatatcagcccaaaagtcaatcttatcatatttcaaatgattttcaaatttgatgaaatcagagttttcatgtattttaaaataaattattatttaaacatcagcaaaaaagtacttaaaactgtaaatttattatgagactgtactaacagtgtgattcaccctgattttacacacattaaaatgttagaaaaaatgtgtctcaaaataaatgaaatataatacatatgactta

SEQ ID NO: 5015 - DNA, 1024 bp, Homo sapiens
ctcgtcctttaccaatagtacctgggcacaaactcaaggctcaggctggttggatgatttgcagattcatggctgggatagcgactcaggcactgccatattcctgaagccttggtctaaaggtaactttagtgataaggaggttgctgagttagaggagatattccgagtctacatctttggattcgctcgagaagtacaagactttgccggtgatttccagatgaaatacccctttgagatccagggcatagcaggctgtgagctacattctggaggtgccatagtaagcttcctgaggggagctctaggaggattggatttcctgagtgtcaagaatgcttcatgtgtgccttccccagaaggtggcagcagggcacagaaattctgtgcactaatcatacaatatcaaggtatcatggaaactgtgagaattctcctctatgaaacctgcccccgatatctcttgggcgtcctcaatgcaggaaaagcagatctgcaaagacaagtgaagcctgaggcctggctgtccagtggccccagtcctggacctggccgtctgcagcttgtgtgccatgtctcaggattctacccaaagcccgtgtgggtgatgtggatgcggggaaaccccacctccattggctcaattgttttggcaataatagtgccttccttgctccttttgctatgccttgcattatggtatatgaggcgccggtcatatcagaatatcccatgagccatcatcatgtctcctctcccattcgcaataagtaccaagaagcccaagatatcagcccaaaagtcaatcttatcatatttcaaatgattttcaaatttgatgaaatcagagttttcatgtattttaaaataaattattatttaaacatcagcaaaaaagtacttaaaactgtaaatttattatgagactgtactaacagtgtgattcaccctgattttacacacattaaaatgttagaaaaaatgtgtctcaaaataaatgaaatataatacatatgactta

SEQ ID NO: 5016 - DNA, 2501 bp, Homo sapiens
accactttgtctaaggcagttgaggaagggaagtagatataatggagcttagtggcagagcagctggaatcctgagagaagagaataactttagttcagagcaggtggggaaatgagagattgagtaggaggaccaaggttgagggaagcagatcttcttagttgctgtcagcggctgatggggaagattgttggtagaaggaagtcagaatataggtacagagggataagtttgctaagaacagagatcagcaaacagcttttctgagagaaagaaacatctgcaaatgacatgctgtttctgcagtttctgctgctagctcttcttctcccaggtggtgacaatgcagacgcatcccaggaacacgtctccttccatgtcatccagatcttctcatttgtcaaccaatcctgggcacgaggtcagggctcaggatggctggacgagttgcagactcatggctgggacagtgaatcaggcacaataattttcctgcataactggtccaagggcaacttcagcaatgaagagttgtcagacctagagttgttatttcgtttctacctctttggattaactcgggagattcaagaccatgcaagtcaagattactcgaaatatccctttgaagtacaggtgaaagcgggctgtgagctgcattctggaaagagcccagaaggcttctttcaggtagctttcaacggattagatttactgagtttccagaatacaacatgggtgccatctccaggctgtggaagtttggcccaaagtgtctgtcatctactcaatcatcagtatgaaggcgtcacagaaacagtgtataatctcataagaagcacttgcccccgatttctcttgggtctcctggatgcagggaagatgtatgtacacaggcaagtgaggccagaagcctggctgtccagtcgccccagccttgggtctggccagctgttgctggtttgtcatgcctccggcttctacccaaagcctgtttgggtgacatggatgcggaatgaacaggagcaactgggcactaaacatggtgatattcttcctaatgctgatgggacatggtatcttcaggtgatcctggaggtggcatctgaggagcctgctggcctgtcttgtcgagtgagacacagcagtctaggaggccaggacatcatcctctactgggctcatatcaggacatcctgtgagactcttccccctgactcccccattgtgttaagaacccagcaacccaggagcctagtacaatatagtgatgccatcccgtcgactctccatttaaattgtttctctttctgcataataaacatttgttaataaaaaccaaattctaatttggaatgtttttcttggaatctccactttttatatagcactcaaccttcaaagcccatttctgatgtcatttcctccaacgatcttccttgacccatactgaacccagagagcccctcaactgttatgtgcatgcaacacttcctaccctgtgttgcagctacttgagtctttcatttcacatttttaagcttttaggaggcaaggatcatgataaatgtgcctttcctgcatatgataggctcagtgaaacacaaaacaaaacatcatatctaagttggattaactgtcatgttgacaatttttctcattatattccttcccaatgttgttgtagcattggaaatattcatgcttctctttttgtttaaatgcttcatacctagcagataaattccactctcctttagctccctcattttctccttaaacatttaaggaaaagtgcagccttgtgccttgatacacttattttctaaacacagagaattacaaatgcaaatagacagagagtgtgcaagttacatgtgatgatcagtggtgcagatatgtcacagaatacttaagaaaaggaacaagagatttggtcctcagggttggagtgggatcaaggcaaccgttgtgctgtatatggaagacaaatttcctaaaggactgtgttatctgagatagccttggctaaactttagtccctttaggtttcattcactaattcaactaatattttttgggtactgagttgagacaggcacatacagcttctaaactggtggtggataaaacaaatgagattgtgtccactctcctgaagttgcaatgtttgcttcctcaatctgtccatgtttcttttctattgttttcatgtttttatttatttcaaaaaattttaaatagattttattgatgtataatttatagtaaaatttgaatctttaagtgtacagttctatttattttgataattatataagcccatgtaaacaaaatcacaatcaagatattaaatgtcataacccctcatacctgtttgtagtcaagcacaccaacaacctggcattcttgcaactactgatatactttatgtcacttaagcttaaacttgtattttctatgattttattaagatggaaataaacatatctacttggta

SEQ ID NO: 5017 - DNA, 1435 bp, Homo sapiens
aggcagttgaggaagggaagtagatataatggagcttagtggcagagcagctggaatcctgagagaagagaataactttagttcagagcaggtggggaaatgagagattgagtaggaggaccaaggttgagggaagcagatcttcttagttgctgtcagcggctgatggggaagattgttggtagaaggaagtcagaatataggtacagagggataagtttgctaagaacagagatcagcaaacagcttttctgagagaaagaaacatctgcaaatgacatgctgtttctgcagtttctgctgctagctcttcttctcccaggtggtgacaatgcagacgcatcccaggaacacgtctccttccatgtcatccagatcttctcatttgtcaaccaatcctgggcacgaggtcagggctcaggatggctggacgagttgcagactcatggctgggacagtgaatcaggcacaataattttcctgcataactggtccaagggcaacttcagcaatgaagagttgtcagacctagagttgttatttcgtttctacctctttggattaactcgggagattcaagaccatgcaagtcaagattactcgaaatatccctttgaagtacaggtgaaagcgggctgtgagctgcattctggaaagagcccagaaggcttctttcaggtagctttcaacggattagatttactgagtttccagaatacaacatgggtgccatctccaggctgtggaagtttggcccaaagtgtctgtcatctactcaatcatcagtatgaaggcgtcacagaaacagtgtataatctcataagaagcacttgcccccgatttctcttgggtctcctggatgcagggaagatgtatgtacacaggcaagtgaggccagaagcctggctgtccagtcgccccagccttgggtctggccagctgttgctggtttgtcatgcctccggcttctacccaaagcctgtttgggtgacatggatgcggaatgaacaggagcaactgggcactaaacatggtgatattcttcctaatgctgatgggacatggtatcttcaggtgatcctggaggtggcatctgaggagcctgctggcctgtcttgtcgagtgagacacagcagtctaggaggccaggacatcatcctctactggggacaccacttttccatgaattggattgccttggtagtgatagtgcccttggtgattctaatagtccttgtgttatggtttaagaagcactgctcatatcaggacatcctgtgagactcttccccctgactcccccattgtgttaagaacccagcaacccaggagcctagtacaatatagtgatgccatcccgtcgactctccatttaaattgtttctctttctgcataataaacatttgttaataaaaaccaaattctaatttggaa

SEQ ID NO: 5018 - DNA, 855 bp, Homo sapiens
tttcctgcataactggtccaagggcaacttcagcaatgaagagttgtcagacctagagttgttatttcgtttctacctctttggattaactcgggagattcaagaccatgcaagtcaagattactcgaaatatccctttgaagtacaggtgaaagcgggctgtgagctgcattctggaaagagcccagaaggcttctttcaggtagctttcaacggattagatttactgagtttccagaatacaacatgggtgccatctccaggctgtggaagtttggcccaaagtgtctgtcatctactcaatcatcagtatgaaggcgtcacagaaacagtgtataatctcataagaagcacttgcccccgatttctcttgggtctcctggatgcagggaagatgtatgtacacaggcaagtgaggccagaagcctggctgtccagtcgccccagccttgggtctggccagctgttgctggtttgtcatgcctccggcttctacccaaagcctgtttgggtgacatggatgcggaatgaacaggagcaactgggcactaaacatggtgatattcttcctaatgctgatgggacatggtatcttcaggtgatcctggaggtggcatctgaggagcctgctggcctgtcttgtcgagtgagacacagcagtctaggaggccaggacatcatcctctactgggctcatatcaggacatcctgtgagactcttccccctgactcccccattgtgttaagaacccagcaacccaggagcctagtacaatatagtgatgccatcccgtcgactctccatttaaattgtttctctttctgcataataaacatttgttaataaaaaccaaa

SEQ ID NO: 5019 - DNA, 1425 bp, Homo sapiens
gttgctgtcagtggctgatggggaagattgtctgttggtagaaggaagtcagaatatagatgtagagggataagtttgctaagaacagagatcagcaaatggcttttctgagagaaggaaacaactgcaaatgacatgctgtttctgtagtttccgctgctagttcttctcctccccggtggtgacaatgcagcatcccaggaacacgtctccttccatgtcatccagatcttctcatttgtcaaccaatcctgggcacgaggtcagggctcaggatggctggacgagttgcagactcatggctgggacagtgaatcaggcacaataattttcctgcataactggtccaagggcaacttcagcaatgaagagttgtcagacctagagttgttatttcgtttctacctctttggattaactcgggagattcaagaccatgcaagtcaagattactcgaaatatccctttgaagtacaggtgaaagcgggctgtgagctgcattctggaaagagcccagaaggcttctttcaggtagctttcaacggattagatttactgagtttccagaatacaacatgggtgccatctccaggctgtggaagtttggcccaaagtgtctgtcatctactcaatcatcagtatgaaggcgtcacagaaacagtgtataatctcataagaagcacttgcccccgatttctcttgggtctcctggatgcagggaagatgtatgtacacaggcaagtgaggccagaagcctggctgtccagtcgccccagccttgggtctggccagctgttgctggtttgtcatgcctccggcttctacccaaagcctgtttgggtgacatggatgcggaatgaacaggagcaactgggcactaaacatggtgatattcttcctaatgctgatgggacatggtatcttcaggtgatcctggaggtggcatctgaggagcctgctggcctgtcttgtcgagtgagacacagcagtctaggaggccaggacatcatcctctactggggacaccacttttccatgaattggattgccttggtagtgatagtgcccttggtgattctaatagtccttgtgttatggtttaagaagcactgctcatatcaggacatcctgtgagactcttccccctgactcccccattgtgttaagaacccagcaacccaggagcctagtacaatatagtgatgccatcccgtcgactctccatttaaattgtttctctttctgcataataaacatttgttaataaaaaccaaattctaatttggaatgtttttcttggaatctccactttttatatagcactcaaccttcaaagcccatttctgatgtcatttcctccaacgatcttccttgacccatactgaacccagagagcccctcaactgttatgtgcatgcaacactt

SEQ ID NO: 5020 - DNA, 2253 bp, Homo sapiens
gttttctacccaagaatgctacttcaggagatcagtcaaaaggttagggtgatggtgacggtggaaatatagaaaaaggaatttattcaagaggtattcaaaaagaagtgaaatagagatgagttggagatagattggataaaaagagtgagggagagggaggtgtcaggctgcagcccaggttctgagttgccaaagaggagtcttttcctccaggaaattgagacacgccggttgtgaaacctactgaagtgagcggcggcgccaggattcctgggaccccgacctctttgcagctcgcacagctaagggcgagggcgcccttcggcagaagcagcaaaccgccggcaagcccagcgaggagggctgccggggtctgggcttgggaattggctggcacccagcggaaagggacgtgagctgagcggcgggggagaagagtgcgcaggtcagagggcggcgcgcagcggcgctccgcgaggtccccacgccgggcgatatggggtgcctgctgtttctgctgctctgggcgctcctccaggcttggggaagcgctgaagtcccgcaaaggcttttccccctccgctgcctccagatctcgtccttcgccaatagcagctggacgcgcaccgacggcttggcgtggctgggggagctgcagacgcacagctggagcaacgactcggacaccgtccgctctctgaagccttggtcccagggcacgttcagcgaccagcagtgggagacgctgcagcatatatttcgggtttatcgaagcagcttcaccagggacgtgaaggaattcgccaaaatgctacgcttatcctatcccttggagctccaggtgtccgctggctgtgaggtgcaccctgggaacgcctcaaataacttcttccatgtagcatttcaaggaaaagatatcctgagtttccaaggaacttcttgggagccaacccaagaggccccactttgggtaaacttggccattcaagtgctcaaccaggacaagtggacgagggaaacagtgcagtggctccttaatggcacctgcccccaatttgtcagtggcctccttgagtcagggaagtcggaactgaagaagcaagtgaagcccaaggcctggctgtcccgtggccccagtcctggccctggccgtctgctgctggtgtgccatgtctcaggattctacccaaagcctgtatgggtgaagtggatgcggggtgagcaggagcagcagggcactcagccaggggacatcctgcccaatgctgacgagacatggtatctccgagcaaccctggatgtggtggctggggaggcagctggcctgtcctgtcgggtgaagcacagcagtctagagggccaggacatcgtcctctactggggtgggagctacacctccatgggcttgattgccttggcagtcctggcgtgcttgctgttcctcctcattgtgggctttacctcccggtttaagaggcaaacttcctatcagggcgtcctgtgactcgccttgccacatctgtgtctctggaacccaggacctctggacctcaggttcctaagacttcagtcctggtctgctcaggaattgaagatgtaaggaattgaagataggagagataccttgaaaaagtagagaacagtcatgaggcagctttcatcacacccttttaacatttatctaaaagaatttaaattctttttcaaaaattacactacaagtttataagcccaaatggctctgtgaaatcagaagtgcaaaggtgtgcaaacttgtatctgaagacctaccagggacaagcaggtaagagctgatgtgagtgtgtgtgatgggatctgtaaggaactggaacacacatgtcctatccaaaggaatcagctgcagctgcttgttgtcaagtataaagtcaggacctggcttggctttaaccgtttttcaagaaaactggaaatctggattttcagcgaacatgcctgattttaaaaggttgactcaagtttttacaaaatactatgtgggacacctcaaatacatacctactgactgatgacaaacccaggagtttgtgtgtcttttataaaaagtttgccctggatgtcatattggcagttggaggacacagtttctattgtaaatttggatttacgactgaagaaggacattttctctttaaaagaaagttaggttataagaaacagaggcgtctcacatttttacttggtgtaattaataaacgaagataaatcata

SEQ ID NO: 5021 - DNA, 435 bp, Homo sapiens
atgctgctcctgttcctcctcttcgagggtctctgctgtcctggggaaaatacagcagtgaagccagaggcctggctgtcctgtggccccagtcctggccctggccgtctgcagcttgtgtgccatgtctcaggattctacccaaagcccgtgtgggtgatgtggatgcggggtggatattccatctttctcatcctgatctgtttgactgtgatagttaccctggtcatattggttgtagttgactcacggttaaaaaaacagagttcaaataagaacattctttctccccacacacccagccctgtctttctcatgggagccaacactcaggacaccaagaattcaagacatcagttctgcttggcacaagtatcgtggatcaaaaacagagtattgaagaagtggaagacacgcctaaaccaactctggtga

SEQ ID NO: 5022 - DNA, 696 bp, Homo sapiens
atgctgctcctgttcctcctcttcgagggtctctgctgtcctggggaaaatacagcagctccccaggctctacaatcctatcatctagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccagatagtgcaagcttctgctggtcaatttcagcttgaattgaagccagaggcctggctgtcctgtggccccagtcctggccctggccgtctgcagcttgtgtgccatgtctcaggattctacccaaagcccgtgtgggtgatgtggatgcggggtggatattccatctttctcatcctgatctgtttgactgtgatagttaccctggtcatattggttgtagttgactcacggttaaaaaaacagagccctgtctttctcatgggagccaacactcaggacaccaagaattcaagacatcagttctgcttggcacaagtatcgtggatcaaaaacagagtattgaagaagtggaagacacgcctaaaccaactctggtga

SEQ ID NO: 5023 - DNA, 861 bp, Homo sapiens
atgctgctcctgttcctcctcttcgagggtctctgctgtcctggggaaaatacagcagctccccaggctctacaatcctatcatctagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccagatagtgcaagcttctgctggtcaatttcagcttgaattgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattggggtggatattccatctttctcatcctgatctgtttgactgtgatagttaccctggtcatattggttgtagttgactcacggttaaaaaaacagagccctgtctttctcatgggagccaacactcaggacaccaagaattcaagacatcagttctgcttggcacaagtatcgtggatcaaaaacagagtattgaagaagtggaagacacgcctaaaccaactctggtga

SEQ ID NO: 5024 - DNA, 399 bp, Homo sapiens
atgctgctcctgttcctcctcttcgagggtctctgctgtcctggggaaaatacagcagtgaagccagaggcctggctgtcctgtggccccagtcctggccctggccgtctgcagcttgtgtgccatgtctcaggattctacccaaagcccgtgtgggtgatgtggatgcggggtggatattccatctttctcatcctgatctgtttgactgtgatagttaccctggtcatattggttgtagttgactcacggttaaaaaaacagagccctgtctttctcatgggagccaacactcaggacaccaagaattcaagacatcagttctgcttggcacaagtatcgtggatcaaaaacagagtattgaagaagtggaagacacgcctaaaccaactctggtga

SEQ ID NO: 5025 - DNA, 1727 bp, Homo sapiens
atgctgctcctgttcctcctcttcgagggtctctgctgtcctggggaaaatacagcagctccccaggctctacaatcctatcatctagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccagatagtgcaagcttctgctggtcaatttcagcttgaataccccttcgagatccagatattagctggctgtagaatgaatgccccacaaatcttcttaaatatggcatatcaagggtcagatttcctgagtttccaaggaatttcctgggagccatctccaggagcagggatccgggcccagaacatctgtaaagtgctcaatcgctacctagatattaaggaaatactgcaaagccttcttggtcacacctgccctcgatttctagcggggctcatggaagcaggggagtcagaactgaaacggaaagtgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattggggtggatattccatctttctcatcctgatctgtttgactgtgatagttaccctggtcatattggttgtagttgactcacggttaaaaaaacagagccctgtctttctcatgggagccaacactcaggacaccaagaattcaagacatcagttctgcttggcacaagtatcgtggatcaaaaacagagtattgaagaagtggaagacacgcctaaaccaactctggtgacatttgctttaccttatacataaaatccttgtctgcatcttcttaaacaccgtccatgtcccataagggaagcatgcttttatttaaacagtttatactagcaaagatactgacccctttaggaatactttttccccatcttccagagattttttttttcctgctttggctacatatccatcattgtttatttttgaaactataatccagatacttctttttcatggattcccgagatcacccaattgatagctcttctgtactccccaaattgaactgatcttcacaagcacattcatctcttcctactctgaacagtagttatttaggtttttgctctttttttttttttaatctcagttgcttgaaagtaggatttaggtatttgtgtctgtattcatgaccaaaaatcttatctgaattcagggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgat

SEQ ID NO: 5026 - DNA, 1689 bp, Homo sapiens
atgctgctcctgttcctcctcttcgagggtctctgctgtcctggggaaaatacagcagctccccaggctctacaatcctatcatctagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccagatagtgcaagcttctgctggtcaatttcagcttgaataccccttcgagatccagatattagctggctgtagaatgaatgccccacaaatcttcttaaatatggcatatcaagggtcagatttcctgagtttccaaggaatttcctgggagccatctccaggagcagggatccgggcccagaacatctgtaaagtgctcaatcgctacctagatattaaggaaatactgcaaagccttcttggtcacacctgccctcgatttctagcggggctcatggaagcaggggagtcagaactgaaacggaaagtgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtggatattccatctttctcatcctgatctgtttgactgtgatagttaccctggtcatattggttgtagttgactcacggttaaaaaaacagagttcaaataagaacattctttctccccacacacccagccctgtctttctcatgggagccaacactcaggacaccaagaattcaagacatcagttctgcttggcacaagtatcgtggatcaaaaacagagtattgaagaagtggaagacacgcctaaaccaactctggtgacatttgctttaccttatacataaaatccttgtctgcatcttcttaaacaccgtccatgtcccataagggaagcatgcttttatttaaacagtttatactagcaaagatactgacccctttaggaatactttttccccatcttccagagattttttttttcctgctttggctacatatccatcattgtttatttttgaaactataatccagatacttctttttcatggattcccgagatcacccaattgatagctcttctgtactccccaaattgaactgatcttcacaagcacattcatctcttcctactctgaacagtagttatttaggtttttgctctttttttttttttaatctcagttgcttgaaagtaggatttaggtatttgtgtctgtattcatgaccaaaaatcttatctgaattcagggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattcagtgtgaatgtaatatttctcaataaat

SEQ ID NO: 5027 - DNA, 936 bp, Homo sapiens
tgtctcaggattctacccaaagcccgtgtgggtgatgtggatgcggggtgagcaggagcagcggggcactcagcgaggggacgtcctgcctaatgctgacgagacatggtggatattccatctttctcatcctgatctgtttgactgtgatagttaccctggtcatattggttgtagttgactcacggttaaaaaaacagagccctgtctttctcatgggagccaacactcaggacaccaagaattcaagacatcagttctgcttggcacaagtatcgtggatcaaaaacagagtattgaagaagtggaagacacgcctaaaccaactctggtgacatttgctttaccttatacataaaatccttgtctgcatcttcttaaacaccgtccatgtcccataagggaagcatgcttttatttaaacagtttatactagcaaagatactgacccctttaggaatactttttccccatcttccagagattttttttttcctgctttggctacatatccatcattgtttatttttgaaactataatccagatacttctttttcatggattcccgagatcacccaattgatagctcttctgtactccccaaattgaactgatcttcacaagcacattcatctcttcctactctgaacagtagttatttaggtttttgctctttttttttttttaatctcagttgcttgaaagtaggatttaggtatttgtgtctgtattcatgaccaaaaatcttatctgaattcagggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattcagt

SEQ ID NO: 5028 - DNA, 1678 bp, Homo sapiens
gggtgtggagaggggtactgatatctgaattattagggcaggtgtcctgccaaggaatccctcctttaacagagcttcaatgctgctcctgttcctcctcttcgagggtctctgctgtcctggggaaaatacagcagctccccaggctctacaatcctatcatctagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccagatagtgcaagcttctgctggtcaatttcagcttgaataccccttcgagatccagatattagctggctgtagaatgaatgccccacaaatcttcttaaatatggcatatcaagggtcagatttcctgagtttccaaggaatttcctgggagccatctccaggagcagggatccgggcccagaacatctgtaaagtgctcaatcgctacctagatattaaggaaatactgcaaagccttcttggtcacacctgccctcgatttctagcggggctcatggaagcaggggagtcagaactgaaacggaaagtgaagccagaggcctggctgtcctgtggccccagtcctggccctggccgtctgcagcttgtgtgccatgtctcaggattctacccaaagcccgtgtgggtgatgtggatgcggggtggatattccatctttctcatcctgatctgtttgactgtgatagttaccctggtcatattggttgtagttgactcacggttaaaaaaacagagccctgtctttctcatgggagccaacactcaggacaccaagaattcaagacatcagttctgcttggcacaagtatcgtggatcaaaaacagagtattgaagaagtggaagacacgcctaaaccaactctggtgacatttgctttaccttatacataaaatccttgtctgcatcttcttaaacaccgtccatgtcccataagggaagcatgcttttatttaaacagtttatactagcaaagatactgacccctttaggaatactttttccccatcttccagagattttttttttcctgctttggctacatatccatcattgtttatttttgaaactataatccagatacttctttttcatggattcccgagatcacccaattgatagctcttctgtactccccaaattgaactgatcttcacaagcacattcatctcttcctactctgaacagtagttatttaggtttttgctctttttttttttttaatctcagttgcttgaaagtaggatttaggtatttgtgtctgtattcatgaccaaaaatcttatctgaattcagggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattcagtgtgaatgtaatatttctcaataaatgctgact

SEQ ID NO: 5029 - DNA, 869 bp, Homo sapiens
ggagaggggtactgatatctgaattattagggcaggtgtcctgccaaggaatccctcctttaacagagcttcaatgctgctcctgttcctcctcttcgagggtctctgctgtcctggggaaaatacagcagtgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtggatattccatctttctcatcctgatctgtttgactgtgatagttaccctggtcatattggttgtagttgactcacggttaaaaaaacagagttcaaataagaacattctttctccccacacacccagccctgtctttctcatgggagccaacactcaggacaccaagaattcaagacatcagttctgcttggcacaagtatcgtggatcaaaaacagagtattgaagaagtggaagacacgcctaaaccaactctggtgacatttgctttaccttatacataaaatccttgtctgcatcttcttaaacaccgtccatgtcccataagggaagcatgcttttatttaaacagtttatactagcaaagatactgacccctttaggaatactttttccccatcttccagagattttttttttcctgctttggctacatatccatcattgtttatttttgaaactataatccagatacttctttttcatggattcccgagatcacccaattgatagctcttctgtactccccaaattgaactgatcttcacaagcacattcatc

SEQ ID NO: 5030 - DNA, 1003 bp, Homo sapiens
caagggaagtcagacgagagtgcaagagggtgtggagaggggtactgatatctgaattattagggcaggtgtcctgccaaggaatccctcctttaacagagcttcaatgctgctcctgttcctcctcttcgagggtctctgctgtcctggggaaaatacagcagctccccaggctctacaatcctatcatctagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccagatagtgcaagcttctgctggtcaatttcagcttgaattgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattggggtggatattccatctttctcatcctgatctgtttgactgtgatagttaccctggtcatattggttgtagttgactcacggttaaaaaaacagagttcaaataagaacattctttctccccacacacccagccctgtctttctcatgggagccaacactcaggacaccaagaattcaagacatcagttctgcttggcacaagtatcgtggatcaaaaacagagtattgaagaagtggaagacacgcctaaaccaactctggtga

SEQ ID NO: 5031 - DNA, 1271 bp, Homo sapiens
agggaagtcagacgagagtgcaagagggtgtggagaggggtactgatatctgaattattagggcaggtgtcctgccaaggaatccctcctttaacagagcttcaatgctgctcctgttcctcctcttcgagggtctctgctgtcctggggaaaatacagcagtgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattggggtggatattccatctttctcatcctgatctgtttgactgtgatagttaccctggtcatattggttgtagttgactcacggttaaaaaaacagagccctgtctttctcatgggagccaacactcaggacaccaagaattcaagacatcagttctgcttggcacaagtatcgtggatcaaaaacagagtattgaagaagtggaagacacgcctaaaccaactctggtgacatttgctttaccttatacataaaatccttgtctgcatcttcttaaacaccgtccatgtcccataagggaagcatgcttttatttaaacagtttatactagcaaagatactgacccctttaggaatactttttccccatcttccagagattttttttttcctgctttggctacatatccatcattgtttatttttgaaactataatccagatacttctttttcatggattcccgagatcacccaattgatagctcttctgtactccccaaattgaactgatcttcacaagcacattcatctcttcctactctgaacagtagttatttaggtttttgctctttttttttttttaatctcagttgcttgaaagtaggatttaggtatttgtgtctgtattcatgaccaaaaatcttatctgaattcagggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattcagtgt

SEQ ID NO: 5032 - DNA, 1458 bp, Homo sapiens
gaaaatctggagccagacagtgagagaggcagaggggaaatgaaaaaccccgtgggaggctgcagcaaagcgaggcagtgtggcttctctgacagggaagtcagcagagggagaggtttgtctgtctgtacagcaagggaagtcagacgagagtgcaagagggtgtggagaggggtactgatatctgaattattagggcaggtgtcctgccaaggaatccctcctttaacagagcttcaatgctgctcctgttcctcctcttcgagggtctctgctgtcctggggaaaatacagcagctccccaggctctacaatcctatcatctagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccagatagtgcaagcttctgctggtcaatttcagcttgaataccccttcgagatccagatattagctggctgtagaatgaatgccccacaaatcttcttaaatatggcatatcaagggtcagatttcctgagtttccaaggaatttcctgggagccatctccaggagcagggatccgggcccagaacatctgtaaagtgctcaatcgctacctagatattaaggaaatactgcaaagccttcttggtcacacctgccctcgatttctagcggggctcatggaagcaggggagtcagaactgaaacggaaagtgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattggggtggatattccatctttctcatcctgatctgtttgactgtgatagttaccctggtcatattggttgtagttgactcacggttaaaaaaacagagttcaaataagaacattctttctccccacacacccagccctgtctttctcatgggagccaacactcaggacaccaagaattcaagacatcagttctgcttggcacaagtatcgtggatcaaaaacagagtattgaagaagtggaagacacgcctaaaccaactctggtgacatttgctttaccttatacataaaatccttgtctgcatcttcttaaacaccg

SEQ ID NO: 5033 - DNA, 1504 bp, Homo sapiens
gtcttctgatcatgatcaagagcagagtgaagagatacaggcggaggagaggatcacagagagctccccaggctctacaatcctatcatctagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccagatagtgcaagcttctgctggtcaatttcagcttgaataccccttcgagatccagatattagctggctgtagaatgaatgccccacaaatcttcttaaatatggcatatcaagggtcagatttcctgagtttccaaggaatttcctgggagccatctccaggagcagggatccgggcccagaacatctgtaaagtgctcaatcgctacctagatattaaggaaatactgcaaagccttcttggtcacacctgccctcgatttctagcggggctcatggaagcaggggagtcagaactgaaacggaaagtgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattggggtgagaaacagctgaggctctgctgggaaataatgaaaatagccctggggcttttgagtgtggggctgaggaaatgggtaggaatgctaggtacaagaagggtaaaactgggacaatcaaaataaagaaggatagagtatgacagtagttaaattttaagaaaatggaagtagagaattagacatactaacagaaaaaggaggaggaactagtgatttagtgggagagggttgggaggagatcacagacaaaggatcaggaggaattgaaatgagggctttggaaaacccagatgaaaattctaggaaggtcccacccttgtgaaatgggaaatctcagcttggtggaatagagtattttagggttggtattcttattctatccccaaccaggtggatattccatctttctcatcctgatctgtttgactgtgatagttaccctggtcatattggttgtagttgactcacggttaaaaaaacagaggtgagctttttcttgttctttgtttcttcagcctgtaatcaattcattcctttttcctctatcttctttttttttttctctgcctttcccctttatttcctttctttga

SEQ ID NO: 5034 - DNA, 1820 bp, Homo sapiens
ttccagcagttagtgcaattagggaggttgggaggatgtacacaagagcagggagaaaatctggagccagacagtgagagaggcagaggggaaatgaaaaaccccgtgggaggctgcagcaaagcgaggcagtgtggcttctctgacagggaagtcagcagagggagaggtttgtctgtctgtacagcaagggaagtcagacgagagtgcaagagggtgtggagaggggtactgatatctgaattattagggcaggtgtcctgccaaggaatccctcctttaacagagcttcaatgctgctcctgttcctcctcttcgagggtctctgctgtcctggggaaaatacagcagaccccttcgagatccagatattagctggctgtagaatgaatgccccacaaatcttcttaaatatggcatatcaagggtcagatttcctgagtttccaaggaatttcctgggagccatctccaggagcagggatccgggcccagaacatctgtaaagtgctcaatcgctacctagatattaaggaaatactgcaaagccttcttggtcacacctgccctcgatttctagcggggctcatggaagcaggggagtcagaactgaaacggaaagtgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattggggtggatattccatctttctcatcctgatctgtttgactgtgatagttaccctggtcatattggttgtagttgactcacggttaaaaaaacagagttcaaataagaacattctttctccccacacacccagccctgtctttctcatgggagccaacactcaggacaccaagaattcaagacatcagttctgcttggcacaagtatcgtggatcaaaaacagagtattgaagaagtggaagacacgcctaaaccaactctggtgacatttgctttaccttatacataaaatccttgtctgcatcttcttaaacaccgtccatgtcccataagggaagcatgcttttatttaaacagtttatactagcaaagatactgacccctttaggaatactttttccccatcttccagagattttttttttcctgctttggctacatatccatcattgtttatttttgaaactataatccagatacttctttttcatggattcccgagatcacccaattgatagctcttctgtactccccaaattgaactgatcttcacaagcacattcatctcttcctactctgaacagtagttatttaggtttttgctctttttttttttttaatctcagttgcttgaaagtaggatttaggtatttgtgtctgtattcatgaccaaaaatcttatctgaattcagggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattcagtgtgaatgtaatatttctcaataaatgctgactgaaataaatttgttgttagatcaa

SEQ ID NO: 5035 - DNA, 745 bp, Homo sapiens
gggaagtcagcagagggagaggtttgtctgtctgtacagcaagggaagtcagacgagagtgcaagagggtgtggagaggggtactgatatctgaattattagggcaggtgtcctgccaaggaatccctcctttaacagagcttcaatgctgctcctgttcctcctcttcgagggtctctgctgtcctggggaaaatacagcagtgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattggggtggatattccatctttctcatcctgatctgtttgactgtgatagttaccctggtcatattggttgtagttgactcacggttaaaaaaacagagttcaaataagaacattctttctccccacacacccagccctgtctttctcatgggagccaacactcaggacaccaagaattcaagacatcagttctgcttggcacaagtatcgtggatcaaaaacagagtattgaagaagtggaagacacgcctaaaccaactctggtga

SEQ ID NO: 5036 - DNA, 2299 bp, Homo sapiens
gtctttgcttcagggcttcatacaggaaatctattgctgtgtcaagttccagagaaaagcttctgttcgtccaagttactaaccaggctaaaccacatagacgtgaaggaaggggctagaaggaagggagtgccccactgttgatggggtaagaggatcctgtactgagaagttgaccagagagggtctcaccatgcgcacagttccttctgtacctgtgtggaggaaaagtactgagtgaagggcagaaaaagagaaaacagaaatgctctgcccttggagaactgctaacctagggctactgttgattttgactatcttcttagtggccgaagcggagggtgctgctcaaccaaacaactcattaatgctgcaaactagcaaggagaatcatgctttagcttcaagcagtttatgtatggatgaaaaacagattacacagaactactcgaaagtactcgcagaagttaacacttcatggcctgtaaagatggctacaaatgctgtgctttgttgccctcctatcgcattaagaaatttgatcataataacatgggaaataatcctgagaggccagccttcctgcacaaaagcctacaagaaagaaacaaatgagaccaaggaaaccaactgtactgatgagagaataacctgggtctccagacctgatcagaattcggaccttcagattcgtaccgtggccatcactcatgacgggtattacagatgcataatggtaacacctgatgggaatttccatcgtggatatcacctccaagtgttagttacacctgaagtgaccctgtttcaaaacaggaatagaactgcagtatgcaaggcagttgcagggaagccagctgcgcatatctcctggatcccagagggcgattgtgccactaagcaagaatactggagcaatggcacagtgactgttaagagtacatgccactgggaggtccacaatgtgtctaccgtgacctgccacgtctcccatttgactggcaacaagagtctgtacatagagctacttcctgttccaggtgccaaaaaatcagcaaaattatatattccatatatcatccttactattattattttgaccatcgtgggattcatttggttgttgaaagtcaatggctgcagaaaatataaattgaataaaacagaatctactccagttgttgaggaggatgaaatgcagccctatgccagctacacagagaagaacaatcctctctatgatactacaaacaaggtgaaggcatctgaggcattacaaagtgaagttgacacagacctccatactttataagttgttggactctagtaccaagaaacaacaacaaacgagatacattataattactgtctgattttcttacagttctagaatgaagacttatattgaaattaggttttccaaggttcttagaagacattttaatggattctcattcatacccttgtataattggaatttttgattcttagctgctaccagctagttctctgaagaactgatgttattacaaagaaaatacatgcccatgaccaaatattcaaattgtgcaggacagtaaataatgaaaaccaaatttcctcaagaaataactgaagaaggagcaagtgtgaacagtttcttgtgtatcctttcagaatattttaatgtacatatgacatgtgtatatgcctatggtatatgtgtcaatttatgtgtccccttacatatacatgcacatatctttgtcaaggcaccagtgggaacaatacactgcattactgttctatacatatgaaaacctaataatataagtcttagagatcattttatatcatgacaagtagagctacctcattctttttaatggttatataaaattccattgtatagttatatcattatttaattaaaaacaaccctaatgatggatatttagattcttttaagttttgtttatttcttttaagttttgtttgtggtataaacaataccacatagaatgtttcttgtgcatatatctctttgtttttgagtatatctgtaggataactttcttgagtggaattgtcaggtcaaagggtttgtgcattttactattgatatatatgttaaattgtgtcaaatatatatgtcaaattccctccaacattgtttaaatgtgcctttccctaaatttctattttaataactgtactattcctgcttctacagttgccactttctctttttaatcaaccagattaaatatgatgtgagattataataagaattatactatttaataaaaatggatttata

SEQ ID NO: 5037 - DNA, 847 bp, Homo sapiens
tgtacctgtgtggaggaaaagtactgagtgaagggcagaaaaagagaaaacagaaatgctctgcccttggagaactgctaacctagggctactgttgattttgactatcttcttagtggccgaagcggagggtgctgctcaaccaaacaactcattaatgctgcaaactagcaaggagaatcatgctttagcttcaagcagtttatgtatggatgaaaaacagattacacagaactactcgaaagtactcgcagaagttaacacttcatggcctgtaaagatggctacaaatgctgtgctttgttgccctcctatcgcattaagaaatttgatcataataacatgggaaataatcctgagaggccagccttcctgcacaaaagcctacaagaaagaaacaaatgagaccaaggaaaccaactgtactgatgagagaataacctgggtctccagacctgatcagaattcggaccttcagattcgtaccgtggccatcactcatgacgggtattacagatgcataatggtaacacctgatgggaatttccatcgtggatatcacctccaagtgttaggtaaggagcatcatatattgaggtatttcacatcaccagatttgtgacggaaacaaatgtctctctgaattccatatgctttatgtgaaaaccgaagcatttttttccctctttcctctctgcagttacacctgaagtgaccctgtttcaaaacaggaatagaactgcagtatgcaaggcagttgcagggaagccagctgcgcatatctcctggatcccagagggcgattgtgccactaagcaagaatactggagcaatggcacagtgactg

SEQ ID NO: 5038 - DNA, 3679 bp, Homo sapiens
attgctgtgtcaagttccagagaaaagcttctgttcgtccaagttactaaccaggctaaaccacatagacgtgaaggaaggggctagaaggaagggagtgccccactgttgatggggtaagaggatcctgtactgagaagttgaccagagagggtctcaccatgcgcacagttccttctgtacctgtgtggaggaaaagtactgagtgaagggcagaaaaagagaaaacagaaatgctctgcccttggagaactgctaacctagggctactgttgattttgactatcttcttagtggccgcttcaagcagtttatgtatggatgaaaaacagattacacagaactactcgaaagtactcgcagaagttaacacttcatggcctgtaaagatggctacaaatgctgtgctttgttgccctcctatcgcattaagaaatttgatcataataacatgggaaataatcctgagaggccagccttcctgcacaaaagcctacaagaaagaaacaaatgagaccaaggaaaccaactgtactgatgagagaataacctgggtctccagacctgatcagaattcggaccttcagattcgtaccgtggccatcactcatgacgggtattacagatgcataatggtaacacctgatgggaatttccatcgtggatatcacctccaagtgttagttacacctgaagtgaccctgtttcaaaacaggaatagaactgcagtatgcaaggcagttgcagggaagccagctgcgcatatctcctggatcccagagggcgattgtgccactaagcaagaatactggagcaatggcacagtgactgttaagagtacatgccactgggaggtccacaatgtgtctaccgtgacctgccacgtctcccatttgactggcaacaagagtctgtacatagagctacttcctgttccaggtgccaaaaaatcagcaaaattatatattccatatatcatccttactattattattttgaccatcgtgggattcatttggttgttgaaagtcaatggctgcagaaaatataaattgaataaaacagaatctactccagttgttgaggaggatgaaatgcagccctatgccagctacacagagaagaacaatcctctctatgatactacaaacaaggtgaaggcatctgaggcattacaaagtgaagttgacacagacctccatactttataagttgttggactctagtaccaagaaacaacaacaaacgagatacattataattactgtctgattttcttacagttctagaatgaagacttatattgaaattaggttttccaaggttcttagaagacattttaatggattctcattcatacccttgtataattggaatttttgattcttagctgctaccagctagttctctgaagaactgatgttattacaaagaaaatacatgcccatgaccaaatattcaaattgtgcaggacagtaaataatgaaaaccaaatttcctcaagaaataactgaagaaggagcaagtgtgaacagtttcttgtgtatcctttcagaatattttaatgtacatatgacatgtgtatatgcctatggtatatgtgtcaatttatgtgtccccttacatatacatgcacatatctttgtcaaggcaccagtgggaacaatacactgcattactgttctatacatatgaaaacctaataatataagtcttagagatcattttatatcatgacaagtagagctacctcattctttttaatggttatataaaattccattgtatagttatatcattatttaattaaaaacaaccctaatgatggatatttagattcttttaagttttgtttatttcttttaagttttgtttgtggtataaacaataccacatagaatgtttcttgtgcatatatctctttgtttttgagtatatctgtaggataactttcttgagtggaattgtcaggtcaaagggtttgtgcattttactattgatatatatgttaaattgtgtcaaatatatatgtcaaattccctccaacattgtttaaatgtgcctttccctaaatttctattttaataactgtactattcctgcttctacagttgccactttctctttttaatcaaccagattaaatatgatgtgagattataataagaattatactatttaataaaaatggatttatatttttggtcatgtttgtaagagagtgaatgcacgtgtgagaacattagcttcttctgaactcattatatctccacagaggtgttgatacttgatgcctaacagttttgcagatgtgctacattggaattgtgtatttttatggtgtacattctattgtgatatatttattgaataattaatgtctattgaccatataagtggcgaaaaatgcaccatagaggacatggggtatttatttacaaactatgagctacataataagcaagtggccatgggatggcatgaccctcccctccatatttttgtggagcaaaatattggcaatgtttatgtaaatcattgttaatatcatgaaattatttttaattaaaaacataagtctatttgctccatagcagaaaaaacatgagaagttttttcatcatgatagaaattgaaacaaaatatattcattcttcaatcataccatctgagatttttaagacagctattttgtcttataagtatatttttctccctctagacatttcagttactatggattttgtcctcaaagggacttttagtctattttggatgtaaagctaatctaatgacacttggcacatgatattttgatcaagccattttgacttgaccaaaaagcagtgtccattaggtttctgcatataaatattaccaagcaatgttcacaatagacatcattacactgtccttgaaatttattaattcttcatccaaccctggttgagctgaggctcatagttaggttcaagactatctgtttaaatattactgaaaaacaaagtaagacagtactatgcttacctcttaacttgataatgtcaaaacaggcatgttaaatgacatcatagaaaagacttcaagataatttatagaagttaaattatattgtacagaaaataattgtatgaaaatctctactatggggctggaacatggttgaacattagaatgatataaaaaattatatatattctccaaatccacgctagacctgtcaaattagagaatctagagattagacctggcgtgtcagcaaggtcatccaggaagcagaggctgagacggagttaggtgtgattacttacatagtcgattacattttacaaataacattttatatgtctcatttactgtgctttctccccatcccattttgtatcttttcctttgctttgctagatttgtcaattttctctctctttctctgtctctctctctttcaatatctctaataatttgaaagtaattcatcataactaaatatctattggggttatgcttcacttacaaacttctgaaaacggctttactgagatataattgatatatttaagtgtacagtttgttaaattttgcacatatttaaaatgtggactttggtaaatgttgacatagttttacatctgtgaaaccatcagcataatcaagataataaacttgtccatcacccccc

SEQ ID NO: 5039 - DNA, 778 bp, Homo sapiens
tgtacctgtgtggaggaaaagtactgagtgaagggcagaaaaagagaaaacagaaatgctctgcccttggagaactgctaacctagggctactgttgattttgactatcttcttagtggccgcttcaagcagtttatgtatggatgaaaaacagattacacagaactactcgaaagtactcgcagaagttaacacttcatggcctgtaaagatggctacaaatgctgtgctttgttgccctcctatcgcattaagaaatttgatcataataacatgggaaataatcctgagaggccagccttcctgcacaaaagcctacaagaaagaaacaaatgagaccaaggaaaccaactgtactgatgagagaataacctgggtctccagacctgatcagaattcggaccttcagattcgtaccgtggccatcactcatgacgggtattacagatgcataatggtaacacctgatgggaatttccatcgtggatatcacctccaagtgttaggtaaggagcatcatatattgaggtatttcacatcaccagatttgtgacggaaacaaatgtctctctgaattccatatgctttatgtgaaaaccgaagcatttttttccctctttcctctctgcagttacacctgaagtgaccctgtttcaaaacaggaatagaactgcagtatgcaaggcagttgcagggaagccagctgcgcatatctcctggatcccagagggcgattgtgccactaagcaagaatactggagcaatggcacagtgactg

SEQ ID NO: 5040 - DNA, 1867 bp, Homo sapiens
gcagccagaagcacctgtgctcccaggataagggtgagcactcaggatgactgtggagaaggaggcccctgatgcgcacttcactgtggacaaacagaacatctccctctggccccgagagcctcctcccaagtccggtccatctctggtcccggggaaaacacccacagtccgtgctgcattaatctgcctgacgctggtcctggtcgcctccgtcctgctgcaggccgtcctttatccccggtttatgggcaccatatcagatgtaaagaccaatgtccagttgctgaaaggtcgtgtggacaacatcagcaccctggattctgaaattaaaaagaatagtgacggcatggaggcagctggcgttcagatccagatggtgaatgagagcctgggttatgtgcgttctcagttcctgaagttaaaaaccagtgtggagaaggccaacgcacagatccagatcttaacaagaagttgggaagaagtcagtaccttaaatgcccaaatcccagagttaaaaagtgatttggagaaagccagtgctttaaatacaaagatccgggcactccagggcagcttggagaatatgagcaagttgctcaaacgacaaaatgatattctacaggtggtttctcaaggctggaagtacttcaaggggaacttctattacttttctctcattccaaagacctggtatagtgccgagcagttctgtgtgtccaggaattcacacctgacctcggtgacctcagagagtgagcaggagtttctgtataaaacagcggggggactcatctactggattggcctgactaaagcagggatggaaggggactggtcctgggtggatgacacgccattcaacaaggtccaaagtgtgaggttctggattccaggtgagcccaacaatgctgggaacaatgaacactgtggcaatataaaggctccctcacttcaggcctggaatgatgccccatgtgacaaaacgtttcttttcatttgtaagcgaccctatgtcccatcagaaccgtgacaggacaggctcccaagctcactctttgagctccaacgcttgttaaacatgaggaaatgcctctttcttccccagactccaggatgactttgcacgttaatttttcttgcttcaaaattgtcccacagtggcattctggagtccgtctgtcttggctggaaattctctgacgtcttggaggcagctggaatggaaaggagaattcaggttaaagtgggaggggtgggtagagaggatttagaagttccaattgccctgctaaggaggatcaagacccgtaatccggcataacaccctggggttttccactctttcagagaaacctcagcttcatcacatcaaagttactccagagcaaccaagcaattctcctgatattgtcatccagggcttttcttggccaaaccccctagaatttccatgtctctgcttagctgtgctggcagctagcagctggctgtgtttgcagtgcaaatagctctgttcttggaaatcctgctcatggtatgtccccagtggtttcttcatccacatcatctaaagcctgaacccgttcttctctggttcaagtcagtggctgacacggacttgtatctccttcagagctcggctggcacccagcctcccttctccttccactcccttagtacactggagtgccgagccctgccttccacccagcgtccatccagcccctgtcctcacctctccggcacctcctcctccttctgcatttcctatcttcctgtgtcttgtgcatgggaagcagccttcagtgccttcatgaattcaccttccagcttcctcagaataaaatgctgcctgggtcaagga

SEQ ID NO: 5041 - DNA, 4196 bp, Homo sapiens
atcacagggtgggaaataaaagctgtggcccccaggagttctggacactgggggagagtggggtgacatgagtgactccaaggaaccaagactgcagcagctgggcctcctggtgtccaaggtccccagctccataagtcaggaacaatccaggcaagacgcgatctaccagaacctgacccagcttaaagctgcagtgggtgagctctcagagaaatccaagctgcaggagatctaccaggagctgacccagctgaaggctgcagtgggtgagcttccagagaaatctaagctgcaggagatctaccaggagctgacccggctgaaggctgcagtgggtgagcttccagagaaatctaagctgcaggagatctaccaggagctgacctggctgaaggctgcagtgggtgagcttccagagaaatctaagatgcaggagatctaccaggagctgactcggctgaaggctgcagtgggtgagcttccagagaaatctaagcagcaggagatctaccaggagctgacccggctgaaggctgcagtgggtgagcttccagagaaatctaagcagcaggagatctaccaggagctgacccggctgaaggctgcagtgggtgagcttccagagaaatctaagcagcaggagatctaccaggagctgacccagctgaaggctgcagtggaacgcctgtgccacccctgtccctgggaatggacattcttccaaggaaactgttacttcatgtctaactcccagcggaactggcacgactccatcaccgcctgcaaagaagtgggggcccagctcgtcgtaatcaaaagtgctgaggagcagaacttcctacagctgcagtcttccagaagtaaccgcttcacctggatgggactttcagatctaaatcaggaaggcacgtggcaatgggtggacggctcacctctgttgcccagcttcaagcagtattggaacagaggagagcccaacaacgttggggaggaagactgcgcggaatttagtggcaatggctggaacgacgacaaatgtaatcttgccaaattctggatctgcaaaaagtccgcagcctcctgctccagggatgaagaacagtttctttctccagcccctgccaccccaaacccccctcctgcgtagcagaacttcacccccttttaagctacagttccttctctccatccttcgaccttcacaaaatctctgggactgttctttgtcagattcttcctcctttagaaggctgggtcccattctgtccttcttgtcatgcctccaatttcccctggtgtagagcttgtttttctggcccatccttggagctttatgagtgagctggtgtgggatgcctttgggggtggacttgtgttccaagaatccactctctcttccttttggagattaggatatttgggttgccatgtgtagctgctatgtcccctggggcgttatcttatacatgcaaacctaccatctgttcaacttccacctaccacctcctgcacccctttgatcggggacttactggttgcaagagctcattttgcaggctggaagcaccagggaattaattcccccagtcaaccaatggcacccagagagggcatggaggctccacgcaaccccttccacccccacatcttcctttgtcttatacatggcttccatttggctgtttctaagttgtattctttattttattattattattactatttttcgagatggagtttcactcttgtcgctcaggctggagtgccatggcgcgatcttggctcactgcaacctctgcctcccgggttcaagtgattctcctgcctcagcctcacgagtagctggaattacaggcaggcgccaccagacccggctaattttttgtatttttagtacagatggggtttctccgtgttggtcaggctggtcttgaactcccgacctcagatgatctgcccgcctcggcctcccaaaattgctgggattacaggtgtgagccaccgcgcctggcctattattttttgtaagaataaaacaggtttattgggatttgggactctgaacagttctgtctctactacctgatctcctcctaccacgactttgggatctagaggagctttggctccggctgtgacggctccggccgttctcactgcggctgcaccggcccccgctgcggtcactatttcttcctctgctaggtgaattgtgcctctcctggctctttgacatgtgctagtgagatttcttccttttcctttcggattccccatttcttttgtaggaatggtctggactagggttctccttccccgcagcctgtagtattcatcgtggtggcccaccctctctctccccttggagctcttgccaaaggaggagacaagcagaggtctctattggatttctcaacacctgaagaaagttgcagtgttttcctcttggacattgttgtatttcaaataaaccacaaatcatcattttccaccgagccactgggcagaattcacactgaagctgtcgtcctgcgtacataccatcgtccgttaaacagagaaagagctgcttggcattcttcttccgactggtactgaacatatatacttgcccctcaggtgaggttccaagttgcaactgaccttgaactgaatcactctccccacgttattttttaattactatttttttttaaagatggggtcttgctctgtcgccaggctggagtgcagtggcgcgatctaggctcactgcaacttccgcctcccgggttcaagcgattctcctgcctcagcctcccgagtagctgggactccactaaaagtacaaaaattagctgggcgtgcaccactgcgcccagctaattcttgtatttttggtagagacggggtttcaacatgttgaccaggatggtctcgatctcttgacctcgtgattcgcccgccgcgtcctcccaaagtgctgggattacaggcctgagccaccgcgcccagtctctccccacgttcttgaactcgggcagcacatcctcacagaaatctaggaactgttggtaggtttcttcctcgctgtactccaggcttgcttcggagtcatagtcatccctcctgcactgctcctttccaaacactgtaaacatgcttttaataagaagggtaggactggatgttgggaaatcatgtgaacatctatctccaaatctgcaagctcctgttttactgtagaagggacaattaactccatccttctccatgactctgaaatccaagggggggttccgggttttgccatgtggcgccattttccaactcattttcagcctgatccagcatcttctggacagcttccggtttttgtttcttctgtcgtttctgttcctcctcctctctctctttcctctgctgttcttcccattgttcctttaactttcgctcttgttcttgccgttttctagccacctcttccttttccttctttattctgaattcttcttgtgccttctgctctctcagcaaccactcctcatgtaatctttgcctctctcttccccatagcttttctagttgttgtttttcaataaaagtgtcctcctctttctgtgagagtcctgagtccctcagtggagcaagttcctgctggcgtttctttcgtttctccttcttcagggcggccctgtactttttgtggcttggtttctctggaaatgtcaccttttcgggcgcagccatcttgccggcaccgccccgcccctctagttgtatcctttataataaactggtaaacattgtaaccgcagattcagcccaatctggttcaactttgtgtaataaaatggcgagttgtttttcagttgtcgtggacccccaggttgcaagttacataccctgggcatgtccagatgaacgaagcgtgcaaatccacgtggaacctaagtgctcagaccgaggaacagggactgagttaagaagtggacaccacgtggcatgatccttgatccaatcagattgagccctggcgtgatccagtcagatcaagcctcctgaatcccctcattacaagatccaatcatatcatgcctcactaccctctgtatataaaatctgccccagcctccaacttggagagacagatttgggccagactcctgtgtccttgcttggctgccttgcaataaatttttctctctacaaaa

SEQ ID NO: 5042 - DNA, 3920 bp, Homo sapiens
atcacagggtgggaaataaaagctgtggcccccaggagttctggacactgggggagagtggggtgacatgagtgactccaaggaaccaagactgcagcagctgggcctcctggtgtccaaggtccccagctccataagtcaggaacaatccaggcaagacgcgatctaccagaacctgacccagcttaaagctgcagtgggtgagctctcagagaaatccaagctgcaggagatctaccaggagctgacccagctgaaggctgcagtgggtgagcttccagagaaatctaagctgcaggagatctaccaggagctgacccggctgaaggctgcagtgggtgagcttccagagaaatctaagcagcaggagatctaccaggagctgacccagctgaaggctgcagtggaacgcctgtgccacccctgtccctgggaatggacattcttccaaggaaactgttacttcatgtctaactcccagcggaactggcacgactccatcaccgcctgcaaagaagtgggggcccagctcgtcgtaatcaaaagtgctgaggagcagaacttcctacagctgcagtcttccagaagtaaccgcttcacctggatgggactttcagatctaaatcaggaaggcacgtggcaatgggtggacggctcacctctgttgcccagcttcaagcagtattggaacagaggagagcccaacaacgttggggaggaagactgcgcggaatttagtggcaatggctggaacgacgacaaatgtaatcttgccaaattctggatctgcaaaaagtccgcagcctcctgctccagggatgaagaacagtttctttctccagcccctgccaccccaaacccccctcctgcgtagcagaacttcacccccttttaagctacagttccttctctccatccttcgaccttcacaaaatctctgggactgttctttgtcagattcttcctcctttagaaggctgggtcccattctgtccttcttgtcatgcctccaatttcccctggtgtagagcttgtttttctggcccatccttggagctttatgagtgagctggtgtgggatgcctttgggggtggacttgtgttccaagaatccactctctcttccttttggagattaggatatttgggttgccatgtgtagctgctatgtcccctggggcgttatcttatacatgcaaacctaccatctgttcaacttccacctaccacctcctgcacccctttgatcggggacttactggttgcaagagctcattttgcaggctggaagcaccagggaattaattcccccagtcaaccaatggcacccagagagggcatggaggctccacgcaaccccttccacccccacatcttcctttgtcttatacatggcttccatttggctgtttctaagttgtattctttattttattattattattactatttttcgagatggagtttcactcttgtcgctcaggctggagtgccatggcgcgatcttggctcactgcaacctctgcctcccgggttcaagtgattctcctgcctcagcctcacgagtagctggaattacaggcaggcgccaccagacccggctaattttttgtatttttagtacagatggggtttctccgtgttggtcaggctggtcttgaactcccgacctcagatgatctgcccgcctcggcctcccaaaattgctgggattacaggtgtgagccaccgcgcctggcctattattttttgtaagaataaaacaggtttattgggatttgggactctgaacagttctgtctctactacctgatctcctcctaccacgactttgggatctagaggagctttggctccggctgtgacggctccggccgttctcactgcggctgcaccggcccccgctgcggtcactatttcttcctctgctaggtgaattgtgcctctcctggctctttgacatgtgctagtgagatttcttccttttcctttcggattccccatttcttttgtaggaatggtctggactagggttctccttccccgcagcctgtagtattcatcgtggtggcccaccctctctctccccttggagctcttgccaaaggaggagacaagcagaggtctctattggatttctcaacacctgaagaaagttgcagtgttttcctcttggacattgttgtatttcaaataaaccacaaatcatcattttccaccgagccactgggcagaattcacactgaagctgtcgtcctgcgtacataccatcgtccgttaaacagagaaagagctgcttggcattcttcttccgactggtactgaacatatatacttgcccctcaggtgaggttccaagttgcaactgaccttgaactgaatcactctccccacgttattttttaattactatttttttttaaagatggggtcttgctctgtcgccaggctggagtgcagtggcgcgatctaggctcactgcaacttccgcctcccgggttcaagcgattctcctgcctcagcctcccgagtagctgggactccactaaaagtacaaaaattagctgggcgtgcaccactgcgcccagctaattcttgtatttttggtagagacggggtttcaacatgttgaccaggatggtctcgatctcttgacctcgtgattcgcccgccgcgtcctcccaaagtgctgggattacaggcctgagccaccgcgcccagtctctccccacgttcttgaactcgggcagcacatcctcacagaaatctaggaactgttggtaggtttcttcctcgctgtactccaggcttgcttcggagtcatagtcatccctcctgcactgctcctttccaaacactgtaaacatgcttttaataagaagggtaggactggatgttgggaaatcatgtgaacatctatctccaaatctgcaagctcctgttttactgtagaagggacaattaactccatccttctccatgactctgaaatccaagggggggttccgggttttgccatgtggcgccattttccaactcattttcagcctgatccagcatcttctggacagcttccggtttttgtttcttctgtcgtttctgttcctcctcctctctctctttcctctgctgttcttcccattgttcctttaactttcgctcttgttcttgccgttttctagccacctcttccttttccttctttattctgaattcttcttgtgccttctgctctctcagcaaccactcctcatgtaatctttgcctctctcttccccatagcttttctagttgttgtttttcaataaaagtgtcctcctctttctgtgagagtcctgagtccctcagtggagcaagttcctgctggcgtttctttcgtttctccttcttcagggcggccctgtactttttgtggcttggtttctctggaaatgtcaccttttcgggcgcagccatcttgccggcaccgccccgcccctctagttgtatcctttataataaactggtaaacattgtaaccgcagattcagcccaatctggttcaactttgtgtaataaaatggcgagttgtttttcagttgtcgtggacccccaggttgcaagttacataccctgggcatgtccagatgaacgaagcgtgcaaatccacgtggaacctaagtgctcagaccgaggaacagggactgagttaagaagtggacaccacgtggcatgatccttgatccaatcagattgagccctggcgtgatccagtcagatcaagcctcctgaatcccctcattacaagatccaatcatatcatgcctcactaccctctgtatataaaatctgccccagcctccaacttggagagacagatttgggccagactcctgtgtccttgcttggctgccttgcaataaatttttctctctacaaaa

SEQ ID NO: 5043 - DNA, 4256 bp, Homo sapiens
atcacagggtgggaaataaaagctgtggcccccaggagttctggacactgggggagagtggggtgacatgagtgactccaaggaaccaagactgcagcagctgggcctcctggaggaggaacagctgagaggccttggattccgacagactcgaggatacaagagcttagcagtgtccaaggtccccagctccataagtcaggaacaatccaggcaagacgcgatctaccagaacctgacccagcttaaagctgcagtgggtgagctctcagagaaatccaagctgcaggagatctaccaggagctgacccagctgaaggctgcagtgggtgagcttccagagaaatctaagctgcaggagatctaccaggagctgacccggctgaaggctgcagtgggtgagcttccagagaaatctaagctgcaggagatctaccaggagctgacctggctgaaggctgcagtgggtgagcttccagagaaatctaagatgcaggagatctaccaggagctgactcggctgaaggctgcagtgggtgagcttccagagaaatctaagcagcaggagatctaccaggagctgacccggctgaaggctgcagtgggtgagcttccagagaaatctaagcagcaggagatctaccaggagctgacccggctgaaggctgcagtgggtgagcttccagagaaatctaagcagcaggagatctaccaggagctgacccagctgaaggctgcagtggaacgcctgtgccacccctgtccctgggaatggacattcttccaaggaaactgttacttcatgtctaactcccagcggaactggcacgactccatcaccgcctgcaaagaagtgggggcccagctcgtcgtaatcaaaagtgctgaggagcagaacttcctacagctgcagtcttccagaagtaaccgcttcacctggatgggactttcagatctaaatcaggaaggcacgtggcaatgggtggacggctcacctctgttgcccagcttcaagcagtattggaacagaggagagcccaacaacgttggggaggaagactgcgcggaatttagtggcaatggctggaacgacgacaaatgtaatcttgccaaattctggatctgcaaaaagtccgcagcctcctgctccagggatgaagaacagtttctttctccagcccctgccaccccaaacccccctcctgcgtagcagaacttcacccccttttaagctacagttccttctctccatccttcgaccttcacaaaatctctgggactgttctttgtcagattcttcctcctttagaaggctgggtcccattctgtccttcttgtcatgcctccaatttcccctggtgtagagcttgtttttctggcccatccttggagctttatgagtgagctggtgtgggatgcctttgggggtggacttgtgttccaagaatccactctctcttccttttggagattaggatatttgggttgccatgtgtagctgctatgtcccctggggcgttatcttatacatgcaaacctaccatctgttcaacttccacctaccacctcctgcacccctttgatcggggacttactggttgcaagagctcattttgcaggctggaagcaccagggaattaattcccccagtcaaccaatggcacccagagagggcatggaggctccacgcaaccccttccacccccacatcttcctttgtcttatacatggcttccatttggctgtttctaagttgtattctttattttattattattattactatttttcgagatggagtttcactcttgtcgctcaggctggagtgccatggcgcgatcttggctcactgcaacctctgcctcccgggttcaagtgattctcctgcctcagcctcacgagtagctggaattacaggcaggcgccaccagacccggctaattttttgtatttttagtacagatggggtttctccgtgttggtcaggctggtcttgaactcccgacctcagatgatctgcccgcctcggcctcccaaaattgctgggattacaggtgtgagccaccgcgcctggcctattattttttgtaagaataaaacaggtttattgggatttgggactctgaacagttctgtctctactacctgatctcctcctaccacgactttgggatctagaggagctttggctccggctgtgacggctccggccgttctcactgcggctgcaccggcccccgctgcggtcactatttcttcctctgctaggtgaattgtgcctctcctggctctttgacatgtgctagtgagatttcttccttttcctttcggattccccatttcttttgtaggaatggtctggactagggttctccttccccgcagcctgtagtattcatcgtggtggcccaccctctctctccccttggagctcttgccaaaggaggagacaagcagaggtctctattggatttctcaacacctgaagaaagttgcagtgttttcctcttggacattgttgtatttcaaataaaccacaaatcatcattttccaccgagccactgggcagaattcacactgaagctgtcgtcctgcgtacataccatcgtccgttaaacagagaaagagctgcttggcattcttcttccgactggtactgaacatatatacttgcccctcaggtgaggttccaagttgcaactgaccttgaactgaatcactctccccacgttattttttaattactatttttttttaaagatggggtcttgctctgtcgccaggctggagtgcagtggcgcgatctaggctcactgcaacttccgcctcccgggttcaagcgattctcctgcctcagcctcccgagtagctgggactccactaaaagtacaaaaattagctgggcgtgcaccactgcgcccagctaattcttgtatttttggtagagacggggtttcaacatgttgaccaggatggtctcgatctcttgacctcgtgattcgcccgccgcgtcctcccaaagtgctgggattacaggcctgagccaccgcgcccagtctctccccacgttcttgaactcgggcagcacatcctcacagaaatctaggaactgttggtaggtttcttcctcgctgtactccaggcttgcttcggagtcatagtcatccctcctgcactgctcctttccaaacactgtaaacatgcttttaataagaagggtaggactggatgttgggaaatcatgtgaacatctatctccaaatctgcaagctcctgttttactgtagaagggacaattaactccatccttctccatgactctgaaatccaagggggggttccgggttttgccatgtggcgccattttccaactcattttcagcctgatccagcatcttctggacagcttccggtttttgtttcttctgtcgtttctgttcctcctcctctctctctttcctctgctgttcttcccattgttcctttaactttcgctcttgttcttgccgttttctagccacctcttccttttccttctttattctgaattcttcttgtgccttctgctctctcagcaaccactcctcatgtaatctttgcctctctcttccccatagcttttctagttgttgtttttcaataaaagtgtcctcctctttctgtgagagtcctgagtccctcagtggagcaagttcctgctggcgtttctttcgtttctccttcttcagggcggccctgtactttttgtggcttggtttctctggaaatgtcaccttttcgggcgcagccatcttgccggcaccgccccgcccctctagttgtatcctttataataaactggtaaacattgtaaccgcagattcagcccaatctggttcaactttgtgtaataaaatggcgagttgtttttcagttgtcgtggacccccaggttgcaagttacataccctgggcatgtccagatgaacgaagcgtgcaaatccacgtggaacctaagtgctcagaccgaggaacagggactgagttaagaagtggacaccacgtggcatgatccttgatccaatcagattgagccctggcgtgatccagtcagatcaagcctcctgaatcccctcattacaagatccaatcatatcatgcctcactaccctctgtatataaaatctgccccagcctccaacttggagagacagatttgggccagactcctgtgtccttgcttggctgccttgcaataaatttttctctctacaaaa

SEQ ID NO: 5044 - DNA, 4328 bp, Homo sapiens
atcacagggtgggaaataaaagctgtggcccccaggagttctggacactgggggagagtggggtgacatgagtgactccaaggaaccaagactgcagcagctgggcctcctggaggaggaacagctgagaggccttggattccgacagactcgaggatacaagagcttagcagggtgtcttggccatggtcccctggtgctgcaactcctctccttcacgctcttggctgggctccttgtccaagtgtccaaggtccccagctccataagtcaggaacaatccaggcaagacgcgatctaccagaacctgacccagcttaaagctgcagtgggtgagctctcagagaaatccaagctgcaggagatctaccaggagctgacccagctgaaggctgcagtgggtgagcttccagagaaatctaagctgcaggagatctaccaggagctgacccggctgaaggctgcagtgggtgagcttccagagaaatctaagctgcaggagatctaccaggagctgacctggctgaaggctgcagtgggtgagcttccagagaaatctaagatgcaggagatctaccaggagctgactcggctgaaggctgcagtgggtgagcttccagagaaatctaagcagcaggagatctaccaggagctgacccggctgaaggctgcagtgggtgagcttccagagaaatctaagcagcaggagatctaccaggagctgacccggctgaaggctgcagtgggtgagcttccagagaaatctaagcagcaggagatctaccaggagctgacccagctgaaggctgcagtggaacgcctgtgccacccctgtccctgggaatggacattcttccaaggaaactgttacttcatgtctaactcccagcggaactggcacgactccatcaccgcctgcaaagaagtgggggcccagctcgtcgtaatcaaaagtgctgaggagcagaacttcctacagctgcagtcttccagaagtaaccgcttcacctggatgggactttcagatctaaatcaggaaggcacgtggcaatgggtggacggctcacctctgttgcccagcttcaagcagtattggaacagaggagagcccaacaacgttggggaggaagactgcgcggaatttagtggcaatggctggaacgacgacaaatgtaatcttgccaaattctggatctgcaaaaagtccgcagcctcctgctccagggatgaagaacagtttctttctccagcccctgccaccccaaacccccctcctgcgtagcagaacttcacccccttttaagctacagttccttctctccatccttcgaccttcacaaaatctctgggactgttctttgtcagattcttcctcctttagaaggctgggtcccattctgtccttcttgtcatgcctccaatttcccctggtgtagagcttgtttttctggcccatccttggagctttatgagtgagctggtgtgggatgcctttgggggtggacttgtgttccaagaatccactctctcttccttttggagattaggatatttgggttgccatgtgtagctgctatgtcccctggggcgttatcttatacatgcaaacctaccatctgttcaacttccacctaccacctcctgcacccctttgatcggggacttactggttgcaagagctcattttgcaggctggaagcaccagggaattaattcccccagtcaaccaatggcacccagagagggcatggaggctccacgcaaccccttccacccccacatcttcctttgtcttatacatggcttccatttggctgtttctaagttgtattctttattttattattattattactatttttcgagatggagtttcactcttgtcgctcaggctggagtgccatggcgcgatcttggctcactgcaacctctgcctcccgggttcaagtgattctcctgcctcagcctcacgagtagctggaattacaggcaggcgccaccagacccggctaattttttgtatttttagtacagatggggtttctccgtgttggtcaggctggtcttgaactcccgacctcagatgatctgcccgcctcggcctcccaaaattgctgggattacaggtgtgagccaccgcgcctggcctattattttttgtaagaataaaacaggtttattgggatttgggactctgaacagttctgtctctactacctgatctcctcctaccacgactttgggatctagaggagctttggctccggctgtgacggctccggccgttctcactgcggctgcaccggcccccgctgcggtcactatttcttcctctgctaggtgaattgtgcctctcctggctctttgacatgtgctagtgagatttcttccttttcctttcggattccccatttcttttgtaggaatggtctggactagggttctccttccccgcagcctgtagtattcatcgtggtggcccaccctctctctccccttggagctcttgccaaaggaggagacaagcagaggtctctattggatttctcaacacctgaagaaagttgcagtgttttcctcttggacattgttgtatttcaaataaaccacaaatcatcattttccaccgagccactgggcagaattcacactgaagctgtcgtcctgcgtacataccatcgtccgttaaacagagaaagagctgcttggcattcttcttccgactggtactgaacatatatacttgcccctcaggtgaggttccaagttgcaactgaccttgaactgaatcactctccccacgttattttttaattactatttttttttaaagatggggtcttgctctgtcgccaggctggagtgcagtggcgcgatctaggctcactgcaacttccgcctcccgggttcaagcgattctcctgcctcagcctcccgagtagctgggactccactaaaagtacaaaaattagctgggcgtgcaccactgcgcccagctaattcttgtatttttggtagagacggggtttcaacatgttgaccaggatggtctcgatctcttgacctcgtgattcgcccgccgcgtcctcccaaagtgctgggattacaggcctgagccaccgcgcccagtctctccccacgttcttgaactcgggcagcacatcctcacagaaatctaggaactgttggtaggtttcttcctcgctgtactccaggcttgcttcggagtcatagtcatccctcctgcactgctcctttccaaacactgtaaacatgcttttaataagaagggtaggactggatgttgggaaatcatgtgaacatctatctccaaatctgcaagctcctgttttactgtagaagggacaattaactccatccttctccatgactctgaaatccaagggggggttccgggttttgccatgtggcgccattttccaactcattttcagcctgatccagcatcttctggacagcttccggtttttgtttcttctgtcgtttctgttcctcctcctctctctctttcctctgctgttcttcccattgttcctttaactttcgctcttgttcttgccgttttctagccacctcttccttttccttctttattctgaattcttcttgtgccttctgctctctcagcaaccactcctcatgtaatctttgcctctctcttccccatagcttttctagttgttgtttttcaataaaagtgtcctcctctttctgtgagagtcctgagtccctcagtggagcaagttcctgctggcgtttctttcgtttctccttcttcagggcggccctgtactttttgtggcttggtttctctggaaatgtcaccttttcgggcgcagccatcttgccggcaccgccccgcccctctagttgtatcctttataataaactggtaaacattgtaaccgcagattcagcccaatctggttcaactttgtgtaataaaatggcgagttgtttttcagttgtcgtggacccccaggttgcaagttacataccctgggcatgtccagatgaacgaagcgtgcaaatccacgtggaacctaagtgctcagaccgaggaacagggactgagttaagaagtggacaccacgtggcatgatccttgatccaatcagattgagccctggcgtgatccagtcagatcaagcctcctgaatcccctcattacaagatccaatcatatcatgcctcactaccctctgtatataaaatctgccccagcctccaacttggagagacagatttgggccagactcctgtgtccttgcttggctgccttgcaataaatttttctctctacaaaa

SEQ ID NO: 5045 - DNA, 4310 bp, Homo sapiens
atcacagggtgggaaataaaagctgtggcccccaggagttctggacactgggggagagtggggtgacatgagtgactccaaggaaccaagactgcagcagctgggcctcctggaggaggaacagctgagaggccttggattccgacagactcgaggatacaagagcttagcagggtgtcttggccatggtcccctggtgctgcaactcctctccttcacgctcttggctgggctccttgtccaagtgtccaaggtccccagctccataagtcaggaacaatccaggcaagacgcgatctaccagaacctgacccagcttaaagctgcagtgggtgagctctcagagaaatccaagctgcaggagatctaccaggagctgacccagctgaaggctgcagtgggtgagcttccagagaaatctaagctgcaggagatctaccaggagctgacccggctgaaggctgcagtgggtgagcttccagagaaatctaagctgcaggagatctaccaggagctgacctggctgaaggctgcagtgggtgagcttccagagaaatctaagatgcaggagatctaccaggagctgactcggctgaaggctgcagtgggtgagcttccagagaaatctaagcagcaggagatctaccaggagctgacccggctgaaggctgcagtgggtgagcttccagagaaatctaagcagcaggagatctaccaggagctgacccggctgaaggctgcagtgggtgagcttccagagaaatctaagcagcaggagatctaccaggagctgacccagctgaaggctgcagtggaacgcctgtgccacccctgtccctgggaatggacattcttccaaggaaactgttacttcatgtctaactcccagcggaactggcacgactccatcaccgcctgcaaagaagtgggggcccagctcgtcgtaatcaaaagtgctgaggagcagtcttccagaagtaaccgcttcacctggatgggactttcagatctaaatcaggaaggcacgtggcaatgggtggacggctcacctctgttgcccagcttcaagcagtattggaacagaggagagcccaacaacgttggggaggaagactgcgcggaatttagtggcaatggctggaacgacgacaaatgtaatcttgccaaattctggatctgcaaaaagtccgcagcctcctgctccagggatgaagaacagtttctttctccagcccctgccaccccaaacccccctcctgcgtagcagaacttcacccccttttaagctacagttccttctctccatccttcgaccttcacaaaatctctgggactgttctttgtcagattcttcctcctttagaaggctgggtcccattctgtccttcttgtcatgcctccaatttcccctggtgtagagcttgtttttctggcccatccttggagctttatgagtgagctggtgtgggatgcctttgggggtggacttgtgttccaagaatccactctctcttccttttggagattaggatatttgggttgccatgtgtagctgctatgtcccctggggcgttatcttatacatgcaaacctaccatctgttcaacttccacctaccacctcctgcacccctttgatcggggacttactggttgcaagagctcattttgcaggctggaagcaccagggaattaattcccccagtcaaccaatggcacccagagagggcatggaggctccacgcaaccccttccacccccacatcttcctttgtcttatacatggcttccatttggctgtttctaagttgtattctttattttattattattattactatttttcgagatggagtttcactcttgtcgctcaggctggagtgccatggcgcgatcttggctcactgcaacctctgcctcccgggttcaagtgattctcctgcctcagcctcacgagtagctggaattacaggcaggcgccaccagacccggctaattttttgtatttttagtacagatggggtttctccgtgttggtcaggctggtcttgaactcccgacctcagatgatctgcccgcctcggcctcccaaaattgctgggattacaggtgtgagccaccgcgcctggcctattattttttgtaagaataaaacaggtttattgggatttgggactctgaacagttctgtctctactacctgatctcctcctaccacgactttgggatctagaggagctttggctccggctgtgacggctccggccgttctcactgcggctgcaccggcccccgctgcggtcactatttcttcctctgctaggtgaattgtgcctctcctggctctttgacatgtgctagtgagatttcttccttttcctttcggattccccatttcttttgtaggaatggtctggactagggttctccttccccgcagcctgtagtattcatcgtggtggcccaccctctctctccccttggagctcttgccaaaggaggagacaagcagaggtctctattggatttctcaacacctgaagaaagttgcagtgttttcctcttggacattgttgtatttcaaataaaccacaaatcatcattttccaccgagccactgggcagaattcacactgaagctgtcgtcctgcgtacataccatcgtccgttaaacagagaaagagctgcttggcattcttcttccgactggtactgaacatatatacttgcccctcaggtgaggttccaagttgcaactgaccttgaactgaatcactctccccacgttattttttaattactatttttttttaaagatggggtcttgctctgtcgccaggctggagtgcagtggcgcgatctaggctcactgcaacttccgcctcccgggttcaagcgattctcctgcctcagcctcccgagtagctgggactccactaaaagtacaaaaattagctgggcgtgcaccactgcgcccagctaattcttgtatttttggtagagacggggtttcaacatgttgaccaggatggtctcgatctcttgacctcgtgattcgcccgccgcgtcctcccaaagtgctgggattacaggcctgagccaccgcgcccagtctctccccacgttcttgaactcgggcagcacatcctcacagaaatctaggaactgttggtaggtttcttcctcgctgtactccaggcttgcttcggagtcatagtcatccctcctgcactgctcctttccaaacactgtaaacatgcttttaataagaagggtaggactggatgttgggaaatcatgtgaacatctatctccaaatctgcaagctcctgttttactgtagaagggacaattaactccatccttctccatgactctgaaatccaagggggggttccgggttttgccatgtggcgccattttccaactcattttcagcctgatccagcatcttctggacagcttccggtttttgtttcttctgtcgtttctgttcctcctcctctctctctttcctctgctgttcttcccattgttcctttaactttcgctcttgttcttgccgttttctagccacctcttccttttccttctttattctgaattcttcttgtgccttctgctctctcagcaaccactcctcatgtaatctttgcctctctcttccccatagcttttctagttgttgtttttcaataaaagtgtcctcctctttctgtgagagtcctgagtccctcagtggagcaagttcctgctggcgtttctttcgtttctccttcttcagggcggccctgtactttttgtggcttggtttctctggaaatgtcaccttttcgggcgcagccatcttgccggcaccgccccgcccctctagttgtatcctttataataaactggtaaacattgtaaccgcagattcagcccaatctggttcaactttgtgtaataaaatggcgagttgtttttcagttgtcgtggacccccaggttgcaagttacataccctgggcatgtccagatgaacgaagcgtgcaaatccacgtggaacctaagtgctcagaccgaggaacagggactgagttaagaagtggacaccacgtggcatgatccttgatccaatcagattgagccctggcgtgatccagtcagatcaagcctcctgaatcccctcattacaagatccaatcatatcatgcctcactaccctctgtatataaaatctgccccagcctccaacttggagagacagatttgggccagactcctgtgtccttgcttggctgccttgcaataaatttttctctctacaaaa

SEQ ID NO: 5046 - DNA, 3620 bp, Homo sapiens
atcacagggtgggaaataaaagctgtggcccccaggagttctggacactgggggagagtggggtgacatgagtgactccaaggaaccaagactgcagcagctgggcctcctggaggaggaacagctgagaggccttggattccgacagactcgaggatacaagagcttagcagggtgtcttggccatggtcccctggtgctgcaactcctctccttcacgctcttggctgggctccttgtccaagtgtccaaggtccccagctccataagtcaggaacaatccagaagtaaccgcttcacctggatgggactttcagatctaaatcaggaaggcacgtggcaatgggtggacggctcacctctgttgcccagcttcaagcagtattggaacagaggagagcccaacaacgttggggaggaagactgcgcggaatttagtggcaatggctggaacgacgacaaatgtaatcttgccaaattctggatctgcaaaaagtccgcagcctcctgctccagggatgaagaacagtttctttctccagcccctgccaccccaaacccccctcctgcgtagcagaacttcacccccttttaagctacagttccttctctccatccttcgaccttcacaaaatctctgggactgttctttgtcagattcttcctcctttagaaggctgggtcccattctgtccttcttgtcatgcctccaatttcccctggtgtagagcttgtttttctggcccatccttggagctttatgagtgagctggtgtgggatgcctttgggggtggacttgtgttccaagaatccactctctcttccttttggagattaggatatttgggttgccatgtgtagctgctatgtcccctggggcgttatcttatacatgcaaacctaccatctgttcaacttccacctaccacctcctgcacccctttgatcggggacttactggttgcaagagctcattttgcaggctggaagcaccagggaattaattcccccagtcaaccaatggcacccagagagggcatggaggctccacgcaaccccttccacccccacatcttcctttgtcttatacatggcttccatttggctgtttctaagttgtattctttattttattattattattactatttttcgagatggagtttcactcttgtcgctcaggctggagtgccatggcgcgatcttggctcactgcaacctctgcctcccgggttcaagtgattctcctgcctcagcctcacgagtagctggaattacaggcaggcgccaccagacccggctaattttttgtatttttagtacagatggggtttctccgtgttggtcaggctggtcttgaactcccgacctcagatgatctgcccgcctcggcctcccaaaattgctgggattacaggtgtgagccaccgcgcctggcctattattttttgtaagaataaaacaggtttattgggatttgggactctgaacagttctgtctctactacctgatctcctcctaccacgactttgggatctagaggagctttggctccggctgtgacggctccggccgttctcactgcggctgcaccggcccccgctgcggtcactatttcttcctctgctaggtgaattgtgcctctcctggctctttgacatgtgctagtgagatttcttccttttcctttcggattccccatttcttttgtaggaatggtctggactagggttctccttccccgcagcctgtagtattcatcgtggtggcccaccctctctctccccttggagctcttgccaaaggaggagacaagcagaggtctctattggatttctcaacacctgaagaaagttgcagtgttttcctcttggacattgttgtatttcaaataaaccacaaatcatcattttccaccgagccactgggcagaattcacactgaagctgtcgtcctgcgtacataccatcgtccgttaaacagagaaagagctgcttggcattcttcttccgactggtactgaacatatatacttgcccctcaggtgaggttccaagttgcaactgaccttgaactgaatcactctccccacgttattttttaattactatttttttttaaagatggggtcttgctctgtcgccaggctggagtgcagtggcgcgatctaggctcactgcaacttccgcctcccgggttcaagcgattctcctgcctcagcctcccgagtagctgggactccactaaaagtacaaaaattagctgggcgtgcaccactgcgcccagctaattcttgtatttttggtagagacggggtttcaacatgttgaccaggatggtctcgatctcttgacctcgtgattcgcccgccgcgtcctcccaaagtgctgggattacaggcctgagccaccgcgcccagtctctccccacgttcttgaactcgggcagcacatcctcacagaaatctaggaactgttggtaggtttcttcctcgctgtactccaggcttgcttcggagtcatagtcatccctcctgcactgctcctttccaaacactgtaaacatgcttttaataagaagggtaggactggatgttgggaaatcatgtgaacatctatctccaaatctgcaagctcctgttttactgtagaagggacaattaactccatccttctccatgactctgaaatccaagggggggttccgggttttgccatgtggcgccattttccaactcattttcagcctgatccagcatcttctggacagcttccggtttttgtttcttctgtcgtttctgttcctcctcctctctctctttcctctgctgttcttcccattgttcctttaactttcgctcttgttcttgccgttttctagccacctcttccttttccttctttattctgaattcttcttgtgccttctgctctctcagcaaccactcctcatgtaatctttgcctctctcttccccatagcttttctagttgttgtttttcaataaaagtgtcctcctctttctgtgagagtcctgagtccctcagtggagcaagttcctgctggcgtttctttcgtttctccttcttcagggcggccctgtactttttgtggcttggtttctctggaaatgtcaccttttcgggcgcagccatcttgccggcaccgccccgcccctctagttgtatcctttataataaactggtaaacattgtaaccgcagattcagcccaatctggttcaactttgtgtaataaaatggcgagttgtttttcagttgtcgtggacccccaggttgcaagttacataccctgggcatgtccagatgaacgaagcgtgcaaatccacgtggaacctaagtgctcagaccgaggaacagggactgagttaagaagtggacaccacgtggcatgatccttgatccaatcagattgagccctggcgtgatccagtcagatcaagcctcctgaatcccctcattacaagatccaatcatatcatgcctcactaccctctgtatataaaatctgccccagcctccaacttggagagacagatttgggccagactcctgtgtccttgcttggctgccttgcaataaatttttctctctacaaaa

SEQ ID NO: 5047 - DNA, 4052 bp, Homo sapiens
atcacagggtgggaaataaaagctgtggcccccaggagttctggacactgggggagagtggggtgacatgagtgactccaaggaaccaagactgcagcagctgggcctcctggaggaggaacagctgagaggccttggattccgacagactcgaggatacaagagcttagcagggtgtcttggccatggtcccctggtgctgcaactcctctccttcacgctcttggctgggctccttgtccaagtgtccaaggtccccagctccataagtcaggaacaatccaggcaagacgcgatctaccagaacctgacccagcttaaagctgcagtgggtgagctctcagagaaatccaagctgcaggagatctaccaggagctgacccagctgaaggctgcagtgggtgagcttccagagaaatctaagctgcaggagatctaccaggagctgacccggctgaaggctgcagtgggtgagcttccagagaaatctaagctgcaggagatctaccaggagctgacctggctgaaggctgcagtggaacgcctgtgccacccctgtccctgggaatggacattcttccaaggaaactgttacttcatgtctaactcccagcggaactggcacgactccatcaccgcctgcaaagaagtgggggcccagctcgtcgtaatcaaaagtgctgaggagcagaacttcctacagctgcagtcttccagaagtaaccgcttcacctggatgggactttcagatctaaatcaggaaggcacgtggcaatgggtggacggctcacctctgttgcccagcttcaagcagtattggaacagaggagagcccaacaacgttggggaggaagactgcgcggaatttagtggcaatggctggaacgacgacaaatgtaatcttgccaaattctggatctgcaaaaagtccgcagcctcctgctccagggatgaagaacagtttctttctccagcccctgccaccccaaacccccctcctgcgtagcagaacttcacccccttttaagctacagttccttctctccatccttcgaccttcacaaaatctctgggactgttctttgtcagattcttcctcctttagaaggctgggtcccattctgtccttcttgtcatgcctccaatttcccctggtgtagagcttgtttttctggcccatccttggagctttatgagtgagctggtgtgggatgcctttgggggtggacttgtgttccaagaatccactctctcttccttttggagattaggatatttgggttgccatgtgtagctgctatgtcccctggggcgttatcttatacatgcaaacctaccatctgttcaacttccacctaccacctcctgcacccctttgatcggggacttactggttgcaagagctcattttgcaggctggaagcaccagggaattaattcccccagtcaaccaatggcacccagagagggcatggaggctccacgcaaccccttccacccccacatcttcctttgtcttatacatggcttccatttggctgtttctaagttgtattctttattttattattattattactatttttcgagatggagtttcactcttgtcgctcaggctggagtgccatggcgcgatcttggctcactgcaacctctgcctcccgggttcaagtgattctcctgcctcagcctcacgagtagctggaattacaggcaggcgccaccagacccggctaattttttgtatttttagtacagatggggtttctccgtgttggtcaggctggtcttgaactcccgacctcagatgatctgcccgcctcggcctcccaaaattgctgggattacaggtgtgagccaccgcgcctggcctattattttttgtaagaataaaacaggtttattgggatttgggactctgaacagttctgtctctactacctgatctcctcctaccacgactttgggatctagaggagctttggctccggctgtgacggctccggccgttctcactgcggctgcaccggcccccgctgcggtcactatttcttcctctgctaggtgaattgtgcctctcctggctctttgacatgtgctagtgagatttcttccttttcctttcggattccccatttcttttgtaggaatggtctggactagggttctccttccccgcagcctgtagtattcatcgtggtggcccaccctctctctccccttggagctcttgccaaaggaggagacaagcagaggtctctattggatttctcaacacctgaagaaagttgcagtgttttcctcttggacattgttgtatttcaaataaaccacaaatcatcattttccaccgagccactgggcagaattcacactgaagctgtcgtcctgcgtacataccatcgtccgttaaacagagaaagagctgcttggcattcttcttccgactggtactgaacatatatacttgcccctcaggtgaggttccaagttgcaactgaccttgaactgaatcactctccccacgttattttttaattactatttttttttaaagatggggtcttgctctgtcgccaggctggagtgcagtggcgcgatctaggctcactgcaacttccgcctcccgggttcaagcgattctcctgcctcagcctcccgagtagctgggactccactaaaagtacaaaaattagctgggcgtgcaccactgcgcccagctaattcttgtatttttggtagagacggggtttcaacatgttgaccaggatggtctcgatctcttgacctcgtgattcgcccgccgcgtcctcccaaagtgctgggattacaggcctgagccaccgcgcccagtctctccccacgttcttgaactcgggcagcacatcctcacagaaatctaggaactgttggtaggtttcttcctcgctgtactccaggcttgcttcggagtcatagtcatccctcctgcactgctcctttccaaacactgtaaacatgcttttaataagaagggtaggactggatgttgggaaatcatgtgaacatctatctccaaatctgcaagctcctgttttactgtagaagggacaattaactccatccttctccatgactctgaaatccaagggggggttccgggttttgccatgtggcgccattttccaactcattttcagcctgatccagcatcttctggacagcttccggtttttgtttcttctgtcgtttctgttcctcctcctctctctctttcctctgctgttcttcccattgttcctttaactttcgctcttgttcttgccgttttctagccacctcttccttttccttctttattctgaattcttcttgtgccttctgctctctcagcaaccactcctcatgtaatctttgcctctctcttccccatagcttttctagttgttgtttttcaataaaagtgtcctcctctttctgtgagagtcctgagtccctcagtggagcaagttcctgctggcgtttctttcgtttctccttcttcagggcggccctgtactttttgtggcttggtttctctggaaatgtcaccttttcgggcgcagccatcttgccggcaccgccccgcccctctagttgtatcctttataataaactggtaaacattgtaaccgcagattcagcccaatctggttcaactttgtgtaataaaatggcgagttgtttttcagttgtcgtggacccccaggttgcaagttacataccctgggcatgtccagatgaacgaagcgtgcaaatccacgtggaacctaagtgctcagaccgaggaacagggactgagttaagaagtggacaccacgtggcatgatccttgatccaatcagattgagccctggcgtgatccagtcagatcaagcctcctgaatcccctcattacaagatccaatcatatcatgcctcactaccctctgtatataaaatctgccccagcctccaacttggagagacagatttgggccagactcctgtgtccttgcttggctgccttgcaataaatttttctctctacaaaa

SEQ ID NO: 5048 - DNA, 105 bp, Homo sapiens
atgagtgactccaaggaaccaagactgcagcagctgggcctcctggaggaggaacagctgagaggccttggattccgacagactcgacgtaatcaaaagtgctga

SEQ ID NO: 5049 - DNA, 4280 bp, Homo sapiens
atcacagggtgggaaataaaagctgtggcccccaggagttctggacactgggggagagtggggtgacatgagtgactccaaggaaccaagactgcagcagctgggcctcctggggtgtcttggccatggtcccctggtgctgcaactcctctccttcacgctcttggctgggctccttgtccaagttcttggcccagtgtccaaggtccccagctccataagtcaggaacaatccaggcaagacgcgatctaccagaacctgacccagcttaaagctgcagtgggtgagctctcagagaaatccaagctgcaggagatctaccaggagctgacccagctgaaggctgcagtgggtgagcttccagagaaatctaagctgcaggagatctaccaggagctgacccggctgaaggctgcagtgggtgagcttccagagaaatctaagctgcaggagatctaccaggagctgacctggctgaaggctgcagtgggtgagcttccagagaaatctaagatgcaggagatctaccaggagctgactcggctgaaggctgcagtgggtgagcttccagagaaatctaagcagcaggagatctaccaggagctgacccggctgaaggctgcagtgggtgagcttccagagaaatctaagcagcaggagatctaccaggagctgacccggctgaaggctgcagtgggtgagcttccagagaaatctaagcagcaggagatctaccaggagctgacccagctgaaggctgcagtggaacgcctgtgccacccctgtccctgggaatggacattcttccaaggaaactgttacttcatgtctaactcccagcggaactggcacgactccatcaccgcctgcaaagaagtgggggcccagctcgtcgtaatcaaaagtgctgaggagcagaacttcctacagctgcagtcttccagaagtaaccgcttcacctggatgggactttcagatctaaatcaggaaggcacgtggcaatgggtggacggctcacctctgttgcccagcttcaagcagtattggaacagaggagagcccaacaacgttggggaggaagactgcgcggaatttagtggcaatggctggaacgacgacaaatgtaatcttgccaaattctggatctgcaaaaagtccgcagcctcctgctccagggatgaagaacagtttctttctccagcccctgccaccccaaacccccctcctgcgtagcagaacttcacccccttttaagctacagttccttctctccatccttcgaccttcacaaaatctctgggactgttctttgtcagattcttcctcctttagaaggctgggtcccattctgtccttcttgtcatgcctccaatttcccctggtgtagagcttgtttttctggcccatccttggagctttatgagtgagctggtgtgggatgcctttgggggtggacttgtgttccaagaatccactctctcttccttttggagattaggatatttgggttgccatgtgtagctgctatgtcccctggggcgttatcttatacatgcaaacctaccatctgttcaacttccacctaccacctcctgcacccctttgatcggggacttactggttgcaagagctcattttgcaggctggaagcaccagggaattaattcccccagtcaaccaatggcacccagagagggcatggaggctccacgcaaccccttccacccccacatcttcctttgtcttatacatggcttccatttggctgtttctaagttgtattctttattttattattattattactatttttcgagatggagtttcactcttgtcgctcaggctggagtgccatggcgcgatcttggctcactgcaacctctgcctcccgggttcaagtgattctcctgcctcagcctcacgagtagctggaattacaggcaggcgccaccagacccggctaattttttgtatttttagtacagatggggtttctccgtgttggtcaggctggtcttgaactcccgacctcagatgatctgcccgcctcggcctcccaaaattgctgggattacaggtgtgagccaccgcgcctggcctattattttttgtaagaataaaacaggtttattgggatttgggactctgaacagttctgtctctactacctgatctcctcctaccacgactttgggatctagaggagctttggctccggctgtgacggctccggccgttctcactgcggctgcaccggcccccgctgcggtcactatttcttcctctgctaggtgaattgtgcctctcctggctctttgacatgtgctagtgagatttcttccttttcctttcggattccccatttcttttgtaggaatggtctggactagggttctccttccccgcagcctgtagtattcatcgtggtggcccaccctctctctccccttggagctcttgccaaaggaggagacaagcagaggtctctattggatttctcaacacctgaagaaagttgcagtgttttcctcttggacattgttgtatttcaaataaaccacaaatcatcattttccaccgagccactgggcagaattcacactgaagctgtcgtcctgcgtacataccatcgtccgttaaacagagaaagagctgcttggcattcttcttccgactggtactgaacatatatacttgcccctcaggtgaggttccaagttgcaactgaccttgaactgaatcactctccccacgttattttttaattactatttttttttaaagatggggtcttgctctgtcgccaggctggagtgcagtggcgcgatctaggctcactgcaacttccgcctcccgggttcaagcgattctcctgcctcagcctcccgagtagctgggactccactaaaagtacaaaaattagctgggcgtgcaccactgcgcccagctaattcttgtatttttggtagagacggggtttcaacatgttgaccaggatggtctcgatctcttgacctcgtgattcgcccgccgcgtcctcccaaagtgctgggattacaggcctgagccaccgcgcccagtctctccccacgttcttgaactcgggcagcacatcctcacagaaatctaggaactgttggtaggtttcttcctcgctgtactccaggcttgcttcggagtcatagtcatccctcctgcactgctcctttccaaacactgtaaacatgcttttaataagaagggtaggactggatgttgggaaatcatgtgaacatctatctccaaatctgcaagctcctgttttactgtagaagggacaattaactccatccttctccatgactctgaaatccaagggggggttccgggttttgccatgtggcgccattttccaactcattttcagcctgatccagcatcttctggacagcttccggtttttgtttcttctgtcgtttctgttcctcctcctctctctctttcctctgctgttcttcccattgttcctttaactttcgctcttgttcttgccgttttctagccacctcttccttttccttctttattctgaattcttcttgtgccttctgctctctcagcaaccactcctcatgtaatctttgcctctctcttccccatagcttttctagttgttgtttttcaataaaagtgtcctcctctttctgtgagagtcctgagtccctcagtggagcaagttcctgctggcgtttctttcgtttctccttcttcagggcggccctgtactttttgtggcttggtttctctggaaatgtcaccttttcgggcgcagccatcttgccggcaccgccccgcccctctagttgtatcctttataataaactggtaaacattgtaaccgcagattcagcccaatctggttcaactttgtgtaataaaatggcgagttgtttttcagttgtcgtggacccccaggttgcaagttacataccctgggcatgtccagatgaacgaagcgtgcaaatccacgtggaacctaagtgctcagaccgaggaacagggactgagttaagaagtggacaccacgtggcatgatccttgatccaatcagattgagccctggcgtgatccagtcagatcaagcctcctgaatcccctcattacaagatccaatcatatcatgcctcactaccctctgtatataaaatctgccccagcctccaacttggagagacagatttgggccagactcctgtgtccttgcttggctgccttgcaataaatttttctctctacaaaa

SEQ ID NO: 5050 - DNA, 939 bp, Homo sapiens
atgagtgactccaaggaaccaagactgcagcagctgggcctcctggaggaggaacagctgagaggccttggattccgacagactcgaggatacaagagcttagcagggtgtcttggccatggtcccctggtgctgcaactcctctccttcacgctcttggctgggctccttgtccaagtgtccaaggtccccagctccataagtcaggaacaatccaggcaagacgcgatctaccagaacctgacccagcttaaagctgcagtgggtgagctctcagagaaatccaagctgcaggagatctaccaggagctgacccagctgaaggctgcagtgggtgagcttccagagaaatctaagctgcaggagatctaccaggagctgacccggctgaaggctgcagtgggtgagcttccagagaaatctaagctgcaggagatctaccaggagctgacctggctgaaggctgcagtggaacgcctgtgccacccctgtccctgggaatggacattcttccaaggaaactgttacttcatgtctaactcccagcggaactggcacgactccatcaccgcctgcaaagaagtgggggcccagctcgtcgtaatcaaaagtgctgaggagcagaacttcctacagctgcagtcttccagaagtaaccgcttcacctggatgggactttcagatctaaatcaggaaggcacgtggcaatgggtggacggctcacctctgttgcccagcttcaagcagtattggaacagaggagagcccaacaacgttggggaggaagactgcgcggaatttagtggcaatggctggaacgacgacaaatgtaatcttgccaaattctggatctgcaaaaagtccgcagcctcctgctccagggatgaagaacagtttctttctccagcccctgccaccccaaacccccctcctgcgtag

SEQ ID NO: 5051 - DNA, 4661 bp, Homo sapiens
cgctcccctcagctcctgcagtgctaattaagggagggagcagcggggagcttgcagtgaccaagagggtgttgaggctaggaggccacgataaacaggatacgataaaagtccttaaccaagacgcagatgggaagaagcgttagagcgagcagcactcacatctcaagaaccagcctttcaaacagtttccagagatggattatcctactttacttttggctcttcttcatgtatacagagctctatgtgaagaggtgctttggcatacatcagttccctttgccgagaacatgtctctagaatgtgtgtatccatcaatgggcatcttaacacaggtggagtggttcaagatcgggacccagcaggattccatagccattttcagccctactcatggcatggtcataaggaagccctatgctgagagggtttactttttgaattcaacgatggcttccaataacatgactcttttctttcggaatgcctctgaagatgatgttggctactattcctgctctctttacacttacccacagggaacttggcagaaggtgatacaggtggttcagtcagatagttttgaggcagctgtgccatcaaatagccacattgtttcggaacctggaaagaatgtcacactcacttgtcagcctcagatgacgtggcctgtgcaggcagtgaggtgggaaaagatccagccccgtcagatcgacctcttaacttactgcaacttggtccatggcagaaatttcacctccaagttcccaagacaaatagtgagcaactgcagccacggaaggtggagcgtcatcgtcatccccgatgtcacagtctcagactcggggctttaccgctgctacttgcaggccagcgcaggagaaaacgaaaccttcgtgatgagattgactgtagccgagggtaaaaccgataaccaatataccctctttgtggctggagggacagttttattgttgttgtttgttatctcaattaccaccatcattgtcattttccttaacagaaggagaaggagagagagaagagatctatttacagagtcctgggatacacagaaggcacccaataactatagaagtcccatctctaccagtcaacctaccaatcaatccatggatgatacaagagaggatatttatgtcaactatccaaccttctctcgcagaccaaagactagagtttaagcttattcttgacatgagtgcattagtaatgactcttatgtactcatgcatggatctttatgcaatttttttccactacccaaggtctaccttagatactagttgtctgaattgagttactttgataggaaaaatacttcattacctaaaatcatttttcatagaactgtttcagaaaacctgactctaactggtttatatacaaaagaaaacttactgtatcatataacagaatgatccaggggagattaagctttgggcaagggctatttaccagggcttaaatgttgtgtctagaattaagtatgggcataaactggcttctgaatccctttccagagtgttggatccatttccctggtcttggcctcactctcatgcaggctttcctcttgtgttggcaagatggctgccaactcttggcaattcatacatccttgtttctgtctggtagagagtttgcttctcaaatggagcaaacaaatttgattattttttcattgttaaataggcaacatgaccagaaaggatggaatggcttaagtaaactaagggttcacttctagagctgagaagcagggtcaaagcacaatactgggcaattcagagcatggttagaagaggaaaggggagtctcaaagctggagagtttaccaacaaatattgactgcagtgattaaccaagacatttttgttaactaaaaagtgaaatatgggatggattctagaaatggggtatctctgtccatacttctagaatccactctatcagcatagtccagaagaatacctggcagtagaagaaatgaatattcaagaggaagataaatgcgagagggcaatcctttactattctcatatttatttatctctcattctgtatagaattcttgccgccatcccaggtctagccttaggagcaaatgtagtagatagtcgaataataaataacttaatgttttggacatattttgtctacttttgagaattatttttaatatgtaaattctctcaaaagggtcaggcacctagttattattttttaatgattatgtgaaagttgaatataatataccactaaaagtgacagttgaaagtggtggcataggacggtagggtagaaatttgggagggaaaaaagaaattgggagggtacaggcaacaggagaaaggaatcaaaccacagaaaaatacaaagggaaacttctgcttcactattcagacaaagacagccctaatgacatcaccaacagtcaaagcaattagagaccatacctaatattgtttaaattctagatgtaggctaacaatgaaaagtatttgccaaactgaataaaactgtcatggttaccttgaaaggacaatggttattgttaaatatagtgatcattcatgtctaaaagattcattatttatctctaaagatttctaaagaccaccatctagaaaagattcattatgaaggctgtatttaaatatcaaagttgtggacttcatgataatcttaaataaagcaaatccaaattctcctgttgcctagacagattctaagatgtaatttacacttttaagctaattagtgagtattttatgattttagccttaaacaccatgtatgccaaataatgcacttgttttgtgaattacagaaatggtaagtgcccacatttctgtgaattataaaatttgtgagtttcttttaacccttttcaggagtgaaaaaataaaaacgaccatttcctggttgtgcttaagtatatgcaagaagggtaaactctcatttttattatgtttgcttaaagatctttttatacctggattcatgaaatgtttccacaaatatattagtgtaacaaacttgaaaggcagtttacaagaaagcactctactatcagatcaatcaaagattctgtgagtgaatttattggtttgcatggtgaagcaagcttagcatcaattaaaaggtaaataatttcttttctgaatggtaaagacaatcaaaatattactttctggaaaactccaataaccaaattctcaatgattagtgtatgtgagcaggaaaacatttttacagttgtagtatggggaaatataaatccaattttaagagagaaaattatgactgggtgtggaagggacagtatagtcagataccattgtcatggtggtttttactgggaacttcatgaaagacttttgtagcaaaccactgcagtattgcaaagcctccagaacatttggaacttgtctctttttccttgtgtgtgtttgtgtttttggtctctcattcaaaatattgatgagaactatttactctgtcctttcttctctatatattcttcctctacagagtgtagggttttttcaggaatttggagccatctgaagtcctcccaaaaattctctgacgtcttctgatgctcctgttataccctcaggggtaatgcttgtgaaattccattcattcattttctttctctggacatctttacttaccaaagcactttcattgtcatctttttaacatcattcttaattcgtgatagttttgggactctccctagtgtatgtttctccccctctactcttttgcacctatgattctgattgttactaagaaagcagatgaaaaacagatccacagaataaacgatcagaattccagtaaattctattttaaatacagatactttttacaagttgctgctttggaagcaaaatgcttcttaagttttacatatatatatatatatatacatatatatatacacatataatttatatcgatggataatacattaagaatctatgcttcctttgaatgccattaatatttatgttaaagtaaccaatgaaaggaaattactttgttataataagataggaagacttgttaatggagtacacagttttgtcagggaaagaacacatcttattgaactatgatgactatgcattgactatattattataagagataccttcaaactttatttaaagaactttaggtataatatgttgagaaaataaaatagaaatttcatttacttgtaatcatgcttaaaatgggaggcaggtaggtgaagatataatttttagtaaaaactccaatttatgttttaagtaattcagtgtattactaaaatactatatatataaacttaaaatacatgggttatcaatttaaaagacaaagtaagtaaaaatacttttagtaggcattcgtggattgtgaacatccaagttatattggtttgtatagaatggcattaagtaaaaattacagctgtataacagtagttttctaaattgagagagtccacattgtaattagagatcactgtgaccaaaatgcttctccttgatttataatgatgtactgtattttgtactgcttatatgaaatttcagcaagattgacgatattataaagatgcttataaagtgtaa

SEQ ID NO: 5052 - DNA, 921 bp, Homo sapiens
cctggcccctctgtcctgtggaaatgctggggcaagtggtcaccctcatactcctcctgctcctcaaggtgtatcagggcaaaggatgccagggatcagctgaccatgtggttagcatctcgggagtgcctcttcagttacaaccaaacagcatacagacgaaggttgacagcattgcatggaagaagttgctgccctcacaaaatggatttcatcacatattgaagtgggagaatggctctttgccttccaatacttccaatgatagattcagttttatagtcaagaacttgagtcttctcatcaaggcagctcagcagcaggacagtggcctctactgcctggaggtcaccagtatatctggaaaagttcagacagccacgttccaggtttttgtatttgaattcagattttggccgtttttggtgatcatcgtgattctaagcgcactgttccttggcacccttgcctgcttctgtgtgtggaggagaaagaggaaggagaagcagtcagagaccagtcccaaggaatttttgacaatttacgaagatgtcaaggatctgaaaaccaggagaaatcacgagcaggagcagacttttcctggaggggggagcaccatctactctatgatccagtcccagtcttctgctcccacgtcacaagaacctgcatatacattatattcattaattcagccttccaggaagtctggatccaggaagaggaaccacagcccttccttcaatagcactatctatgaagtgattggaaagagtcaacctaaagcccagaaccctgctcgattgagccgcaaagagctggagaactttgatgtttattcctagttgctgcagcaattctcacctttcttgcacatcagcatctgctttgggaattggcacagtggatgacggcacagga

SEQ ID NO: 5053 - DNA, 1215 bp, Homo sapiens
cttgtgggaactgtcagaccagctccaggcgctggggctttctcagtggccttgtcagctcacagcaggcgttaacagcctctaattgaggaaactgtggctggacaggttgcaaggcagttctgctccccatcgtcctcttgctgactggggactgctgagcccgtgcacggcagagagtctggtggggtggaggggctggcctggcccctctgtcctgtggaaatgctggggcaagtggtcaccctcatactcctcctgctcctcaaggtgtatcagggcaaaggatgccagggatcagctgaccatgtggttagcatctcgggagtgcctcttcagttacaaccaaacagcatacagacgaaggttgacagcattgcatggaagaagttgctgccctcacaaaatggatttcatcacatattgaagtgggagaatggctctttgccttccaatacttccaatgatagattcagttttatagtcaagaacttgagtcttctcatcaaggcagctcagcagcaggacagtggcctctactgcctggaggtcaccagtatatctggaaaagttcagacagccacgttccaggtttttgtatttgataaagttgagaaaccccgcctacaggggcaggggaagatcctggacagagggagatgccaagtggctctgtcttgcttggtctccagggatggcaatgtgtcctatgcttggtacagagggagcaagctgatccagacagcagggaacctcacctacctggacgaggaggttgacattaatggcactcacacatatacctgcaatgtcagcaatcctgttagctgggaaagccacaccctgaatctcactcaggactgtcagaatgcccatcaggaattcagattttggccgtttttggtgatcatcgtgattctaagcgcactgttccttggcacccttgcctgcttctgtgtgtggaggagaaagaggaaggagaagcagtcagagaccagtcccaaggaatttttgacaatttacgaagatgtcaaggatctgaaaaccaggagaaatcacgagcaggagcagacttttcctggaggggggagcaccatctactctatgatccagtcccagtcttctgctcccacgtcacaagaacctgcatatacattatattcattaattcagccttccaggaagggtgacagattctattcattttctggctga

SEQ ID NO: 5054 - DNA, 1360 bp, Homo sapiens
gctgactggggactgctgagcccgtgcacggcagagagtctggtggggtggaggggctggcctggcccctctgtcctgtggaaatgctggggcaagtggtcaccctcatactcctcctgctcctcaaggtgtatcagggcaaaggatgccagggatcagctgaccatgtggttagcatctcgggagtgcctcttcagttacaaccaaacagcatacagacgaaggttgacagcattgcatggaagaagttgctgccctcacaaaatggatttcatcacatattgaagtgggagaatggctctttgccttccaatacttccaatgatagattcagttttatagtcaagaacttgagtcttctcatcaaggcagctcagcagcaggacagtggcctctactgcctggaggtcaccagtatatctggaaaagttcagacagccacgttccaggtttttgtatttgaatctctgcttccagataaagttgagaaaccccgcctacaggggcaggggaagatcctggacagagggagatgccaagtggctctgtcttgcttggtctccagggatggcaatgtgtcctatgcttggtacagagggagcaagctgatccagacagcagggaacctcacctacctggacgaggaggttgacattaatggcactcacacatatacctgcaatgtcagcaatcctgttagctgggaaagccacaccctgaatctcactcaggactgtcagaatgcccatcaggaattcagattttggccgtttttggtgatcatcgtgattctaagcgcactgttccttggcacccttgcctgcttctgtgtgtggaggagaaagaggaaggagaagcagtcagagaccagtcccaaggaatttttgacaatttacgaagatgtcaaggatctgaaaaccaggagaaatcacgagcaggagcagacttttcctggaggggggagcaccatctactctatgatccagtcccagtcttctgctcccacgtcacaagaacctgcatatacattatattcattaattcagccttccaggaagtctggatccaggaagaggaaccacagcccttccttcaatagcactatctatgaagtgattggaaagagtcaacctaaagcccagaaccctgctcgattgagccgcaaagagctggagaactttgatgtttattcctagttgctgcagcaattctcacctttcttgcacatcagcatctgctttgggaattggcacagtggatgacggcacaggagtctctatagaacagttcctagtctggagaggatatggaaatttgttcttgttctatattttgttttgaaaatgatgtctaacaacca

SEQ ID NO: 5055 - DNA, 2463 bp, Homo sapiens
ggccttgtcagctcacagcaggcgttaacagcctctaattgaggaaactgtggctggacaggttgcaaggcagttctgctccccatcgtcctcttgctgactggggactgctgagcccgtgcacggcagagagtctggtggggtggaggggctggcctggcccctctgtcctgtggaaatgctggggcaagtggtcaccctcatactcctcctgctcctcaaggtgtatcagggcaaaggatgccagggatcagctgaccatgtggttagcatctcgggagtgcctcttcagttacaaccaaacagcatacagacgaaggttgacagcattgcatggaagaagttgctgccctcacaaaatggatttcatcacatattgaagtgggagaatggctctttgccttccaatacttccaatgatagattcagttttatagtcaagaacttgagtcttctcatcaaggcagctcagcagcaggacagtggcctctactgcctggaggtcaccagtatatctggaaaagttcagacagccacgttccaggtttttgtatttgataaagttgagaaaccccgcctacaggggcaggggaagatcctggacagagggagatgccaagtggctctgtcttgcttggtctccagggatggcaatgtgtcctatgcttggtacagagggagcaagctgatccagacagcagggaacctcacctacctggacgaggaggttgacattaatggcactcacacatatacctgcaatgtcagcaatcctgttagctgggaaagccacaccctgaatctcactcaggactgtcagaatgcccatcaggaattcagattttggccgtttttggtgatcatcgtgattctaagcgcactgttccttggcacccttgcctgcttctgtgtgtggaggagaaagaggaaggagaagcagtcagagaccagtcccaaggaatttttgacaatttacgaagatgtcaaggatctgaaaaccaggagaaatcacgagcaggagcagacttttcctggaggggggagcaccatctactctatgatccagtcccagtcttctgctcccacgtcacaagaacctgcatatacattatattcattaattcagccttccaggaagtctggatccaggaagaggaaccacagcccttccttcaatagcactatctatgaagtgattggaaagagtcaacctaaagcccagaaccctgctcgattgagccgcaaagagctggagaactttgatgtttattcctagttgctgcagcaattctcacctttcttgcacatcagcatctgctttgggaattggcacagtggatgacggcacaggagtctctatagaacagttcctagtctggagaggatatggaaatttgttcttgttctatattttgttttgaaaatgatgtctaacaaccatgataagagcaaggctgttaaataatatcttccaatttacagatcagacatgaatgggtggaggggttaggttgttcacaaaaggccacattccaagtatttgtaatctagaaagtgttatgtaagtgatgttattagcatcgagattccctccacctgattttcaagctgtcacttgtttccttttctcccctctctgggttgactgcatttctagactctcgccggcccaggcccatcttccaaagcaagaggaaggaatgataatggtgactcaggggaagaagaaacagccctcctctgaaagcctggactgtccggctgtgaactggctggcaggttctgcacgtgggtgggggccagggcctgggctttactcaattgcagagaaaaaactttctccctgcatctcatacctttacctctggccagttggccaccagggggagtgggctgaagggagagtagatggtgcaaagcaagcccatctctaagtagaaaaatcacccagagcacatgctgacctgataactggggtgttgagaccagctttgtccatggtatgatgtttgatttatgaagacgcattgttagaaatccatttggcttcttcatagaagtggcttcccagaggaagaggcctctcagaaaccatgttctatttaagttctgagtcctgatgagtgttccccaggatgcacattgaagggagggctcaggcagctgagggctgagaatgaggcagttggaatctagacactatgctgggttccctgagtcgtcaggccagacatttcaacaaggctgtggggagcagggctgtgactctggctgagcccaggaaagcgacaagggtgaactgggagaggacttactcagagaccccaacaggtgatactgcacaaagcctggttcttcaattttcctaccctgtatctaacataggagtttcatataaaacggtgatatcatgcagatgcagtctgaattccttgcctgaattaaatttatgtatcctctcca

SEQ ID NO: 5056 - DNA, 1609 bp, Homo sapiens
ttttctcctaaccgtcccggccaccgctgcctcagcctctgcctcccagcctctttctgagggaaaggacaagatgaagtggaaggcgcttttcaccgcggccatcctgcaggcacagttgccgattacagaggcacagagctttggcctgctggatcccaaactctgctacctgctggatggaatcctcttcatctatggtgtcattctcactgccttgttcctgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaacagccaggggatttcaccactcaaaggccagacctgcagacgcccagattatgagacacaggatgaagcatttacaacccggttcactcttctcagccactgaagtattcccctttatgtacaggatgctttggttatatttagctccaaaccttcacacacagactgttgtccctgcactctttaagggagtgtactcccagggcttacggccctggccttgggccctctggtttgccggtggtgcaggtagacctgtctcctggcggttcctcgttctccctgggaggcgggcgcactgcctctcacagctgagttgttgagtctgttttgtaaagtccccagagaaagcgcagatgctagcacatgccctaatgtctgtatcactctgtgtctgagtggcttcactcctgctgtaaatttggcttctgttgtcaccttcacctcctttcaaggtaactgtactgggccatgttgtgcctccctggtgagagggccgggcagaggggcagatggaaaggagcctaggccaggtgcaaccagggagctgcaggggcatgggaaggtgggcgggcaggggagggtcagccagggcctgcgagggcagcgggagcctccctgcctcaggcctctgtgccgcaccattgaactgtaccatgtgctacaggggccagaagatgaacagactgaccttgatgagctgtgcacaaagtggcataaaaaacatgtggttacacagtgtgaataaagtgctgcggagcaagaggaggccgttgattcacttcacgctttcagcgaatgacaaaatcatctttgtgaaggcctcgcaggaagacccaacacatgggacctataactgcccagcggacagtggcaggacaggaaaaacccgtcaatgtactaggatactgctgcgtcattacagggcacaggccatggatggaaaacgctctctactctgctttttttctactgttttaatttatactggcatgctaaagccttcctattttgcataataaatgcttcagtgaaaatgca

SEQ ID NO: 5057 - DNA, 1678 bp, Homo sapiens
tgctttctcaaaggccccacagtcctccacttcctggggaggtagctgcagaataaaaccagcagagactccttttctcctaaccgtcccggccaccgctgcctcagcctctgcctcccagcctctttctgagggaaaggacaagatgaagtggaaggcgcttttcaccgcggccatcctgcaggcacagttgccgattacagaggcacagagctttggcctgctggatcccaaactctgctacctgctggatggaatcctcttcatctatggtgtcattctcactgccttgttcctgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaacagccaggggatttcaccactcaaaggccagacctgcagacgcccagattatgagacacaggatgaagcatttacaacccggttcactcttctcagccactgaagtattcccctttatgtacaggatgctttggttatatttagctccaaaccttcacacacagactgttgtccctgcactctttaagggagtgtactcccagggcttacggccctggccttgggccctctggtttgccggtggtgcaggtagacctgtctcctggcggttcctcgttctccctgggaggcgggcgcactgcctctcacagctgagttgttgagtctgttttgtaaagtccccagagaaagcgcagatgctagcacatgccctaatgtctgtatcactctgtgtctgagtggcttcactcctgctgtaaatttggcttctgttgtcaccttcacctcctttcaaggtaactgtactgggccatgttgtgcctccctggtgagagggccgggcagaggggcagatggaaaggagcctaggccaggtgcaaccagggagctgcaggggcatgggaaggtgggcgggcaggggagggtcagccagggcctgcgagggcagcgggagcctccctgcctcaggcctctgtgccgcaccattgaactgtaccatgtgctacaggggccagaagatgaacagactgaccttgatgagctgtgcacaaagtggcataaaaaacatgtggttacacagtgtgaataaagtgctgcggagcaagaggaggccgttgattcacttcacgctttcagcgaatgacaaaatcatctttgtgaaggcctcgcaggaagacccaacacatgggacctataactgcccagcggacagtggcaggacaggaaaaacccgtcaatgtactaggatactgctgcgtcattacagggcacaggccatggatggaaaacgctctctactctgctttttttctactgttttaatttatactggcatgctaaagccttcctattttgcataataaatgcttcagtgaaaatgca

SEQ ID NO: 5058 - DNA, 2558 bp, Homo sapiens
agtccgggggcatcgcgatgctgctgcgcctgttgctggcctgggcggccgcagggcccacactgggccaggacccctgggctgctgagccccgtgccgcctgcggccccagcagctgctacgctctcttcccacggcgccgcaccttcctggaggcctggcgggcctgccgcgagctggggggcgacctggccactcctcggacccccgaggaggcccagcgtgtggacagcctggtgggtgcgggcccagccagccggctgctgtggatcgggctgcagcggcaggcccggcaatgccagctgcagcgcccactgcgcggcttcacgtggaccacaggggaccaggacacggctttcaccaactgggcccagccagcctctggaggcccctgcccggcccagcgctgtgtggccctggaggcaagtggcgagcaccgctggctggagggctcgtgcacgctggctgtcgacggctacctgtgccagtttggcttcgagggcgcctgcccggcgctgcaagatgaggcgggccaggccggcccagccgtgtataccacgcccttccacctggtctccacagagtttgagtggctgcccttcggctctgtggccgctgtgcagtgccaggctggcaggggagcctctctgctctgcgtgaagcagcctgagggaggtgtgggctggtcacgggctgggcccctgtgcctggggactggctgcagccctgacaacgggggctgcgaacacgaatgtgtggaggaggtggatggtcacgtgtcctgccgctgcactgagggcttccggctggcagcagacgggcgcagttgcgaggacccctgtgcccaggctccgtgcgagcagcagtgtgagcccggtgggccacaaggctacagctgccactgtcgcctgggtttccggccagcggaggatgatccgcaccgctgtgtggacacagatgagtgccagattgccggtgtgtgccagcagatgtgtgtcaactacgttggtggcttcgagtgttattgtagcgagggacatgagctggaggctgatggcatcagctgcagccctgcaggggccatgggtgcccaggcttcccaggacctcggagatgagttgctggatgacggggaggatgaggaagatgaagacgaggcctggaaggccttcaacggtggctggacggagatgcctgggatcctgtggatggagcctacgcagccgcctgactttgccctggcctatagaccgagcttcccagaggacagagagccacagataccctacccggagcccacctggccacccccgctcagtgcccccagggtcccctaccactcctcagtgctctccgtcacccggcctgtggtggtctctgccacgcatcccacactgccttctgcccaccagcctcctgtgatccctgccacacacccagctttgtcccgtgaccaccagatccccgtgatcgcagccaactatccagatctgccttctgcctaccaacccggtattctctctgtctctcattcagcacagcctcctgcccaccagccccctatgatctcaaccaaatatccggagctcttccctgcccaccagtcccccatgtttccagacacccgggtcgctggcacccagaccaccactcatttgcctggaatcccacctaaccatgcccctctggtcaccaccctcggtgcccagctaccccctcaagccccagatgcccttgtcctcagaacccaggccacccagcttcccattatcccaactgcccagccctctctgaccaccacctccaggtcccctgtgtctcctgcccatcaaatctctgtgcctgctgccacccagcccgcagccctccccaccctcctgccctctcagagccccactaaccagacctcacccatcagccctacacatccccattccaaagccccccaaatcccaagggaagatggccccagtcccaagttggccctgtggctgccctcaccagctcccacagcagccccaacagccctgggggaggctggtcttgccgagcacagccagagggatgaccggtggctgctggtggcactcctggtgccaacgtgtgtctttttggtggtcctgcttgcactgggcatcgtgtactgcacccgctgtggcccccatgcacccaacaagcgcatcactgactgctatcgctgggtcatccatgctgggagcaagagcccaacagaacccatgccccccaggggcagcctcacaggggtgcagacctgcagaaccagcgtgtgatggggtgcagacccccctcatggagtatggggcgctggacacatggccggggctgcaccagggacccatgggggctgcccagctggacagatggcttcctgctccccaggcccagccagggtcctctctcaaccactagacttggctctcaggaactctgcttcctggcccagcgctcgtgaccaaggatacaccaaagcccttaagacctcagggggcgggtgctggggtcttctccaataaatggggtgtcaaccttacccaagg

SEQ ID NO: 5059 - DNA, 2815 bp, Homo sapiens
ccaggccgtgtgctctgcccagcgggctggctcaggcctcggtcagcagccgccaccgcggggccaatccggcctcagggacgcaccggagccgcctttccgggcctcaggcggattctccggcgcggcccgccccgcccctcggactccccgggccgcccccggcccccattcgggccgggcctcgctgcggcggcgactgagccaggctgggccgcgtccctgagtcccagagtcggcgcggcgcggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctcctcttgctctagccttaatactggccttttccctccctgccccaagtgaagacagggcactctgcgcccaccacatgcacagctgtgcatggagacctgcaggtgcacgtgctggaacacgtgtggttcccccctggcccagcctcctctgcagtgcccctctcccctgcccatcctccccacggaagcatgtgctggtcacactggttctccaggggtctgtgatggggcccctgggggtcagcttctgtccctctgccttctcacctctttgttcctttcttttcatgtatccattcagttgatgtttattgagcaactacagatgtcagcactgtgttaggtgctgggggccctgcgtgggaagataaagttcctccctcaaggactccccatccagctgggagacagacaactaactacactgcaccctgcggtttgcagggggctcctgcctggctccctgctccacacctcctctgtggctcaaggcttcctggatacctcacccccatcccacccataattcttacccagagcatggggttggggcggaaacctggagagagggacatagcccctcgccacggctagagaatctggtggtgtccaaaatgtctgtccaggtgtgggcaggtgggcaggcaccaaggccctctggacctttcatagcagcagaaaaggcagagcctggggcagggcagggccaggaatgctttggggacaccgaggggactgccccccacccccaccatggtgctattctggggctggggcagtcttttcctggcttgcctctggccagctcctggcctctggtagagtgagacttcagacgttctgatgccttccggatgtcatctctccctgccccaggaatggaagatgtgaggacttctaatttaaatgtgggactcggagggattttgtaaactgggggtatattttggggaaaataaatgtctttgtaaaaagctt

SEQ ID NO: 5060 - DNA, 3469 bp, Homo sapiens
ccaggccgtgtgctctgcccagcgggctggctcaggcctcggtcagcagccgccaccgcggggccaatccggcctcagggacgcaccggagccgcctttccgggcctcaggcggattctccggcgcggcccgccccgcccctcggactccccgggccgcccccggcccccattcgggccgggcctcgctgcggcggcgactgagccaggctgggccgcgtccctgagtcccagagtcggcgcggcgcggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccagggctaccctgaggctgaggtgttctggcaggatgggcagggtgtgcccctgactggcaacgtgaccacgtcgcagatggccaacgagcagggcttgtttgatgtgcacagcatcctgcgggtggtgctgggtgcaaatggcacctacagctgcctggtgcgcaaccccgtgctgcagcaggatgcgcacagctctgtcaccatcacaccccagagaagccccacaggagccgtggaggtccaggtccctgaggacccggtggtggccctagtgggcaccgatgccaccctgcgctgctccttctcccccgagcctggcttcagcctggcacagctcaacctcatctggcagctgacagacaccaaacagctggtgcacagtttcaccgaaggccgggaccagggcagcgcctatgccaaccgcacggccctcttcccggacctgctggcacaaggcaatgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctcctcttgctctagccttaatactggccttttccctccctgccccaagtgaagacagggcactctgcgcccaccacatgcacagctgtgcatggagacctgcaggtgcacgtgctggaacacgtgtggttcccccctggcccagcctcctctgcagtgcccctctcccctgcccatcctccccacggaagcatgtgctggtcacactggttctccaggggtctgtgatggggcccctgggggtcagcttctgtccctctgccttctcacctctttgttcctttcttttcatgtatccattcagttgatgtttattgagcaactacagatgtcagcactgtgttaggtgctgggggccctgcgtgggaagataaagttcctccctcaaggactccccatccagctgggagacagacaactaactacactgcaccctgcggtttgcagggggctcctgcctggctccctgctccacacctcctctgtggctcaaggcttcctggatacctcacccccatcccacccataattcttacccagagcatggggttggggcggaaacctggagagagggacatagcccctcgccacggctagagaatctggtggtgtccaaaatgtctgtccaggtgtgggcaggtgggcaggcaccaaggccctctggacctttcatagcagcagaaaaggcagagcctggggcagggcagggccaggaatgctttggggacaccgaggggactgccccccacccccaccatggtgctattctggggctggggcagtcttttcctggcttgcctctggccagctcctggcctctggtagagtgagacttcagacgttctgatgccttccggatgtcatctctccctgccccaggaatggaagatgtgaggacttctaatttaaatgtgggactcggagggattttgtaaactgggggtatattttggggaaaataaatgtctttgtaaaaagctt

SEQ ID NO: 5061 - DNA, 1614 bp, Homo sapiens
attcgggccgggcctcgctgcggcggcgactgagccaggctgggccgcgtccctgagtcccagagtcggcgcggcgcggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccagggctaccctgaggctgaggtgttctggcaggatgggcagggtgtgcccctgactggcaacgtgaccacgtcgcagatggccaacgagcagggcttgtttgatgtgcacagcatcctgcgggtggtgctgggtgcaaatggcacctacagctgcctggtgcgcaaccccgtgctgcagcaggatgcgcacagctctgtcaccatcacaccccagagaagccccacaggagccgtggaggtccaggtccctgaggacccggtggtggccctagtgggcaccgatgccaccctgcgctgctccttctcccccgagcctggcttcagcctggcacagctcaacctcatctggcagctgacagacaccaaacagctggtgcacagtttcaccgaaggccgggaccagggcagcgcctatgccaaccgcacggccctcttcccggacctgctggcacaaggcaatgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccaggcccagcctcctctgcagtgcccctctcccctgcccatcctccccacggaagcatgtgctggtcacactggttctccaggggtctgtga

SEQ ID NO: 5062 - DNA, 1162 bp, Homo sapiens
attcgggccgggcctcgctgcggcggcgactgagccaggctgggccgcgtccctgagtcccagagtcggcgcggcgcggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttc

SEQ ID NO: 5063 - DNA, 649 bp, Homo sapiens
attcgggccgggcctcgctgcggcggcgactgagccaggctgggccgcgtccctgagtcccagagtcggcgcggcgcgtcttgcagtatcgcccagactggagtacagtggcgcgatttccactcactacaacctccgcctcctgggttcaagcaattctcctgcctcagcctcctgagtagctggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgca

SEQ ID NO: 5064 - DNA, 621 bp, Homo sapiens
tttcctcgggttgagaggggcccgggcgccgtcggacctgcagaccccggaagctgcggaccgggccgggtgggtgaatgcgcttttgcaggccccgggtctggagcgggcatgggggcagatctgtcccgtgttgaagcttaacgaagccaccggccggcgctgggaggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgc

SEQ ID NO: 5065 - DNA, 2690 bp, Homo sapiens
cgggcctcgctgcggcggcgactgagccaggctgggccgcgtccctgagtcccagagtcggcgcggcgcggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccagggctaccctgaggctgaggtgttctggcaggatgggcagggtgtgcccctgactggcaacgtgaccacgtcgcagatggccaacgagcagggcttgtttgatgtgcacagcatcctgcgggtggtgctgggtgcaaatggcacctacagctgcctggtgcgcaaccccgtgctgcagcaggatgcgcacagctctgtcaccatcacaccccagagaagccccacaggagccgtggaggtccaggtccctgaggacccggtggtggccctagtgggcaccgatgccaccctgcgctgctccttctcccccgagcctggcttcagcctggcacagctcaacctcatctggcagctgacagacaccaaacagctggtgcacagtttcaccgaaggccgggaccagggcagcgcctatgccaaccgcacggccctcttcccggacctgctggcacaaggcaatgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaaggtaaagacacctgggcttgaggttgtgtctgtgtatgcacacatctgtgtgtgagaggctgagagggtgggtaggcatcatcctttcactagtgacctgaggccccctctgcagaagagcagcctcaacttccccctggtgagatggcagagggctgagtaaccaaggtcccagctgctctgatgggacccaaatacgacagaggcttaagcaggacaggagtttattcctccttcctgtgatagtgtgagcataggtaatcgtaaaaccactgatgacctggagccaggttccacttacctggattctgccctcttcaacttcaagctttcactcctaggtctaagaggctgtttgtgctcccacgccccctccagagccaagagggagagaaaggaaggatatgtttccttctagagcttgagtggaagtagcctgcatcacttccgcttacattccattggtcagaacccaggcatatgagccctaactcaggggaggctagaaaagtgttcagctgggtagccatgtccctggcgcacagtgggtggttagtaaatgtccatagtcattattgggcctattgttataatgtcagtgatgacatttggaaatacaggagataggtcatttccttcctgtttttcagaatcaaataaccatagaagagctgggcagatggagataaaaagtgtcagcttaggccaggcatggtacttcacacctgtaatctcagcactttgggaggccgaggtgggtggatcacttgaggtcaggagtttgagaccagcctggccaacatggtgaaaccctgtctctactaaaaatacaaaacttagccgggcgtggtggtgcatgcctgtaatcccagctacttgggaagctgaggcgggagaatcacttgaacctgggaggcagaggttgcagtgaactgagattgcacctgtgcactccagcctgggcaacagagcaagattccatctc

SEQ ID NO: 5066 - DNA, 628 bp, Homo sapiens
gggcgaaggtgtgggcgactggtgcacttccacaggcagccgtgggcagcatgaggggtcagattccgggaaggacaggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgct

SEQ ID NO: 5067 - DNA, 507 bp, Homo sapiens
ctttgtctgctgcgggccgggcctggatcccgcggaggtccgcacgttcccgctcagggctgcaggagctgagcagggcgccttccctccgggctcctgctcccctgccctcccccaggtccgggcggcccccctcgcacaggagtcccgggaaccgcgggcgcccctcctgccctgggctgtggggcccgcggagagctgggggctcccggatcctaccccgcccccctttcctcgggttgagaggggcccgggcgccgtcggacctgcagaccccggaagctgcggaccgggccgggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctcctt

SEQ ID NO: 5068 - DNA, 1598 bp, Homo sapiens
atcatgtgccctaaggggatggtggcggtggtggtggccgtggatgacggagactctcaggccttggcaggtgcgtctttcagttcccctcacacttcgggttcctcggggaggaggggctggaaccctagcccatcgtcaggacaaagatgctcaggctgctcttggctctcaacttattcccttcaattcaagtaacaggaaacaagattttggtgaagcagtcgcccatgcttgtagcgtacgacaatgcggtcaaccttagctgcaagtattcctacaatctcttctcaagggagttccgggcatcccttcacaaaggactggatagtgctgtggaagtctgtgttgtatatgggaattactcccagcagcttcaggtttactcaaaaacggggttcaactgtgatgggaaattgggcaatgaatcagtgacattctacctccagaatttgtatgttaaccaaacagatatttacttctgcaaaattgaagttatgtatcctcctccttacctagacaatgagaagagcaatggaaccattatccatgtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcctgacacggacgcctatccagaagccagccggctggcagcccccatctgctcaatatcactgctctggataggaaatgaccgccatctccagccggccacctcaggcccctgttgggccaccaatgccaatttttctcgagtgactagaccaaatatcaagatcattttgagactctgaaatgaagtaaaagagatttcctgtgacaggccaagtcttacagtgccatggcccacattccaacttaccatgtacttagtgacttgactgagaagttagggtagaaaacaaaaagggagtggattctgggagcctcttccctttctcactcacctgcacatctcagtcaagcaaagtgtggtatccacagacattttagttgcagaagaaaggctaggaaatcattccttttggttaaatgggtgtttaatcttttggttagtgggttaaacggggtaagttagagtagggggagggataggaagacatatttaaaaaccattaaaacactgtctcccactcatgaaatgagccacgtagttcctatttaatgctgttttcctttagtttagaaatacatagacattgtcttttatgaattctgatcatatttagtcattttgaccaaatgagggatttggtcaaatgagggattccctcaaagcaatatcaggtaaaccaagttgctttcctcactccctgtcatgagacttcagtgttaatgttcacaatatactttcgaaagaataaaatagttctcctacatgaagaaagaatatgtcaggaaataa

SEQ ID NO: 5069 - DNA, 653 bp, Homo sapiens
aaagatgctcaggctgctcttggctctcaacttattcccttcaattcaagtaacagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcctgacacggacgcctatccagaagccagccggctggcagcccccatctgctcaatatcactgctctggataggaaatgaccgccatctccagccggccacctcaggcccctgttgggccaccaatgccaatttttctcgagtgactagaccaaatatcaagatcattttgagactctgaaatgaagtaaaagagatttcctgtgacaggccaagtcttacagtgccatggcccacattccaacttaccatgtacttagtgacttgactgagaagttagggtagaaaacaaaaagggagtggattctgggagcctcttccctttctcactcacctgcacatctcagtc

SEQ ID NO: 5070 - DNA, 3555 bp, Homo sapiens
taaagtcatcaaaacaacgttatatcctgtgtgaaatgctgcagtcaggatgccttgtggtttgagtgccttgatcatgtgccctaaggggatggtggcggtggtggtggccgtggatgacggagactctcaggccttggcaggtgcgtctttcagttcccctcacacttcgggttcctcggggaggaggggctggaaccctagcccatcgtcaggacaaagatgctcaggctgctcttggctctcaacttattcccttcaattcaagtaacaggaaacaagattttggtgaagcagtcgcccatgcttgtagcgtacgacaatgcggtcaaccttagctacaatgagaagagcaatggaaccattatccatgtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcctgacacggacgcctatccagaagccagccggctggcagcccccatctgctcaatatcactgctctggataggaaatgaccgccatctccagccggccacctcaggcccctgttgggccaccaatgccaatttttctcgagtgactagaccaaatatcaagatcattttgagactctgaaatgaagtaaaagagatttcctgtgacaggccaagtcttacagtgccatggcccacattccaacttaccatgtacttagtgacttgactgagaagttagggtagaaaacaaaaagggagtggattctgggagcctcttccctttctcactcacctgcacatctcagtcaagcaaagtgtggtatccacagacattttagttgcagaagaaaggctaggaaatcattccttttggttaaatgggtgtttaatcttttggttagtgggttaaacggggtaagttagagtagggggagggataggaagacatatttaaaaaccattaaaacactgtctcccactcatgaaatgagccacgtagttcctatttaatgctgttttcctttagtttagaaatacatagacattgtcttttatgaattctgatcatatttagtcattttgaccaaatgagggatttggtcaaatgagggattccctcaaagcaatatcaggtaaaccaagttgctttcctcactccctgtcatgagacttcagtgttaatgttcacaatatactttcgaaagaataaaatagttctcctacatgaagaaagaatatgtcaggaaataaggtcactttatgtcaaaattatttgagtactatgggacctggcgcagtggctcatgcttgtaatcccagcactttgggaggccgaggtgggcagatcacttgagatcaggaccagcctggtcaagatggtgaaactccgtctgtactaaaaatacaaaatttagcttggcctggtggcaggcacctgtaatcccagctgcccaagaggctgaggcatgagaatcgcttgaacctggcaggcggaggttgcagtgagccgagatagtgccacagctctccagcctgggcgacagagtgagactccatctcaaacaacaacaacaacaacaacaacaacaacaaaccacaaaattatttgagtactgtgaaggattatttgtctaacagttcattccaatcagaccaggtaggagctttcctgtttcatatgtttcagggttgcacagttggtctctttaatgtcggtgtggagatccaaagtgggttgtggaaagagcgtccataggagaagtgagaatactgtgaaaaagggatgttagcattcattagagtatgaggatgagtcccaagaaggttctttggaaggaggacgaatagaatggagtaatgaaattcttgccatgtgctgaggagatagccagcattaggtgacaatcttccagaagtggtcaggcagaaggtgccctggtgagagctcctttacagggactttatgtggtttagggctcagagctccaaaactctgggctcagctgctcctgtaccttggaggtccattcacatgggaaagtattttggaatgtgtcttttgaagagagcatcagagttcttaagggactgggtaaggcctgaccctgaaatgaccatggatatttttctacctacagtttgagtcaactagaatatgcctggggaccttgaagaatggcccttcagtggccctcaccatttgttcatgcttcagttaattcaggtgttgaaggagcttaggttttagaggcacgtagacttggttcaagtctcgttagtagttgaatagcctcaggcaagtcactgcccacctaagatgatggttcttcaactataaaatggagataatggttacaaatgtctcttcctatagtataatctccataagggcatggcccaagtctgtctttgactctgcctatccctgacatttagtagcatgcccgacatacaatgttagctattggtattattgccatatagataaattatgtataaaaattaaactgggcaatagcctaagaaggggggaatattgtaacacaaatttaaacccactacgcagggatgaggtgctataatatgaggaccttttaacttccatcattttcctgtttcttgaaatagtttatcttgtaatgaaatataaggcacctcccacttttatgtatagaaagaggtcttttaatttttttttaatgtgagaaggaagggaggagtaggaatcttgagattccagatcgaaaatactgtactttggttgatttttaagtgggcttccattccatggatttaatcagtcccaagaagatcaaactcagcagtacttgggtgctgaagaactgttggatttaccctggcacgtgtgccacttgccagcttcttgggcacacagagttcttcaatccaagttatcagattgtatttgaaaatgacagagctggagagttttttgaaatggcagtggcaaataaataaatacttttttttaaatggaaagacttgatctatggtaataaatgattttgttttctgactggaaaaataggcctactaaagatgaatcacacttgagatgtttcttactcactctgcacagaaacaaagaagaaatgttatacagggaagtccgttttcactattagtatgaaccaagaaatggttcaaaaacagtggtaggagcaatgctttcatagtttcagatatggtagttatgaagaaaacaatgtcatttgctgctattattgtaagagtcttataattaatggtactcctataatttttgattgtgagctcacctatttgggttaagcatgccaatttaaagagaccaagtgtatgtacattatgttctacatattcagtgataaaattactaaactacta

SEQ ID NO: 5071 - DNA, 705 bp, Homo sapiens
atgccttgtggtttgagtgccttgatcatgtgccctaaggggatggtggcggtggtggtggccgtggatgacggagactctcaggccttggcaggaaacaagattttggtgaagcagtcgcccatgcttgtagcgtacgacaatgcggtcaaccttagctgcaagtattcctacaatctcttctcaagggagttccgggcatcccttcacaaaggactggatagtgctgtggaagtctgtgttgtatatgggaattactcccagcagcttcaggtttactcaaaaacggggttcaactgtgatgggaaattgggcaatgaatcagtgacattctacctccagaatttgtatgttaaccaaacagatatttacttctgcaaaattgaagttatgtatcctcctccttacctagacaatgagaagagcaatggaaccattatccatgtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcctga

SEQ ID NO: 5072 - DNA, 5412 bp, Homo sapiens
ctctgtctgggtccccaccttagtctacggtgtcgccttttctaactgcgagtgctaaggaagaggcgaggggcgggctccgaggctaggcgggcgctcggggttggagccgagggtctgggcaaaccggtgggtccctccccactgcgggagcggccagggtgggaaaaccgcggtcgggcgggcggggtagggccctcccgccgccgtggctcctggggaggccaggggtgaggagctgtcgccgcctttgcctctgcctcgagggccgcgctgaagagactggtaggagagcgccgcgggcggatggaggcgactcttcgccccgcctgagctcaggaggggctagcgcggagcgcgggtcccgcctccagccgcgggagcggccgcgcgagccaccactggaggaggaggaggaggagcggacgtcggcttctccccgcgggagcccccagcatggttgactatattgtggagtatgactatgatgctgtacatgatgatgaattaactattcgagttggagaaatcatcaggaatgtgaaaaagctacaggaggaagggtggctggaaggagaactaaatgggagaagaggaatgttccctgacaatttcgttaaggaaattaaaagagagacggaattcaaggatgacagtttgcccatcaaacgggaaaggcatgggaatgtagcaagtcttgtacaacgaataagcacctatggacttccagctggaggaattcagccacatccacaaaccaaaaacattaagaagaagaccaagaagcgtcagtgtaaagttctttttgagtacattccacaaaatgaggatgaactggagctgaaagtgggagatattattgatattaatgaagaggtagaagaaggctggtggagtggaaccctgaataacaagttgggactgtttccctcaaattttgtgaaagaattagaggtaacagatgatggtgaaactcatgaagcccaggacgattcagaaactgttttggctgggcctacttcacctataccttctctgggaaatgtgagtgaaactgcatctggatcagttacacagccaaagaaaattcgaggaattggatttggagacatttttaaagaaggctctgtgaaacttcggacaagaacatccagtagtgaaacagaagagaaaaaaccagaaaagcccttaatcctacagtcactgggacccaaaactcagagtgtggagataacaaaaacagataccgaaggtaaaattaaagctaaagaatattgtagaacattatttgcctatgaaggtactaatgaagatgaacttacttttaaagagggggagataatccatttgataagtaaggagactggagaagctggctggtggaggggcgaacttaatggtaaagaaggagtatttccagacaattttgctgtccagataaatgaacttgataaagactttccaaaaccaaagaaaccaccacctcctgctaaggctccagctccaaagcctgaactgatagctgcagagaagaaatatttttctttaaagcctgaagaaaaggatgaaaaatcaacactggaacagaaaccttctaaaccagcagctccacaagtcccacccaagaaacctactccacctaccaaagccagtaatttactgagatcttctggaacagtgtacccaaagcgacctgaaaaaccagttcctccaccacctcctatagccaagattaatggggaagtttctagcatttcatcaaaatttgaaactgagccagtatcaaaactaaagctagattctgaacagctgccccttagaccaaaatcagtagactttgattcacttacagtaaggacctccaaagaaacagatgttgtaaattttgatgacatagcttcctcagaaaacttgcttcatctcactgcaaatagaccaaagatgcctggaagaaggttgccgggccgtttcaatggtggacattctccaactcacagccccgaaaaaatcttgaagttaccaaaagaagaagacagtgccaacctgaagccatctgaattaaaaaaagatacatgctactctccaaagccatctgtgtacctttcaacaccttccagtgcttctaaagcaaatacaactgctttcctgactccattagaaatcaaagctaaagtggaaacagatgatgtgaaaaaaaattccctggatgaacttagagcccagattattgaattgttgtgcattgtagaagcactgaaaaaggatcacgggaaagaactggaaaaactgcgaaaagatttggaagaagagaagacaatgagaagtaatctagagatggaaatagagaagctgaaaaaagctgtcctgtcttcttgagtggtgtggacctggtgttcataatgttccagggattcagaagcaacgctatgaacttcagctgacttgttacttaaaaattgtgaattctgttgttgtgataaatatgagcaaatgaagtgtaatatctatagaaaagtagagtgagggtgaatttatatatatattttgttttgccaatatgaagaaaaagaggccttatttcttaactgtgctgggattgcaaacactttttaaaaaattgtttgcttgaaaatactactgaatataaataagaatgtgcacagtagtttttttattgaaacttgtattatttttaaagagatctatactataaatatggtgatatatttacaagtaatctgttaagatatactatttgagagggacagattagccttttagtaactatagtcactactttttccataatgcataagggatataaactctgtgtgtgtgtgtgtgtgtgtgtgtgtgtgtgtgtgtgtgtgtatatatatatatatatttttacttttatcctcttaccgaaggttacactgttgtgcctgtttgtctgcaatgctgtttatattttgggtgatgaaataggagtttcctagctatataaaccagattactcacccatgcatatagtaagaactaatgaataatcaaaataatttcatcaacttttagaatattttatgttgcttgcactataggagtcataaaaggaacttagttaaaatatgttggattgttaaacatttggggaaatatgaactgtattttaaatttgttaggtctgaagaatctaaaactgttaatttaacccttaacttgtgcctagaaactacagcacatataaaatatgtaaacaccagcctgttgctgtacttttctgcttattttacagcctcaaatatttctcattatcttgtcacttagttcttcatgtttctccttctgacttttaataatggtaataggaaaacaaaacccaaagcttttcagaacttcagtgtgaggtttcctattttgacaagttaacttgtaaatactcaggttttacgatgtataatttacctaatagaccaaactaactcatggagatattttgaactattatttaggtacaaactttataaagaatgttagtatgtcataaaatataacattacagcttatttaaaaccaaatatagttgaacatatttaaaatacattttcacagaatggatgaattagttgtttcttcagagttacttatgaacagttgaatgctttaaaatgttctgtctgtaggtaacatctaaaacacaagtgggtttatttaaatttttaaaatttgaaattttttatttgcaaaaaattgttttatgctttattatatcgcaaatgagtgtcagatttttgagtaccaatgatcatgcttccattttttttagttttaaaccaccaaaccaatatttttcctttaaattttaatcttataatatagaaatcttatgtaaatgaaattttgtcatgtttcaaataaagagaactgaagtagaaaatagaaatgccagtaaacaacataatgtttaatttacaacttacattaggggtttgggggaatgctaattatatattgagaatatacattagaactcttcaaaatgggctcttctaatgaggtcactactgaacaaaattgttccctcttctgttaaatagaataggtttaaatgactagtcaaatgaattattttcttcttgttaaataaattaaatcttactttcttttaatgaccaaccttaggtaaaacaaaaatattgtaatcctagaaattatcctccagctttctcacctgaaaatctattgaagtgatccctggtcatcctaataatgggatgagggaagtttccagcagatttcaggctgttcttaaagtttttgttggtcattttctcaatagtacatgaaatcaagatgcttatgagcatggaaatgtatttaaagtttttgcttgtgtcctcctcagtcagaatagaaaagtaactgaaatacttttacctttctgtccttgataaaatagtaaagaaaaccaaacaaacccaggcctgatgggaaaaatgattcctttattctagcaacttactttctgttggtatgggaaatgttattaatttctattactaaagttcatatcacaaaatgatatttaataataaccttggggtaaatcatgaattttttttctacgtgtgagtataaaagacaaaagttgaacagcatggaatctcattgccaaattattagtgaatgtatagttcaggtattctttgagacacacagtatcattaatttctgaattgtatttcagtgttattttttgtttgtgaccactaagcttctgtcttaatacaaagctgttaccttctacagaatttaagtctgaagatgtaaagagagaacaggccttgtgtaacagaagatactcttttttatgctccttactgtgatcacagaaaaattaaaaatccaagtgctctctagatttgttgataaacattttatgcttgcatttaaacttgaaatgtatgagcagaatgagacaatcagttaaatcagaaatgagaagtattataatgtaaaggccttgttttgctgtagcaataaaatgaccaagtgcaatgacttgatttaataaaatcatattttaaaagttgctgctatgaatatttttggctataaaattttaccctgacttgctttcaataactgttacgtaatgcagttgatgttgtaacctaacattccaaaaaaaaaattgagagggggaatctcaaaatagtatatacttcactaacttgtttacaggtgctgtatttaaaagcatgcttctctctcaaaaagaaaaattaaaggattttattgccagtcgtgtcagtctttattggttattttttgttaactttagcatttgtgtatttcagagtatgatgaaaattatattacttcaatttccaaatacaagaataaatagtaaaccaaaaacattaaaaa

SEQ ID NO: 5073 - DNA, 2293 bp, Homo sapiens
aaaggcggtctagatgtgcagaaggtgcaagccagagctcaggcagaacttccagagtgcatctgggatctgcatttgccactggttgcagatcaggcggacgaggagccgggaaggcagagccatgtggctgccccctgctctgctccttctcagcctctcaggctgtttctccatccaaggcccagagtctgtgagagccccagagcaggggtccctgacggttcaatgccactataagcaaggatgggagacctacattaagtggtggtgccgaggggtgcgctgggatacatgcaagatcctcattgaaaccagagggtcggagcaaggagagaagagtgaccgtgtgtccatcaaggacaatcagaaagaccgcacgttcactgtgaccatggaggggctcaggcgagatgacgcagatgtttactggtgtgggattgaaagaagaggacctgaccttgggactcaagtgaaagtgatcgttgacccagagggagcggcttccacaacagcaagctcacctaccaacagcaatatggcagtgttcatcggctcccacaagaggaaccactacatgctcctggtatttgtgaaggtgcccatcttgctcatcttggtcactgccatcctctggttgaaggggtctcagagggtccctgaggagccaggggaacagcctatctacatgaacttctccgaacctctgactaaagacatggccacttagagagatggatctgcagagccttcctgccctggccacgtttccagaagagactcgggctgtggaaggaacatctacgagtcctcgggatgcagtgactgagataggggccctgggcctccgccctggccttggagctggtgggcacctccctgttctgcacagctcagggacttagccaggtcctctcctgagccaccatcacctcctggggtgccagcacctgttctcttggtcaggagctgtagagatggagctcaagcactggacgactctgtccccactgctggaataactcgggcacagagcatgggaccaaagtacagaaagaggttgggggagacccccccagccctagacttccatcattccggagaccaactcaacaccgtctttgcctgagaacctgatatatccgtgtttttaaatttttttttttctagcaaagttgggttttaatgacttatgttcataggaaacctctctgatcccacacacaaggagggtgattctgggatgagttcctggttctagggcatgaggggctggatggaccctgtccccagggaggacatggctctgagtccacagggctgaggaggcaatgggaacctccctggcccggcccggtgcttgtcctccccctcccacctcttcctcctcctagctccccaagctccctgcctattcccccacctccgaggggctgcagcttgggagcctcctcagcatgacagcttgggtctcctccccaaaagagcctgtcaggcctcaagaaccacctccaggtggggagggcagtaacgaaaaccatcgcaggaaatggcaccctcccttttcggtgatgttgaaatcatgttactaatgaaaactgtcctagggaagtggttctgtctcctcacaggcttcacccacggcgatgaggcccttgaatgtggtcactttgtgctgtatggttgagggaccctcacaccaaagggaccttcccatgtgagatgtgctcccgcccccacctgcccacaagcaaacacaccacacatgttcggcatgttgccctttgaacacccatgaggacgcctccaacctgctcttggttctaatagggagtactgactgtcagcagtggataaaggagaggggaccctctggtccctagcatggcacccagagcctcccctcttcttgtccttcagccaaagagaaactttctctgactttgaactgaatttaggtctctggccaatgatgggcctgaaaattccataatggccagagaggagagttcgagcccggctaagatcccctgagtcattctgtgagggaccaagacccacagtccaccagccccagggccctacctcctggaatgctttcctggatccagcttcccgaagatccgaccagacccagggaggacggcaccgctccgcgggagggaaagccaaagcatggtgcttcaccagctggactcaggggcgaggggacatgggcgcttgtcaacgtgatgtcattcttttcccaccgtttcttcctgttgatattcaatgaatccgtcaatctctctgg

SEQ ID NO: 5074 - DNA, 2286 bp, Homo sapiens
tctagatgtgcagaaggtgcaagccagagctcaggcagaacttccagagtgcatctgggatctgcatttgccactggttgcagatcaggcggacgaggagccgggaaggcagagccatgtggctgccccctgctctgctccttctcagcctctcaggctgtttctccatccaaggcccagagtctgtgagagccccagagcaggggtccctgacggttcaatgccactataagcaaggatgggagacctacattaagtggtggtgccgaggggtgcgctgggatacatgcaagatcctcattgaaaccagagggtcggagcaaggagagaagagtgaccgtgtgtccatcaaggacaatcagaaagaccgcacgttcactgtgaccatggaggggctcaggcgagatgacgcagatgtttactggtgtgggattgaaagaagaggacctgaccttgggactcaagtgaaagtgatcgttgacccagagggagcggcttccacaacagcaagctcacctaccaacagcaatatggcagtgttcatcggctcccacaagaggaaccactacatgctcctggtatttgtgaaggtgcccatcttgctcatcttggtcactgccatcctctggttgaaggggtctcagagggtccctgaggagccaggggaacagcctatctacatgaacttctccgaacctctgactaaagacatggccacttagagagatggatctgcagagccttcctgccctggccacgtttccagaagagactcgggctgtggaaggaacatctacgagtcctcgggatgcagtgactgagataggggccctgggcctccgccctggccttggagctggtgggcacctccctgttctgcacagctcagggacttagccaggtcctctcctgagccaccatcacctcctggggtgccagcacctgttctcttggtcaggagctgtagagatggagctcaagcactggacgactctgtccccactgctggaataactcgggcacagagcatgggaccaaagtacagaaagaggttgggggagacccccccagccctagacttccatcattccggagaccaactcaacaccgtctttgcctgagaacctgatatatccgtgtttttaaatttttttttttctagcaaagttgggttttaatgacttatgttcataggaaacctctctgatcccacacacaaggagggtgattctgggatgagttcctggttctagggcatgaggggctggatggaccctgtccccagggaggacatggctctgagtccacagggctgaggaggcaatgggaacctccctggcccggcccggtgcttgtcctccccctcccacctcttcctcctcctagctccccaagctccctgcctattcccccacctccgaggggctgcagcttgggagcctcctcagcatgacagcttgggtctcctccccaaaagagcctgtcaggcctcaagaaccacctccaggtggggagggcagtaacgaaaaccatcgcaggaaatggcaccctcccttttcggtgatgttgaaatcatgttactaatgaaaactgtcctagggaagtggttctgtctcctcacaggcttcacccacggcgatgaggcccttgaatgtggtcactttgtgctgtatggttgagggaccctcacaccaaagggaccttcccatgtgagatgtgctcccgcccccacctgcccacaagcaaacacaccacacatgttcggcatgttgccctttgaacacccatgaggacgcctccaacctgctcttggttctaatagggagtactgactgtcagcagtggataaaggagaggggaccctctggtccctagcatggcacccagagcctcccctcttcttgtccttcagccaaagagaaactttctctgactttgaactgaatttaggtctctggccaatgatgggcctgaaaattccataatggccagagaggagagttcgagcccggctaagatcccctgagtcattctgtgagggaccaagacccacagtccaccagccccagggccctacctcctggaatgctttcctggatccagcttcccgaagatccgaccagacccagggaggacggcaccgctccgcgggagggaaagccaaagcatggtgcttcaccagctggactcaggggcgaggggacatgggcgcttgtcaacgtgatgtcattcttttcccaccgtttcttcctgttgatattcaatgaatccgtcaatctctctgga

SEQ ID NO: 5075 - DNA, 1805 bp, Homo sapiens
aagttcaagggcgagagtgagtaccagcagaaggctgggagtctgtagtttgttcctgctgccaggctccactgaggggaacggggacctgtctgaagagaagatgcccctgctgacactctacctgctcctcttctggctctcaggctactccattgtcactcaaatcaccggtccaacaacagtgaatggcttggagcggggctccttgaccgtgcagtgtgtttacagatcaggctgggagacctacttgaagtggtggtgtcgaggagctatttggcgtgactgcaagatccttgttaaaaccagtgggtcagagcaggaggtgaagagggaccgggtgtccatcaaggacaatcagaaaaaccgcacgttcactgtgaccatggaggatctcatgaaaactgatgctgacacttactggtgtggaattgagaaaactggaaatgaccttggggtcacagttcaagtgaccattgacccagcaccagtcacccaagaagaaactagcagctccccaactctgaccggccaccacttggacaacaggagtgagggttcccaggctgcaaactacagacctgcagctcatcaggcacaagctcctgaagctcagtgtcctcctgcccctcatcttcaccatattgctgctgcttttggtggccgcctcactcttggcttggaggatgatgaagtaccagcagaaagcagccgggatgtccccagagcaggtactgcagcccctggagggcgacctctgctatgcagacctgaccctgcagctggccggaacctccccgcaaaaggctaccacgaagctttcctctgcccaggttgaccaggtggaagtggaatatgtcaccatggcttccttgccgaaggaggacatttcctatgcatctctgaccttgggtgctgaggatcaggaaccgacctactgcaacatgggccacctcagtagccacctccccggcaggggccctgaggagcccacggaatacagcaccatcagcaggccttagcctgcactccaggctccttcttggaccccaggctgtgagcacactcctgcctcatcgaccgtctgccccctgctcccctcatcaggaccaacccggggactggtgcctctgcctgatcagccagcattgcccctagctctgggttgggcttggggccaagtctcagggggcttctaggagttggggttttctaaacgtcccctcctctcctacatagttgaggagggggctagggatatgctctggggctttcatgggaatgatgaagatgataatgagaaaaatgttatcattattatcatgaagtaccattatcgtaatacaatgaacctttatttattgcctaccacatgttatgggctgaataatggcccccaaagatatctgtgtcctaatcctcagaacctgtgactgttaccttctgtggcagaaagggacagtgcagatgtatgtaagttaaggactttgagatagagaggttattcttgctgattcaggtgggcccaaaatatcaccacaagggtcctcataagaaagaggccagaaggtcaaagaggtagagacaaagtgatgatggaagtggacgtgggtgtgacgtgagcaggggccatgaatgccgcagccttcagatgccagaaagggaaaggaatggattcccctgcctggagcctccaaaagaaaccagccctgcccacgccttgacttgagcccattgaaactgatcttgagctcctggcctccagaattgcaggagaataaatttgtgttgtttttaatgagcca

SEQ ID NO: 5076 - DNA, 1764 bp, Homo sapiens
tgaaggaggaagttcaagggcgagagtgagtaccagcagaaggctgggagtctgtagtttgttcctgctgccaggctccactgaggggaacggggacctgtctgaagagaagatgcccctgctgacactctacctgctcctcttctggctctcaggctactccattgtcactcaaatcaccggtccaacaacagtgaatggcttggagcggggctccttgaccgtgcagtgtgtttacagatcaggctgggagacctacttgaagtggtggtgtcgaggagctatttggcgtgactgcaagatccttgttaaaaccagtgggtcagagcaggaggtgaagagggaccgggtgtccatcaaggacaatcagaaaaaccgcacgttcactgtgaccatggaggatctcatgaaaactgatgctgacacttactggtgtggaattgagaaaactggaaatgaccttggggtcacagttcaagtgaccattgacccagcaccagtcacccaagaagaaactagcagctccccaactctgaccggccaccacttggacaacaggcacaagctcctgaagctcagtgtcctcctgcccctcatcttcaccatattgctgctgcttttggtggccgcctcactcttggcttggaggatgatgaagtaccagcagaaagcagccgggatgtccccagagcaggtactgcagcccctggagggcgacctctgctatgcagacctgaccctgcagctggccggaacctccccgcaaaaggctaccacgaagctttcctctgcccaggttgaccaggtggaagtggaatatgtcaccatggcttccttgccgaaggaggacatttcctatgcatctctgaccttgggtgctgaggatcaggaaccgacctactgcaacatgggccacctcagtagccacctccccggcaggggccctgaggagcccacggaatacagcaccatcagcaggccttagcctgcactccaggctccttcttggaccccaggctgtgagcacactcctgcctcatcgaccgtctgccccctgctcccctcatcaggaccaacccggggactggtgcctctgcctgatcagccagcattgcccctagctctgggttgggcttggggccaagtctcagggggcttctaggagttggggttttctaaacgtcccctcctctcctacatagttgaggagggggctagggatatgctctggggctttcatgggaatgatgaagatgataatgagaaaaatgttatcattattatcatgaagtaccattatcgtaatacaatgaacctttatttattgcctaccacatgttatgggctgaataatggcccccaaagatatctgtgtcctaatcctcagaacctgtgactgttaccttctgtggcagaaagggacagtgcagatgtatgtaagttaaggactttgagatagagaggttattcttgctgattcaggtgggcccaaaatatcaccacaagggtcctcataagaaagaggccagaaggtcaaagaggtagagacaaagtgatgatggaagtggacgtgggtgtgacgtgagcaggggccatgaatgccgcagccttcagatgccagaaagggaaaggaatggattcccctgcctggagcctccaaaagaaaccagccctgcccacgccttgacttgagcccattgaaactgatcttgagctcctggcctccagaattgcaggagaataaatttgtgttgtttttaatga

SEQ ID NO: 5077 - DNA, 1552 bp, Homo sapiens
atgtggctgcctcagctcgacctcatgagggtcatcagtgctaagagtcaaggctactccattgtcactcaaatcaccggtccaacaacagtgaatggcttggagcggggctccttgaccgtgcagtgtgtttacagatcaggctgggagacctacttgaagtggtggtgtcgaggagctatttggcgtgactgcaagatccttgttaaaaccagtgggtcagagcaggaggtgaagagggaccgggtgtccatcaaggacaatcagaaaaaccgcacgttcactgtgaccatggaggatctcatgaaaactgatgctgacacttactggtgtggaattgagaaaactggaaatgaccttggggtcacagttcaagtgaccattgacccagcaccagtcacccaagaagaaactagcagctccccaactctgaccggccaccacttggacaacagcagccgggatgtccccagagcaggtactgcagcccctggagggcgacctctgctatgcagacctgaccctgcagctggccggaacctccccgcaaaaggctaccacgaagctttcctctgcccaggttgaccaggtggaagtggaatatgtcaccatggcttccttgccgaaggaggacatttcctatgcatctctgaccttgggtgctgaggatcaggaaccgacctactgcaacatgggccacctcagtagccacctccccggcaggggccctgaggagcccacggaatacagcaccatcagcaggccttagcctgcactccaggctccttcttggaccccaggctgtgagcacactcctgcctcatcgaccgtctgccccctgctcccctcatcaggaccaacccggggactggtgcctctgcctgatcagccagcattgcccctagctctgggttgggcttggggccaagtctcagggggcttctaggagttggggttttctaaacgtcccctcctctcctacatagttgaggagggggctagggatatgctctggggctttcatgggaatgatgaagatgataatgagaaaaatgttatcattattatcatgaagtaccattatcgtaatacaatgaacctttatttattgcctaccacatgttatgggctgaataatggcccccaaagatatctgtgtcctaatcctcagaacctgtgactgttaccttctgtggcagaaagggacagtgcagatgtatgtaagttaaggactttgagatagagaggttattcttgctgattcaggtgggcccaaaatatcaccacaagggtcctcataagaaagaggccagaaggtcaaagaggtagagacaaagtgatgatggaagtggacgtgggtgtgacgtgagcaggggccatgaatgccgcagccttcagatgccagaaagggaaaggaatggattcccctgcctggagcctccaaaagaaaccagccctgcccacgccttgacttgagcccattgaaactgatcttgagctcctggcctccagaattgcaggagaataaatttgtgttgtttttaatgagcca

SEQ ID NO: 5078 - DNA, 1687 bp, Homo sapiens
atgtggctgcctcagctcgacctcatgagggtcatcagtgctaagagtcaaggctactccattgtcactcaaatcaccggtccaacaacagtgaatggcttggagcggggctccttgaccgtgcagtgtgtttacagatcaggctgggagacctacttgaagtggtggtgtcgaggagctatttggcgtgactgcaagatccttgttaaaaccagtgggtcagagcaggaggtgaagagggaccgggtgtccatcaaggacaatcagaaaaaccgcacgttcactgtgaccatggaggatctcatgaaaactgatgctgacacttactggtgtggaattgagaaaactggaaatgaccttggggtcacagttcaagtgaccattgacccagcgtcgactcctgcccccaccacgcctacctccactacgtttacagcaccagtcacccaagaagaaactagcagctccccaactctgaccggccaccacttggacaacaggcacaagctcctgaagctcagtgtcctcctgcccctcatcttcaccatattgctgctgcttttggtggccgcctcactcttggcttggaggatgatgaagtaccagcagaaaggtactgcagcccctggagggcgacctctgctatgcagacctgaccctgcagctggccggaacctccccgcaaaaggctaccacgaagctttcctctgcccaggttgaccaggtggaagtggaatatgtcaccatggcttccttgccgaaggaggacatttcctatgcatctctgaccttgggtgctgaggatcaggaaccgacctactgcaacatgggccacctcagtagccacctccccggcaggggccctgaggagcccacggaatacagcaccatcagcaggccttagcctgcactccaggctccttcttggaccccaggctgtgagcacactcctgcctcatcgaccgtctgccccctgctcccctcatcaggaccaacccggggactggtgcctctgcctgatcagccagcattgcccctagctctgggttgggcttggggccaagtctcagggggcttctaggagttggggttttctaaacgtcccctcctctcctacatagttgaggagggggctagggatatgctctggggctttcatgggaatgatgaagatgataatgagaaaaatgttatcattattatcatgaagtaccattatcgtaatacaatgaacctttatttattgcctaccacatgttatgggctgaataatggcccccaaagatatctgtgtcctaatcctcagaacctgtgactgttaccttctgtggcagaaagggacagtgcagatgtatgtaagttaaggactttgagatagagaggttattcttgctgattcaggtgggcccaaaatatcaccacaagggtcctcataagaaagaggccagaaggtcaaagaggtagagacaaagtgatgatggaagtggacgtgggtgtgacgtgagcaggggccatgaatgccgcagccttcagatgccagaaagggaaaggaatggattcccctgcctggagcctccaaaagaaaccagccctgcccacgccttgacttgagcccattgaaactgatcttgagctcctggcctccagaattgcaggagaataaatttgtgttgtttttaatgagcca

SEQ ID NO: 5079 - DNA, 3741 bp, Homo sapiens
ctctccggccgcgcagccgctgccgcccacccgcacccgccgtcatgctccgggccgcgctgcccgcgctcctgctgccgttgctgggcctcgccgctgctgccgtcgcggactgtccttcatctacttggattcagttccaagacagttgttacatttttctccaagaagccatcaaagtagaaagcatagaggatgtcagaaatcagtgtactgaccatggagcggacatgataagcatacataatgaagaagaaaatgcttttatactggatactttgaaaaagcaatggaaaggcccagatgatatcctactaggcatgttttatgacacagatgatgcgagtttcaagtggtttgataattcaaatatgacatttgataagtggacagaccaagatgatgatgaggatttagttgacacctgtgcttttctgcacatcaagacaggtgaatggaaaaaaggaaattgtgaagtttcttctgtggaaggaacactatgcaaaacagctatcccatacaaaaggaaatatttatcagataaccacattttaatatcagcattggtgattgctagcacggtaattttgacagttttgggagcaatcatttggttcctgtacaaaaaacattctgattctcgtttcaccacagttttttcaaccgcaccccaatcaccttataatgaagactgtgttttggtagttggagaagaaaatgaatatcctgttcaatttgactaagtttttggtaatcttgcactaagacatcaacaaaatgccctggcagagataacttgggaaagattttaatataaaacttgacattggatattagagctttaatggtattccttattccagtaacatttttatgtactcatctgctgtgaaaagtctttaggttcattaaaaaaacaggttttagaaatgatcttagatctaatatagtgattttaagcatcccgtcaaaggcagaatctgtcacttgaatgaaggaaagcttaaagcccaagcagataaaaataaaagcccagcctatttgtcttgcctgctgtatcttccctatttagttgacccactttagtttatatgtttattagtaaacatgaaatggggaataagtgattttaagtacatcccatacatttaaatatctttgataattgttatttttttggcagataattcctctagaatgtgtatctttttatgatttagatgaagaaaattttacaacttttaacaccccacaccaattttagtttcattacttttacacacaccattttatcacaaatgactcaagttttaatgaatgtttataaattatttgaaacaaaatatgatcgctgtgtccaggatggcatagagaaagctggcaattaggttaacacttacatattatagtgcccctttaaggatttctctcttgccaccataccttttgtactttcccctatacaagatgtatctcattctcctcaagcatttataaatttttccttcaatgacatgaaaactgtgcaagcaaaaaccgaagaaaaacacttaagtacaactgtagtgacagtgatcaaagttttcagtgcatttattgtacattttaagaaaaaggtgaaaatcatttggggagtaaaaaaatgaaaaagctgaaacgagtaattttcctcaccatcaataaaccaaaaacaggaaagataaagaatgtataaatttcacgtaaattagtcacgtatcacttatcaatggggatacgttctaagaaatgcatagttagggaatcttgtgtgaaaatcagcttgtatttacacaaacccagatggtagagcctattttgtcccaaacctacacagcatgttactgtgctgaatactgcagacaattgtaacacaatatttgtgtatctaaatatagaaaaggtacagtaaaaatatggtctactaaggaaacactgttctatatgtggtccattactgactgaagtatactgtctagaagtctgaggctcaaagaaaagtaatccctcttctgaatccacaccccatcaattatcttactttcttctggggagatagatagatatactatctcactagcttgactaatggcaacaaagttccagcttgtgtagtctctttttattgaccacatgaatcgaaaacactcatcacaattaatggcactatcattaatgagacatgagtaactaaaaagtgatagaaaactattaacagtgcggctacatggtactgaaaatgcaggcattacaccagctgttacacaagcacaagcatgctctgtaagagctttacatttctgagattttgtatagtgattgagatgtctattttattattgatagactattactaatgtcaatattgaacactaccctggaattcctgcctggttttcctacccaaattgtaccactccttgaagaactacaggcacagtaaaaaaaatatggcgtattatgtgaactaaaagagttctaaaggagttcttaaaggagtggtagaatttgggtaggaaagtgattaagtccaacttaaaaccaacagtctcaaacgtctacaactacaatgtccaatgagccactagccacatgaggctatttaagtaaatttagtttaaaatccagttttcgaattacattagccacattgtcaagtgttcaaatcacaggtggttagtggctactgtactgggcaacatacattatagaacattttcattataggaagttttattgggcagtgctgctcttaaatcctaccttccactcaactcccatacaactttcttttgtacattttgatactttctacctaatggcagctcttccaaaatagctgctttaaactctgatttaattttcaatatttggtttcatttttcaacaggccaagaggcctctggtaatgaagtgctatatatatatatatgatggagtctcactgtgctgcccaggctacagtgcagtggctcgatcttggctctctccaatctccgccttgcaggttttcaagcaattctcctgcctcagcctccttagtagctgggaccacagacatctgtcaccacacccagctaactttttgtatttttggtagagacggggtttcgccatattgactgggctggtctcaaactcctgacctcaagtgatccacccaccttggtctcccaaagtgctgggattacatgcgtgagccaccacacttggcctacattttttctttatataccagaacatctataacaggcaccttatctactcattagtgaagagataattggattacacaggcaggcttgtttactacatccagaatgtagaaactgctttcttcaacatcttggttctagctagtaataacaatataattctttggcagatattcagaataacattttaaactacattttcttagaaaattgcattcttgtagtgagcagtgtatggtctcttttgttcagaatttaaaactgataaccaatgaaagccttttctcttattcctctaccgtcatttacatgataatctgaagctaatatgacaatatttaaatactaagtggtactagggaactacaagaatactgtaaagcttaagccattgttatcactgtcatttagcatttaataacaaaactatacagaattatgtgcataccaatgaatgttttgtaccatctagttaaattttttaaataaagttttatgggttaagcag

SEQ ID NO: 5080 - DNA, 831 bp, Homo sapiens
ctctccggccgcgcagccgctgccgcccacccgcacccgccgtcatgctccgggccgcgctgcccgcgctcctgctgccgttgctgggcctcgccgctgctgccgtcgcggactgtccttcatctacttggattcagttccaagacagttgttacatttttctccaagaagccatcaaagtagaaagcatagaggatgtcagaaatcagtgtactgaccatggagcggacatgataagcatacataatgaagaagaaaatgcttttatactggatactttgaaaaagcaatggaaaggcccagatgatatcctactaggcatgttttatgacacagatgtcccatacaaaaggaaatatttatcagataaccacattttaatatcagcattggtgattgctagcacggtaattttgacagttttgggagcaatcatttggttcctgtacaaaaaacattctgattctcgtttcaccacagttttttcaaccgcaccccaatcaccttataatgaagactgtgttttggtagttggagaagaaaatgaatatcctgttcaatttgactaagtttttggtaatcttgcactaagacatcaacaaaatgccctggcagagataacttgggaaagattttaatataaaacttgacattggatattagagctttaatggtattccttattccagtaacatttttatgtactcatctgctgtgaaaagtctttaggttcattaaaaaaacaggttttagaaatgatcttagatctaatatagtgattttaagcatcccgtcaaaggcagaatctgtcacttgaatgaaggaaagctt

SEQ ID NO: 5081 - DNA, 1251 bp, Homo sapiens
gtgcgcgtgcgcagggataagagagcggtctggacagcgcgtggccggcgccgctgtggggacagcatgagcggcggttggatggcgcaggttggagcgtggcgaacaggggctctgggcctggcgctgctgctgctgctcggcctcggactaggcctggaggccgccgcgagcccgctttccaccccgacctctgcccaggccgcaggccccagctcaggctcgtgcccacccaccaagttccagtgccgcaccagtggcttatgcgtgcccctcacctggcgctgcgacagggacttggactgcagcgatggcagcgatgaggaggagtgcaggattgagccatgtacccagaaagggcaatgcccaccgccccctggcctcccctgcccctgcaccggcgtcagtgactgctctgggggaactgacaagaaactgcgcaactgcagccgcctggcctgcctagcaggcgagctccgttgcacgctgagcgatgactgcattccactcacgtggcgctgcgacggccacccagactgtcccgactccagcgacgagctcggctgtggaaccaatgagatcctcccggaaggggatgccacaaccatggggccccctgtgaccctggagagtgtcacctctctcaggaatgccacaaccatggggccccctgtgaccctggagagtgtcccctctgtcgggaatgccacatcctcctctgccggagaccagtctggaagcccaactgcctatggggttattgcagctgctgcggtgctcagtgcaagcctggtcaccgccaccctcctccttttgtcctggctccgagcccaggagcgcctccgcccactggggttactggtggccatgaaggagtccctgctgctgtcagaacagaagacctcgctgccctgaggacaagcacttgccaccaccgtcactcagccctgggcgtagccggacaggaggagagcagtgatgcggatgggtacccgggcacaccagccctcagagacctgagctcttctggccacgtggaacctcgaacccgagctcctgcagaagtggccctggagattgagggtccctggacactccctatggagatccggggagctaggatggggaacctgccacagccagaactgaggggctggccccaggcagctcccagggggtagaacggccctgtgcttaagacactcctgctgccccgtctgagggtggcaattaaagttgcttcacatcctc

SEQ ID NO: 5082 - DNA, 676 bp, Homo sapiens
aatgagatcctcccggaaggggatgccacaaccatggggccccctgtgaccctggagagtgtcacctctctcaggaatgccacaaccatggggccccctgtgaccctggagagtgtcccctctgtcgggaatgccatcctcctctgccggagaccagtctggaagcccaactgcctatggggttattgcagctgctgcggtgctcagtgcaagcctggtcaccgccaccctcctccttttgtcctggctccgagcccaggagcgcctccgcccactggggttactggtggccatgaaggagtccctgctgctgtcagaacagaagacctcgctgccctgaggacaagcacttgccaccaccgtcactcagccctgggcgtagccggacaggaggagagcagtgatgcggatgggtacccgggcacaccagccctcagagacctgagctcttctggccacgtggaacctcgaacccgagctcctgcagaagtggccctggagattgagggtccctggacactccctatggagatccggggagctaggatggggaacctgccacagccagaactgaggggctggccccaggcagctcccagggggtagaacggccctgtgcttaagacactcctgctgccccgtctgagggtggcaattaaagttgcttcacatcctc

SEQ ID NO: 5083 - DNA, 1125 bp, Homo sapiens
gtgcgcgtgcgcagggataagagagcggtctggacagcgcgtggccggcgccgctgtggggacagcatgagcggcggttggatggcgcaggttggagcgtggcgaacaggggctctgggcctggcgctgctgctgctgctcggcctcggactaggcctggaggccgccgcgagcccgctttccaccccgacctctgcccaggccgcagggattgagccatgtacccagaaagggcaatgcccaccgccccctggcctcccctgcccctgcaccggcgtcagtgactgctctgggggaactgacaagaaactgcgcaactgcagccgcctggcctgcctagcaggcgagctccgttgcacgctgagcgatgactgcattccactcacgtggcgctgcgacggccacccagactgtcccgactccagcgacgagctcggctgtggaaccaatgagatcctcccggaaggggatgccacaaccatggggccccctgtgaccctggagagtgtcacctctctcaggaatgccacaaccatggggccccctgtgaccctggagagtgtcccctctgtcgggaatgccacatcctcctctgccggagaccagtctggaagcccaactgcctatggggttattgcagctgctgcggtgctcagtgcaagcctggtcaccgccaccctcctccttttgtcctggctccgagcccaggagcgcctccgcccactggggttactggtggccatgaaggagtccctgctgctgtcagaacagaagacctcgctgccctgaggacaagcacttgccaccaccgtcactcagccctgggcgtagccggacaggaggagagcagtgatgcggatgggtacccgggcacaccagccctcagagacctgagctcttctggccacgtggaacctcgaacccgagctcctgcagaagtggccctggagattgagggtccctggacactccctatggagatccggggagctaggatggggaacctgccacagccagaactgaggggctggccccaggcagctcccagggggtagaacggccctgtgcttaagacactcctgctgccccgtctgagggtggcaattaaagttgcttcacatcctc

SEQ ID NO: 5084 - DNA, 1466 bp, Homo sapiens
tctgctcacacaggaagccctggaagctgcttcctcagacatgccgctgctgctactgctgcccctgctgtgggcaggggccctggctatggatccaaatttctggctgcaagtgcaggagtcagtgacggtacaggagggtttgtgcgtcctcgtgccctgcactttcttccatcccataccctactacgacaagaactccccagttcatggttactggttccgggaaggagccattatatccagggactctccagtggccacaaacaagctagatcaagaagtacaggaggagactcagggcagattccgcctccttggggatcccagtaggaacaactgctccctgagcatcgtagacgccaggaggagggataatggttcatacttctttcggatggagagaggaagtaccaaatacagttacaaatctccccagctctctgtgcatgtgacagacttgacccacaggcccaaaatcctcatccctggcactctagaacccggccactccaaaaacctgacctgctctgtgtcctgggcctgtgagcagggaacacccccgatcttctcctggttgtcagctgcccccacctccctgggccccaggactactcactcctcggtgctcataatcaccccacggccccaggaccacggcaccaacctgacctgtcaggtgaagttcgctggagctggtgtgactacggagagaaccatccagctcaacgtcacctatgttccacagaacccaacaactggtatctttccaggagatggctcagggaaacaagagaccagagcaggagtggttcatggggccattggaggagctggtgttacagccctgctcgctctttgtctctgcctcatcttcttcatagtgaagacccacaggaggaaagcagccaggacagcagtgggcaggaatgacacccaccctaccacagggtcagcctccccgaaacaccagaagaagtccaagttacatggccccactgaaacctcaagctgttcaggtgccgcccctactgtggagatggatgaggagctgcattatgcttccctcaactttcatgggatgaatccttccaaggacacctccaccgaatactcagaggtcaggacccagtgaggaacccacaagagcatcaggctcagctagaagatccacatcctctacaggtcggggaccaaaggctgattcttggagatttaacaccccacaggcaatgggtttatagacattatgtgagtttcctgctatattaacatcatcttagactttgcaagcagagagtcgtggaatcaaatctgtgctctttcatttgctaagtgtatgatgtcacacaagctccttaaccttccatgtctccattttcttctctgtgaagtaggtataagaagtcctatctcatagggatgctgtgagcattaaataaaggtacacatggaaaacaccagtc

SEQ ID NO: 5085 - DNA, 1108 bp, Homo sapiens
tctgctcacacaggaagccctggaagctgcttcctcagacatgccgctgctgctactgctgcccctgctgtgggcaggggccctggctatggatccaaatttctggctgcaagtgcaggagtcagtgacggtacaggagggtttgtgcgtcctcgtgccctgcactttcttccatcccataccctactacgacaagaactccccagttcatggttactggttccgggaaggagccattatatccagggactctccagtggccacaaacaagctagatcaagaagtacaggaggagactcagggcagattccgcctccttggggatcccagtaggaacaactgctccctgagcatcgtagacgccaggaggagggataatggttcatacttctttcggatggagagaggaagtaccaaatacagttacaaatctccccagctctctgtgcatgtgacagacttgacccacaggcccaaaatcctcatccctggcactctagaacccggccactccaaaaacctgacctgctctgtgtcctgggcctgtgagcagggaacacccccgatcttctcctggttgtcagctgcccccacctccctgggccccaggactactcactcctcggtgctcataatcaccccacggccccaggaccacggcaccaacctgacctgtcaggtgaagttcgctggagctggtgtgactacggagagaaccatccagctcaacgtcacctatgttccacagaacccaacaactggtatctttccaggagatggctcagggaaacaagagaccagagcaggagtggttcatggggccattggaggagctggtgttacagccctgctcgctctttgtctctgcctcatcttcttcatagtgaagacccacaggaggaaagcagccaggacagcagtgggcaggaatgacacccaccctaccacagggtcagcctccccggtacgttgaggccaacagatcaggagatgatggccattgaaaagatagtttcttggccgggcacagtgtttcacacctgcaatcccagcacctttggaggccaaggcgggcggatcacgaggtcaggagattgagactatcctg

SEQ ID NO: 5086 - DNA, 1085 bp, Homo sapiens
tctgctcacacaggaagccctggaagctgcttcctcagacatgccgctgctgctactgctgcccctgctgtgggcagacttgacccacaggcccaaaatcctcatccctggcactctagaacccggccactccaaaaacctgacctgctctgtgtcctgggcctgtgagcagggaacacccccgatcttctcctggttgtcagctgcccccacctccctgggccccaggactactcactcctcggtgctcataatcaccccacggccccaggaccacggcaccaacctgacctgtcaggtgaagttcgctggagctggtgtgactacggagagaaccatccagctcaacgtcacctatgttccacagaacccaacaactggtatctttccaggagatggctcagggaaacaagagaccagagcaggagtggttcatggggccattggaggagctggtgttacagccctgctcgctctttgtctctgcctcatcttcttcatagtgaagacccacaggaggaaagcagccaggacagcagtgggcaggaatgacacccaccctaccacagggtcagcctccccgaaacaccagaagaagtccaagttacatggccccactgaaacctcaagctgttcaggtgccgcccctactgtggagatggatgaggagctgcattatgcttccctcaactttcatgggatgaatccttccaaggacacctccaccgaatactcagaggtcaggacccagtgaggaacccacaagagcatcaggctcagctagaagatccacatcctctacaggtcggggaccaaaggctgattcttggagatttaacaccccacaggcaatgggtttatagacattatgtgagtttcctgctatattaacatcatcttagactttgcaagcagagagtcgtggaatcaaatctgtgctctttcatttgctaagtgtatgatgtcacacaagctccttaaccttccatgtctccattttcttctctgtgaagtaggtataagaagtcctatctcatagggatgctgtgagcattaaataaaggtacacatggaaaacaccagtc

SEQ ID NO: 5087 - DNA, 1494 bp, Homo sapiens
actcccttcctcttttctgctcacacaggaagccctggaagctgcttcctcagacatgccgctgctgctactgctgcccctgctgtgggcagacttgacccacaggcccaaaatcctcatccctggcactctagaacccggccactccaaaaacctgacctgctctgtgtcctgggcctgtgagcagggaacacccccgatcttctcctggttgtcagctgcccccacctccctgggccccaggactactcactcctcggtgctcataatcaccccacggccccaggaccacggcaccaacctgacctgtcaggtgaagttcgctggagctggtgtgactacggagagaaccatccagctcaacgtcacctatgttccacagaacccaacaactggtatctttccaggagatggctcagggaaacaagagaccagagcaggagtggttcatggggccattggaggagctggtgttacagccctgctcgctctttgtctctgcctcatcttcttcatagtgaagacccacaggaggaaagcagccaggacagcagtgggcaggaatgacacccaccctaccacagggtcagcctccccggtgagtgatggggcatcctggcatccagtctgtcctgcagacacctcctcccaatgtggcccaccgtcatgccccattcagcatttccagaactgagcttattgtctttcctcctgtttaacagtgtaggttttaatatttttcaggtacgttgaggccaacagatcaggagatgatggccattgaaaagatagtttcttggccgggcacagtgtttcacacctgcaatcccagcacctttggaggccaaggcgggcggatcacgaggtcaggagattgagactatcctggctaacatggtgaaaccccgtctctactaaaaatacaaaaaattagccagatgtggtggctggcgcctgtagtcccagctacttgggaggctgaggcaggagaatggtatgaacccgggaggcagagcttgtagtgagccgacatagcaccactgcactccagcctgggtgacagagagagactctgtcccaaaaagaaaaaaaaaatagtttcttattcaccgttcccgagagggcacaccacaccatgcaaggccatatggagaagcaccagggtcagtcaggaagcagagggagcaaggagaaaatgggacaagagccttcactgtggctttcatggaaaagaatgggcaagacagggtaagcaagctaggcaggtttaggattggctacttagaacaatttcagcagactctggggtataggagttgtctctagttgtctggtacatggccctgggtttattaaggaggattgtggtctggagtgtaagagctcaataaaggatccagctggtagtgtgggctttagattgactggtttgcacatgaaaggtgcacttgtatgcaagtcctttattagctctagaaatctactatccttggg

SEQ ID NO: 5088 - DNA, 2094 bp, Homo sapiens
aacttgtgttaggcatgcgtccgaagagctggaaggctgaggatgtcaatggctttcagatgtcaggataaccttaaggatagatgaagggttgagagcctgtgcctcatttctgagttctcagctgctatgccgtggaaatcctgtttactttctgcatctgctcctgcaagactctggagccagtcttgaggtcctacatctccgaaagcaagctcttctagaagttgatagctttccaatgattagacgaattgattctttctgtgactcatcagttcatttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataagtaagtatgtaccaaaaaatattgcttcaataatattagcttatatattacttgttttcactttatcaaagagaagttacatattaggccatatatatttctagacatgtctagccactgatcatttttaaatataggtaaataaacctataaatattatcacgcagatcactaaagtatatctttaattctgggagaaatgagataaaagatgtacttgtgaccattgtaacaatagcacaaataaagcacttgtgccaaa

SEQ ID NO: 5089 - DNA, 1942 bp, Homo sapiens
atttgatcctattaagaattgtccaaatgttggagcatttgattgaaaaatccttcttagccattttaaagatagctttccaatgattagacgaattgattctttctgtgactcatcagttcatttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataagtaagtatgtaccaaaaaatattgcttcaataatattagcttatatattacttgttttcactttatcaaagagaagttacatattaggccatatatatttctagacatgtctagccactgatcatttttaaatataggtaaataaacctataaatattatcacgcagatcactaaagtatatctttaattctgggagaaatgagataaaagatgtacttgtgaccattgtaacaatagcacaaataaagcacttgtgccaaagttgtcc

SEQ ID NO: 5090 - DNA, 855 bp, Homo sapiens
gagagttctccttagataagatttcaatatgttaatcatgtgtagaaagaaaattaaaaaggaggaatatgaagaaattcagatatgacattattagttctgccactggtaggcattagaagcaagaaaagggagacggaccgaggaagccactttgaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatcct

SEQ ID NO: 5091 - DNA, 1686 bp, Homo sapiens
atgacattattagttctgccactggtaggcattagaagcaagaaaagggagacggaccgaggaagccactttggtgaaacaaaaagaaaagcatttgtttatttagaacgggcaaaatgatacgtttcagtgggtgttttctttgtactttgatctttttgtactgatatttaagcttctgttttatgatctctttctaatgatagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattg

SEQ ID NO: 5092 - DNA, 565 bp, Homo sapiens
aagttgctgagacaagggaagagagatgaggaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatct

SEQ ID NO: 5093 - DNA, 541 bp, Homo sapiens
ttgctatggcaacccaatttattagtgactgcaaaactaacttagctggcattgtggcaaatctccatattttgctgatagctttccaatgattagacgaattgattctttctgtgactcatcagttcatttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacag

SEQ ID NO: 5094 - DNA, 1808 bp, Homo sapiens
aagttgctgagacaagggaagagagatgaggaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataagtaagtatgtaccaaaaaatattgcttcaataatattagcttatatattacttgttttcactttatcaaagagaagttacatattaggccatatatatttctagacatgtctagccactgatcatttttaaatataggtaaataaacctataaatattatcacgcagatcactaaagtatatctttaattctgggagaaatgagataaaagatgtacttgtgaccattgtaacaatagcacaaataaagcacttgtgccaaagttgtcc

SEQ ID NO: 5095 - DNA, 1421 bp, Homo sapiens
accagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataagtaagtatgtaccaaaaaatattgcttcaat

SEQ ID NO: 5096 - DNA, 2365 bp, Homo sapiens
gattgcatggagacactcaggagcacaaattgcaccacggggttagtccatcacggggttagtccatccaaaagcaaggaggcagcctttggtacccctgtgccagtcaatattcattaaagggcagttttttcaaggaagtcggagctagctgctggacactaacagtcaaatctcaaaggagctgggagagaaatgcacaagcagacagggtcttgctctgttgcccaggctggagtgcagtggcgccatcacagctgctgcaacctcaacctcccaagctcaagtgaatctcccacctcagcctcccaagtagctgggactacagcaaggtttccaagaattacgttggtaggcattcaactggcatcctctggaggtaaccagatgcccagctgctcctggaggggacatatggaagtgggctcataggcggaagggacttgccttgtctcatatgaaactttggactgtggacttttgagttaacgctgaaatgagatagctttccaatgattagacgaattgattctttctgtgactcatcagttcatttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataagtaagtatgtaccaaaaaatattgcttcaataatattagcttatatattacttgttttcactttatcaaagagaagttacatattaggccatatatatttctagacatgtctagccactgatcatttttaaatataggtaaataaacctataaatattatcacgcagatcactaaagtatatctttaattctgggagaaatgagataaaagatgtacttgtgaccattgtaacaatagcacaaataaagcacttgtgccaaa

SEQ ID NO: 5097 - DNA, 536 bp, Homo sapiens
attcctggcatggtcacagtgactactgtgacttgtttgagaggtgactttgaacatttattttactttcagatagctttccaatgattagacgaattgattctttctgtgactcatcagttcatttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacag

SEQ ID NO: 5098 - DNA, 720 bp, Homo sapiens
ggcaaacacaaccagagtcttcggtgttaattccctggtcttcccaactagcattctgaaagtgcattaacatttgtggccttgtgctctttcatcggacttctaatgatagctttccaatgattagacgaattgattctttctgtgactcatcagttcatttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggca

SEQ ID NO: 5099 - DNA, 2298 bp, Homo sapiens
atttgatcctattaagaattgtccaaatgttggagcatttgattgaaaaatccttcttagccattttaaagatagctttccaatgattagacgaattgattctttctgtgactcatcagttcatttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataaacctggctcaagcacaaaccaatttgtgttgttctgattcaataattggtttctgggtggccaattcagaagaagagtgtacatgctcaacaaatcctaggccctgcattcctgtcatcctcatccgggggaaacaccatcatcccagtagctgccctattcaactgcaacagtctccaggaccatcagtatactgcatttcatgtgcaccaaatattttgaaagacatttataaataattggcttatgactcatatttctctatgaataccttcatacagcaggtataactcttttctttatgggcttaaatattttgtcactgatcctgcaaatggacatcattttagcacactagcggtttatattttaaggaccttcattctctgttctgcacctcttctggaaattgagtaaattttgcttttttttttttactcagttgcaacttacgcttggcatcttcagaatgcttttctagcattaagagatgtaaatgataaaggaattattgtatgaaatattacaaagcgtagactatgcattgttattcattataatattttttgctgtcataatcgcctcataaagacaggtttcaaccattaaaatatgttcttcctta

SEQ ID NO: 5100 - DNA, 569 bp, Homo sapiens
gactgcagtgtaggactttcctgcagaataccatttgatcctattaagaattgtccaaatgttggagcatttgattgaaaaatccttcttagccattttaaagactcattagtgaaccagaacaataaaccaaacagagaaccatcagataatgggttagcctgggaagaatattaattacaactggagatagctttccaatgattagacgaattgattctttctgtgactcatcagttcatttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttg

SEQ ID NO: 5101 - DNA, 1741 bp, Homo sapiens
agatgtcaggataaccttaaggatagatgaagggttgagagcctgtgcctcatttctgagttctcagctgctatgccgtggaaatcctgtttactttctgcatctgctcctgcaagactctggagccagtcttgaggtcctacatctccgaaagcaagctcttctagaagttgcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataagtaagtatgtaccaaaaaatattgcttcaataatattagcttatatattacttgttttcactttatcaaagagaagttacatattaggccatatatatttctagacatgtctagccactgatcatttttaaatataggtaaataaacctataaatattatcacgcagatcactaaagtatatctttaattctgggagaaatgagataaaagatgtacttgtgaccattgtaacaatagcacaaataaagcacttgtgccaaagttgtcc

SEQ ID NO: 5102 - DNA, 1364 bp, Homo sapiens
agaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcatacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataagtaagtatgtaccaaaaaatattgcttcaataat

SEQ ID NO: 5103 - DNA, 1353 bp, Homo sapiens
agaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataagtaagtatgtaccaaaaaatattgcttcaat

SEQ ID NO: 5104 - DNA, 1241 bp, Homo sapiens
ttcctttctctctcagctctccgtctctctttctctctcagcctctttctttctccctgtctcccccactgtcagcacctcttctgtgtggtgagtggaccgcttaccccactaggtgaagatgtcagcccaggagagctgcctcagcctcatcaagtacttcctcttcgttttcaacctcttcttcttcgtcctcggcagcctgatcttctgcttcggcatctggatcctcattgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgagctcgggttcatgacgctctcgatattcctgtgcagaaacctggaccacgtctacaaccggctcgctcgataccgttaggccccgccctccccaaagtcccgccccgcccccgtcacgtgcgctgggcacttccctgctgcctgtaaatatttgtttaatccccagttcgcctggagccctccgccttcacattcccctggggacccacgtggctgcgtgcccctgctgctgtcacctctcccacgggacctggggctttcgtccacagcttcctgtccccatctgtcggcctaccaccacccacaagattatttttcacccaaacctcaaataaatcccctgcgtttttggt

SEQ ID NO: 5105 - DNA, 1588 bp, Homo sapiens
atgcccagaggtgggttccagtagatcaggggtccctttagatcccccagcgcctgagacatggagacctgggagggactgccccatgagtccttggtgcccacaaattccaaggcccctcagcacctcttctgtgtggtgagtggaccgcttaccccactaggtgaagatgtcagcccaggagagctgcctcagcctcatcaagtacttcctcttcgttttcaacctcttcttcttcgtcctcggcagcctgatcttctgcttcggcatctggatcctcattgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagaaagacacaccgacctggaccaagggagacaggcataaacagctccaaagggaaacacacgggaaaaagagagaacaagagaaagaaatagacgccctgaaagaagagacagagacttatgagccgtagaaatagtggaagaaacagaaagacagacctgaagtacacagagctagccattcagtaaggatttgagactggcccagagatgcacagggcccgcctgaggctggcacagcctgagagggggaggggtggggcggggaagataaggcccagcctcactggtggcctctcagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgagctcgggttcatgacgctctcgatattcctgtgcagaaacctggaccacgtctacaaccggctcgctcgataccgttaggccccgccctccccaaagtcccgccccgcccccgtcacgtgcgctgggcacttccctgctgcctgtaaatatttgtttaatccccagttcgcctggagccctccgccttcacattcccctggggacccacgtggctgcgtgcccctgctgctgtcacctctcccacgggacctggggctttcgtccacagcttcctgtccccatctgtcggcctaccaccacccacaagattatttttcacccaaacctcaaataaatcccctgcgtttttggt

SEQ ID NO: 5106 - DNA, 1207 bp, Homo sapiens
ttcctttctctctcagctctccgtctctctttctctctcagcctctttctttctccctgtctcccccactgtcagcacctcttctgtgtggtgagtggaccgcttaccccactaggtgaagatgtcagcccaggagagctgcctcagcctcatcaagtcctcggcagcctgatcttctgcttcggcatctggatcctcattgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgagctcgggttcatgacgctctcgatattcctgtgcagaaacctggaccacgtctacaaccggctcgctcgataccgttaggccccgccctccccaaagtcccgccccgcccccgtcacgtgcgctgggcacttccctgctgcctgtaaatatttgtttaatccccagttcgcctggagccctccgccttcacattcccctggggacccacgtggctgcgtgcccctgctgctgtcacctctcccacgggacctggggctttcgtccacagcttcctgtccccatctgtcggcctaccaccacccacaagattatttttcacccaaacctcaaataaatcccctgcgtttttggt

SEQ ID NO: 5107 - DNA, 1571 bp, Homo sapiens
actaggtgaagatgtcagcccaggagagctgcctcagcctcatcaagtacttcctcttcgttttcaacctcttcttcttcgtcctcggcagcctgatcttctgcttcggcatctggatcctcattgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgaggtgatctggccccgcccccacccgcgatcggccctaaatccctagatggccctgcccttcatttcgcgtccttcggttgcctgggaaggacgagctcagggcggagcgcagcccaccccggccctcccgccgctccacccagcaccggagggtgggggcggcccagcttcagggagccctgattgggtgtacgcagggaaagcctcctgctattggctgcgatctccctcccctttctccgcagatgactgtcatggtgctgagcgtacagctacagcgcagggcactccgccggaaatgcgagccgcacgtgccgggcgctggggattcgagccccgggcccagcctgatcgctgacggcggcggcgggcacagcggcagtctgtggggtggctggggcatggcgggtgcctgccccaactggggagacaaggcaccgcagggcaagctgcccatggccctggggctctggccgctgtgggttcaagacgaggaccagcctgacactggaagtgcgggcgcagaattagaggaggcacaattagaggctgaggcagagggggaagacagatgagcctccaaaataaaggaccctgggcttgcttccgaccttactccttctcagcctctacccccacttgtagcagctattcccgcctcatcagccagccctgcggcagttcccgtcgagccccgcccttttctacctatccccttctccagccccttcccgcccaattcacggccccacccctgacctttctcgcccgggtgggcatcacccccgtctcg

SEQ ID NO: 5108 - DNA, 1884 bp, Homo sapiens
gggggtgggaagggaaacagagaaaaggcaagtgaaacagaaggggaggtgcagtttcagaacccagccagcctctctcttgctgcctagcctcctgccggcctcatcttcgcccagccaaccccgcctggagccctatggccaactgcgagttcagcccggtgtccggggacaaaccctgctgccggctctctaggagagcccaactctgtcttggcgtcagtatcctggtcctgatcctcgtcgtggtgctcgcggtggtcgtcccgaggtggcgccagcagtggagcggtccgggcaccaccaagcgctttcccgagaccgtcctggcgcgatgcgtcaagtacactgaaattcatcctgagatgagacatgtagactgccaaagtgtatgggatgctttcaagggtgcatttatttcaaaacatccttgcaacattactgaagaagactatcagccactaatgaagttgggaactcagaccgtaccttgcaacaagattcttctttggagcagaataaaagatctggcccatcagttcacacaggtccagcgggacatgttcaccctggaggacacgctgctaggctaccttgctgatgacctcacatggtgtggtgaattcaacacttccaaaataaactatcaatcttgcccagactggagaaaggactgcagcaacaaccctgtttcagtattctggaaaacggtttcccgcaggtttgcagaagctgcctgtgatgtggtccatgtgatgctcaatggatcccgcagtaaaatctttgacaaaaacagcacttttgggagtgtggaagtccataatttgcaaccagagaaggttcagacactagaggcctgggtgatacatggtggaagagaagattccagagacttatgccaggatcccaccataaaagagctggaatcgattataagcaaaaggaatattcaattttcctgcaagaatatctacagacctgacaagtttcttcagtgtgtgaaaaatcctgaggattcatcttgcacatctgagatctgagccagtcgctgtggttgttttagctccttgactccttgtggtttatgtcatcatacatgactcagcatacctgctggtgcagagctgaagattttggagggtcctccacaataaggtcaatgccagagacggaagcctttttccccaaagtcttaaaataacttatatcatcagcatacctttattgtgatctatcaatagtcaagaaaaattattgtataagattagaatgaaaattgtatgttaagttacttcactttaattctcatgtgatccttttatgttatttatatattggtaacatcctttctattgaaaaatcaccacaccaaacctctcttattagaacaggcaagtgaagaaaagtgaatgctcaagtttttcagaaagcattacatttccaaatgaatgaccttgttgcatgatgtatttttgtacccttcctacagatagtcaaaccataaacttcatggtcatgggtcatgttggtgaaaattattctgtaggatataagctacccacgtacttggtgctttaccccaacccttccaacagtgctgtgaggttggtattatttcattttttagatgagaaaatgggagctcagagaggttatatatttaagttggtgcaaaagtaattgcaagttttgccaccgaaaggaatggcaaaaccacaattatttttgaaccaacctaataatttaccgtaagtcctacatttagtatcaagctagagactgaatttgaactcaactctgtccaactccaaaattcatgtgctttttccttctaggcctttcataccaaactaatagtagtttatattctcttccaacaaatgc

SEQ ID NO: 5109 - DNA, 1357 bp, Homo sapiens
agtgaaacagaaggggaggtgcagtttcagaacccagccagcctctctcttgctgcctagcctcctgccggcctcatcttcgcccagccaaccccgcctggagccctatggccaactgcgagttcagcccggtgtccggggacaaaccctgctgccggctctctaggagagcccaactctgtcttggcgtcagtatcctggtcctgatcctcgtcgtggtgctcgcggtggtcgtcccgaggtggcgccagcagtggagcggtccgggcaccaccaagcgctttcccgagaccgtcctggcgcgatgcgtcaagtacactgaaattcatcctgagatgagacatgtagactgccaaagtgtatgggatgctttcaagggtgcatttatttcaaaacatccttgcaacattactgaagaagactatcagccactaatgaagttgggaactcagaccgtaccttgcaacaagaatgaaactatcaatcttgcccagactggagaaaggactgcagcaacaaccctgtttcagtattctggaaaacggtttcccgcaggtttgcagaagctgcctgtgatgtggtccatgtgatgctcaatggatcccgcagtaaaatctttgacaaaaacagcacttttgggagtgtggaagtccataatttgcaaccagagaaggttcagacactagaggcctgggtgatacatggtggaagagaagattccagagacttatgccaggatcccaccataaaagagctggaatcgattataagcaaaaggaatattcaattttcctgcaagaatatctacagacctgacaagtttcttcagtgtgtgaaaaatcctgaggattcatcttgcacatctgagatctgagccagtcgctgtggttgttttagctccttgactccttgtggtttatgtcatcatacatgactcagcatacctgctggtgcagagctgaagattttggagggtcctccacaataaggtcaatgccagagacggaagcctttttccccaaagtcttaaaataacttatatcatcagcatacctttattgtgatctatcaatagtcaagaaaaattattgtataagattagaatgaaaattgtatgttaagttacttcactttaattctcatgtgatccttttatgttatttatatattggtaacatcctttctattgaaaaatcaccacaccaaacctctcttattagaacaggcaagtgaagaaaagtgaatgctcaagtttttcagaaagcattacatttccaaatgaatgaccttgttgcatgatgtatttttgtacccttcctacagatagtcaaaccataaacttcatggtcatgggtca

SEQ ID NO: 5110 - DNA, 1548 bp, Homo sapiens
gctaaatgtcatgtatttttcatggcccctccaggtattgtcagagtcctcttgtttggccttctaggaaggctgtgggacccagctttcttcaaccagtccaggtggaggcctctgccttgaacgtttccaagtgaggtaaaacccgcaggcccagaggcctctctacttcctgtgtggggttcagaaaccctcctcccctcccagcctcaggtgcctgcttcagaaaatgaagtagtaagtctgctggcctccgccatcttagtaaagtaacagtcccatgaaacaaagatgcagtcgggcactcactggagagttctgggcctctgcctcttatcagttggcgtttgggggcaagatggtaatgaagaaatgggtggtattacacagacaccatataaagtctccatctctggaaccacagtaatattgacatgccctcagtatcctggatctgaaatactatggcaacacaatgataaaaacataggcggtgatgaggatgataaaaacataggcagtgatgaggatcacctgtcactgaaggaattttcagaattggagcaaagtggttattatgtctgctaccccagaggaagcaaaccagaagatgcgaacttttatctctacctgagggcaagagtgtgtgagaactgcatggagatggatgtgatgtcggtggccacaattgtcatagtggacatctgcatcactgggggcttgctgctgctggtttactactggagcaagaatagaaaggccaaggccaagcctgtgacacgaggagcgggtgctggcggcaggcaaaggggacaaaacaaggagaggccaccacctgttcccaacccagactatgagcccatccggaaaggccagcgggacctgtattctggcctgaatcagagacgcatctgaccctctggagaacactgcctcccgctggcccaggtctcctctccagtccccctgcgactccctgtttcctgggctagtcttggaccccacgagagagaatcgttcctcagcctcatggtgaactcgcgccctccagcctgatcccccgctccctcctccctgccttctctgctggtacccagtcctaaaatattgctgcttcctcttcctttgaagcatcatcagtagtcacaccctcacagctggcctgccctcttgccaggatatttatttgtgctattcactcccttccctttggatgtaacttctccgttcagttccctccttttcttgcatgtaagttgtcccccatcccaaagtattccatctacttttctatcgccgtccccttttgcagccctctctggggatggactgggtaaatgttgacagaggccctgccccgttcacagatcctggccctgagccagccctgtgctcctccctcccccaacactccctaccaaccccctaatcccctactccctccaccccccctccactgtaggccactggatggtcatttgcatctccgtaaatgtgctctgctcctcagctgagagagaaaaaaataaactgtatttggctgcaaga

SEQ ID NO: 5111 - DNA, 1289 bp, Homo sapiens
gtaagtctgctggcctccgccatcttagtaaagtaacagtcccatgaaacaaagatgcagtcgggcactcactggagagttctgggcctctgcctcttatcagttggcgtttgggggcaagatggtaatgaagaaatggcatataaagtctccatctctggaaccacagtaatattgacatgccctcagtatcctggatctgaaatactatggcaacacaatgataaaaacataggcggtgatgaggatgataaaaacataggcagtgatgaggatcacctgtcactgaaggaattttcagaattggagcaaagtggttattatgtctgctaccccagaggaagcaaaccagaagatgcgaacttttatctctacctgagggcaagagtgtgtgagaactgcatggagatggatgtgatgtcggtggccacaattgtcatagtggacatctgcatcactgggggcttgctgctgctggtttactactggagcaagaatagaaaggccaaggccaagcctgtgacacgaggagcgggtgctggcggcaggcaaaggggacaaaacaaggagaggccaccacctgttcccaacccagactatgagcccatccggaaaggccagcgggacctgtattctggcctgaatcagagacgcatctgaccctctggagaacactgcctcccgctggcccaggtctcctctccagtccccctgcgactccctgtttcctgggctagtcttggaccccacgagagagaatcgttcctcagcctcatggtgaactcgcgccctccagcctgatcccccgctccctcctccctgccttctctgctggtacccagtcctaaaatattgctgcttcctcttcctttgaagcatcatcagtagtcacaccctcacagctggcctgccctcttgccaggatatttatttgtgctattcactcccttccctttggatgtaacttctccgttcagttccctccttttcttgcatgtaagttgtcccccatcccaaagtattccatctacttttctatcgccgtccccttttgcagccctctctggggatggactgggtaaatgttgacagaggccctgccccgttcacagatcctggccctgagccagccctgtgctcctccctcccccaacactccctaccaaccccctaatcccctactccctccaccccccctccactgtaggccactggatggtcatttgcatctccgtaaatgtgctctgctcctcagctgagagagaaaaaaataaactgtatttggctgc

SEQ ID NO: 5112 - DNA, 1179 bp, Homo sapiens
agtctagctgctgcacaggctggctggctggctggctgctaagggctgctccacgcttttgccggaggacagagactgacatggaacaggggaagggcctggctgtcctcatcctggctatcattcttcttcaaggtactttggcccagtcaatcaaaggaaaccacttggttaaggtgtatgactatcaagaagatggttcggtacttctgacttgtgatgcagaagccaaaaatatcacatggtttaaagatgggaagatgatcggcttcctaactgaagataaaaaaaaatggaatctgggaagtaatgccaaggaccctcgagggatgtatcagtgtaaaggatcacagaacaagtcaaaaccactccaagtgtattacagaacttcagacaagcagactctgttgcccaatgaccagctctaccagcccctcaaggatcgagaagatgaccagtacagccaccttcaaggaaaccagttgaggaggaattgaactcaggactcagagtagtccaggtgttctcctcctattcagttcccagaatcaaagcaatgcattttggaaagctcctagcagagagactttcagccctaaatctagactcaaggttcccagagatgacaaatggagaagaaaggccatcagagcaaatttgggggtttctcaaataaaataaaaataaaaacaaatactgtgtttcagaagcgccacctattggggaaaattgtaaaagaaaaatgaaaagatcaaataaccccctggatttgaatataattttttgtgttgtaatttttatttcgtttttgtataggttataattcacatggctcaaatattcagtgaaagctctccctccaccgccatcccctgctacccagtgaccctgttgccctcttcagagacaaattagtttctcttttttttttttttttttttttttttgagacagtctggctctgtcacccaggctgaaatgcagtggcaccatctcggctcactgcaacctctgcctcctgggttcaagcgattctcctgcctcagcctcccgggcagctgggattacaggcacacactaccacacctggctaatttttgtatttttagtagagacagggttttgctctgttggccaagctggtctcgaactcctgacctcaagtgatccgcccgcctc

SEQ ID NO: 5113 - DNA, 2678 bp, Homo sapiens
gcacaggctggctggctggctggctgctaagggctgctccacgcttttgccggaggacagagactgacatggaacaggggaagggcctggctgtcctcatcctggctatcattcttcttcaaggtactttggcccagtcaatcaaaggaaaccacttggttaaggtgtatgactatcaagaagatggttcggtacttctgacttgtgatgcagaagccaaaaatatcacatggtttaaagatgggaagatgatcggcttcctaactgaagataaaaaaaaatggaatctgggaagtaatgccaaggaccctcgagggatgtatcagtgtaaaggatcacagaacaagtcaaaaccactccaagtgtattacagaatgtgtcagaactgcattgaactaaatgcagccaccatatctggctttctctttgctgaaatcgtcagcattttcgtccttgctgttggggtctacttcattgctggacaggatggagttcgccagtcgagagcttcagacaagcagactctgttgcccaatgaccagctctaccagcccctcaaggatcgagaagatgaccagtacagccaccttcaaggaaaccagttgaggaggaattgaactcaggactcagagtagtccaggtgttctcctcctattcagttcccagaatcaaagcaatgcattttggaaagctcctagcagagagactttcagccctaaatctagactcaaggttcccagagatgacaaatggagaagaaaggccatcagagcaaatttgggggtttctcaaataaaataaaaataaaaacaaatactgtgtttcagaagcgccacctattggggaaaattgtaaaagaaaaatgaaaagatcaaataaccccctggatttgaatataattttttgtgttgtaatttttatttcgtttttgtataggttataattcacatggctcaaatattcagtgaaagctctccctccaccgccatcccctgctacccagtgaccctgttgccctcttcagagacaaattagtttctcttttttttttttttttttttttttttgagacagtctggctctgtcacccaggctgaaatgcagtggcaccatctcggctcactgcaacctctgcctcctgggttcaagcgattctcctgcctcagcctcccgggcagctgggattacaggcacacactaccacacctggctaatttttgtatttttagtagagacagggttttgctctgttggccaagctggtctcgaactcctgacctcaagtgatccgcccgcctcagcctcccaaagtgctgggattacaggtgtgagccaccatgcctggtcttaaaaccagtttcttatatatctctctggaggtattctaggcatatatgagcacattctcaagtacatattatcctcccttcccctatcttttagacaaatgatatcaaactatacatcttgtgagattattgcataccattatatgaagataccattatatcctttttaatgcaaccatattgtacaaatagactatgatttatttaacctgttatctatcagtggatatttaagttggtagttggttccaatcttttgctcttacaacaattctgcaatgactaacattgtataaatatcatttttaaaaataattgcattgaagcataatgtacatgccataaaatccacccatcttaagtgatttcacctgttctcagaaatttttagtaaatttaactaattgtacagccattaccataatccagctttaggacattttcttttttttcttttcttttcttttttttcttttttttttttttttgaagtggaatcttgctctgtggcccaggctggagtgcagtggcgcgatctcagctcactgcaacctccacctcctgggttcaagcgattctcttgccttggcctcccgagtagctgagactacaggcacatgccaccacgcccagctcattttttgtgtatttagtatttgtgtatctagtatttgtgtacttagtagagacagggtttcaccatgttggccaggctggtctccaattcctgacctcaggcgatccacccgccttgacctcccaaagtgctgggattacaggtgtgagccaccgcgccaggcccgtaactgtattttaatatagccattctatggatttaatatggtattttattatggccttaatttgcatttccctagatactaaccatgctgagtgtcctgtcttgtgtttattaaccattcatatatttttagtgaaatgtgtatcaaatcttttgcccatttttaagttgacttatttgtttgtcttcttactattgggttgcatatgtttttgatataagtcctttatcagatatatgatttggaaatattttctaccaatctgtggtttgtttttcttaatggtgtcttttgaagtgcaaaaggtttgaattttgaagtacattttattgattttttcttctatatattgtgcttttggtatcatgtctaataaatctttaccaaacccacagttacaaagattttctcctgtcttctttttatactttttacagctttatggttttagctctaacaataaatgtgattttgaacatacataagactatttgtaacaaacacaaataaattgaattgttgggca

SEQ ID NO: 5114 - DNA, 3278 bp, Homo sapiens
gctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgctgcctccatctagtacaaaacctccagctttgagtcattcagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 5115 - DNA, 3124 bp, Homo sapiens
gctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggtcctaggcctacttacaagcctccagtctcaaattatccaggatatcctaaacctgaggaaggaatacttgacagtttggatgtttgggtcattgctgtgattgttattgccataggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 5116 - DNA, 3233 bp, Homo sapiens
gctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 5117 - DNA, 3188 bp, Homo sapiens
gctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 5118 - DNA, 3371 bp, Homo sapiens
gctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgctgcctccatctagtacaaaacctccagctttgagtcattcagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaaggcacatacctaactgatgagacccacagagaagtaaaatttacttctctctgagaaggagagatgagagaaaggtttgcttttatcattaaaaggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 5119 - DNA, 3081 bp, Homo sapiens
gcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggaga

SEQ ID NO: 5120 - DNA, 3236 bp, Homo sapiens
gctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgctgcctccatctagtacaaaacctccagctttgagtcattcagtgtcgacttcttccactacaaaatctccagcgtccagtgcctcaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 5121 - DNA, 3281 bp, Homo sapiens
gctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaaggcacatacctaactgatgagacccacagagaagtaaaatttacttctctctgagaaggagagatgagagaaaggtttgcttttatcattaaaaggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 5122 - DNA, 3326 bp, Homo sapiens
gctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaaggcacatacctaactgatgagacccacagagaagtaaaatttacttctctctgagaaggagagatgagagaaaggtttgcttttatcattaaaaggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 5123 - DNA, 3089 bp, Homo sapiens
gctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccggagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgctgcctccatctagtacaaaacctccagctttgagtcattcagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 5124 - DNA, 3169 bp, Homo sapiens
gctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccataggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 5125 - DNA, 1258 bp, Homo sapiens
tatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttca

SEQ ID NO: 5126 - DNA, 1793 bp, Homo sapiens
caactgtctcctgcgttgctgggaagttctggaaggaagcatgtgctccagaggttgggattcgtgtctggctctggaattgctactgctgcctctgtcactcctggtgaccagcattcaaggtcacttggtacatatgaccgtggtctccggcagcaacgtgactctgaacatctctgagagcctgcctgagaactacaaacaactaacctggttttatactttcgaccagaagattgtagaatgggattccagaaaatctaagtactttgaatccaaatttaaaggcagggtcagacttgatcctcagagtggcgcactgtacatctctaaggtccagaaagaggacaacagcacctacatcatgagggtgttgaaaaagactgggaatgagcaagaatggaagatcaagctgcaagtgcttggtgagtcaggggagccaaagagcaaatccccactccagtggccccagatggaccactgtagggcttcctgggaggcatggggcactctcggggaggaggagagaaaaacctcaggacaggtttgattcatttttccttgatccaattctatttgggagtgagcctaggtcaacagatatccaaattaacaatcttaggacatttaacacctcttctgaagttagtgagtctaagctttgaagagaaggaaaactagagatttttcctatttccttcattttgtcctgtgatcaacctaaatcagctcagctcatcttgattatatctccgaaattaggcttcattggacttaagaaaaaagagaatgtattaatataaagaatggggcaggagttatcaggagaatttttcaactttcataatgggcaggacaaaaaaacttccactcatagctccagtctaaccagtgtatatggaataaggactcaggcattatacctggagccagacagacttgggttcaaaactggtcagttgctcactagctgtgcagccttgaaaaaagatcttcacatctctgtgcccatattaggtaagattcttttgatagcaaataacagaaactaattcaatgtacctttaccaaaaaaggagaatttagtttaagaaactagggctatttaaagcaattcaaagagtttaaaagagctaggaagggcttaaggggagaagattgaaaaccaggttcgggccagaacccctagcttcaggaatctgtggactgtgcctatggatttggattcctgccattttacacatgttatctctcaaaacttagacttttgctcctctgagtttcaattctcagggcaatttaaagagagagaaactgatagtcccaatttagttcaggtgtgtgtacctgatctaaacatttttggtgaaaggatcagattatagggcagaaacatggatatggggaggggctccaggggttggggtatgcaattcttgtagaagagcggggctaaataatccaagagtggtgttcccttgagagccttgggttcttcatcatattatgagaataattctacttacctttcaggatgttattagagtcaaagtagataaggaaagtgaaaacattttttaaaatgtcaaaacatgcaaatgaagagtgttgtatacattcaagttccaccagccagacagtccctgatccaagcagtcagattccccttctaactcttcttccatgtcatatgggctgaaaattcagaaagtcctgggaacaaaaagattcaaggtctcttacagtggtgttctggttaacaagctctacaagatttaaaaaaaaaaaaaaaa

SEQ ID NO: 5127 - DNA, 1126 bp, Homo sapiens
gtttggtaagttccgtttttagccccggcctttttctagccaggctctcaactgtctcctgcgttgctgggaagttctggaaggaagcatgtgctccagaggttgggattcgtgtctggctctggaattgctactgctgcctctgtcactcctggtgaccagcattcaaggtcacttggtacatatgaccgtggtctccggcagcaacgtgactctgaacatctctgagagcctgcctgagaactacaaacaactaacctggttttatactttcgaccagaagattgtagaatgggattccagaaaatctaagtactttgaatccaaatttaaaggcagggtcagacttgatcctcagagtggcgcactgtacatctctaaggtccagaaagaggacaacagcacctacatcatgagggtgttgaaaaagactgggaatgagcaagaatggaagatcaagctgcaagtgcttgaccctgtacccaagcctgtcatcaaaattgagaagatagaagacatggatgacaactgttatctgaaactgtcatgtgtgatacctggcgagtctgtaaactacacctggtatggggacaaaaggcccttcccaaaggagctccagaacagtgtgcttgaaaccacccttatgccacataattactccaggtgttatacttgccaagtcagcaattctgtgagcagcaagaatggcacggtctgcctcagtccaccctgtaccctggcccggtcctttggagtagaatggattgcaagttggctagtggtcacggtgcccaccattcttggcctgttacttacctgagatgagctcttttaactcaagcgaaacttcaaggccagaagatcttgcctgttggtgatcatgctcctcaccaggacagagactgtataggctgaccagaagcatgctgctgaattatcaacgaggattttcaagttaacttttaaatactggttattatttaattttatatccctttgttgttttctagtacacagagatatagagatacacatgcttttttcccacccaaaattgtgacaacattatgtgaatgttttattattttttaaaataaacatttgatataattgtcaattaactgaa

SEQ ID NO: 5128 - DNA, 2191 bp, Homo sapiens
ctcctcttaacatacttgcagctaaaactaaatattgctgcttggggacctccttctagccttaaatttcagctcatcaccttcacctgccttggtcatggctctgctattctccttgatccttgccatttgcaccagacctggattcctagcgtctccatctggagtgcggctggtggggggcctccaccgctgtgaagggcgggtggaggtggaacagaaaggccagtggggcaccgtgtgtgatgacggctgggacattaaggacgtggctgtgttgtgccgggagctgggctgtggagctgccagcggaacccctagtggtattttgtatgagccaccagcagaaaaagagcaaaaggtcctcatccaatcagtcagttgcacaggaacagaagatacattggctcagtgtgagcaagaagaagtttatgattgttcacatgatgaagatgctggggcatcgtgtgagaacccagagagctctttctccccagtcccagagggtgtcaggctggctgacggccctgggcattgcaagggacgcgtggaagtgaagcaccagaaccagtggtataccgtgtgccagacaggctggagcctccgggccgcaaaggtggtgtgccggcagctgggatgtgggagggctgtactgactcaaaaacgctgcaacaagcatgcctatggccgaaaacccatctggctgagccagatgtcatgctcaggacgagaagcaacccttcaggattgcccttctgggccttgggggaagaacacctgcaaccatgatgaagacacgtgggtcgaatgtgaagatccctttgacttgagactagtaggaggagacaacctctgctctgggcgactggaggtgctgcacaagggcgtatggggctctgtctgtgatgacaactggggagaaaaggaggaccaggtggtatgcaagcaactgggctgtgggaagtccctctctccctccttcagagaccggaaatgctatggccctggggttggccgcatctggctggataatgttcgttgctcaggggaggagcagtccctggagcagtgccagcacagattttgggggtttcacgactgcacccaccaggaagatgtggctgtcatctgctcaggatagtatcctggtgttgcttgacctggcccccctggccccgcctgccctctgcttgttctcctgagccctgattatcctcatactcattctggggctcaggcttgagccactactccctcatcccctcaggagtctgaacactgggcttatgccttactctcagggacaagcagcccccattgctgcctgtagatgtgagctgttgagttccctcttgctggggaagatgagcttccatgtatcctgtgctcaaccctgaccctttgacactggttctggcctttcctgccttttctcaagctgcctggaatcctcaaacctgtcactttggtcagatgtgcagaccattactaaggtctatgtctgcaaacattactaatctaggtcctattactaatctatgtctgcaaacattaaaggaatgaaacaatgaaaggaacatttgaaagaaaatgtgggtagacaatttcttgcaacttgggggaaagtttagaattcttttgattggactactttttttttttttcctcaagcttcaggtgaccacaatagcaacacctccctattctgttatttcttagtgtaggtagacaattctttcaggagcagagcagcgtcctataatcctagaccttttcatgacgtgtaaaaaatgatgtttcatcctctgattgccccaataaaaatctttgttgtccatccctatacaacctgccaacatggttgacatttaatgagaggaatgtcaaaaatacattttactttattcaaagaaaaatatattggttactgggaaaaggtcaagaaagaggcagaaagagatcagggagggctaaagttgtgtcttatgccaagcgaaagtgaaaaatatcattttcactttatcaactgagactttggggcctgtaagcttgaggcaagacagaaataagagaatcaagacttgattgtaaaaattgacaactttagattctgaggctaggctgagtacttattatacggctacatttacacatttacacttatctaataaatcagatttcacagtctcaa

SEQ ID NO: 5129 - DNA, 1505 bp, Homo sapiens
agccccggatatctgtgttaccagccttgtctcggccacctcaaggataatcactaaattctgccgaaaggactgaggaacggtgcctggaaaagggcaagaatatcacggcatgggcatgagtagcttgaaactgctgaagtatgtcctgtttttcttcaacttgctcttttggatctgtggctgctgcattttgggctttgggatctacctgctgatccacaacaacttcggagtgctcttccataacctcccctccctcacgctgggcaatgtgtttgtcatcgtgggctctattatcatggtagttgccttcctgggctgcatgggctctatcaaggaaaacaagtgtctgcttatgtcgttcttcatcctgctgctgattatcctccttgctgaggtgaccttggccatcctgctctttgtatatgaacagaagctgaatgagtatgtggctaagggtctgaccgacagcatccaccgttaccactcagacaatagcaccaaggcagcgtgggactccatccagtcatttctgcagtgttgtggtataaatggcacgagtgattggaccagtggcccaccagcatcttgcccctcagatcgaaaagtggagggttgctatgcgaaagcaagactgtggtttcattccaatttcctgtatatcggaatcatcaccatctgtgtatgtgtgattgaggtgttggggatgtcctttgcactgaccctgaactgccagattgacaaaaccagccagaccatagggctatgatctgcagtagtcctgtggtgaagagacttgtttcatctccggaaatgcaaaaccatttatagcatgaagccctacatgatcactgcaggatgatcctcctcccatcctttccctttttaggtccctgtcttatacaaccagagaagtgggtgttggccaggcacatcccatctcaggcagcaagacaatctttcactcactgacggcagcagccatgtctctcaaagtggtgaaactaatatctgagcatcttttagacaagagaggcaaagacaaactggatttaatggcccaacatcaaagggtgaacccaggatatgaatttttgcatcttcccattgtcgaattagtctccagcctctaaataatgcccagtcttctccccaaagtcaagcaagagactagttgaagggagttctggggccaggctcactggaccattgtcacaaccctctgtttctctttgactaagtgccctggctacaggaattacacagttctctttctccaaagggcaagatctcatttcaatttctttattagagggccttattgatgtgttctaagtctttccagaaaaaaactatccagtgatttatatcctgatttcaaccagtcacttagctgataatcacagtaagaagacttctggtattatctctctatcagataagattttgttaatgtactattttactcttcaataaataaaagtttattatctcaatcacaa

SEQ ID NO: 5130 - DNA, 977 bp, Homo sapiens
tagccccggatatctgtgttaccagccttgtctcggccacctcaaggataatcactaaattctgccgaaaggactgaggaacggtgcctggaaaagggcaagaatatcacggcatgggcatgagtagcttgaaactgctgaagtatgtcctgtttttcttcaacttgctcttttggatctgtggctgctgcattttgggctttgggatctacctgctgatccacaacaacttcggagtgctcttccataacctcccctccctcacgctgggcaatgtgtttgtcatcgtgggctctattatcatggtagttgccttcctgggctgcatgggctctatcaaggaaaacaagtgtctgcttatgtcgttcttcatcctgctgctgattatcctccttgctgaggtgaccttggccatcctgctctttgtatatgaacagaagggttgctatgcgaaagcaagactgtggtttcattccaatttcctgtatatcggaatcatcaccatctgtgtatgtgtgattgaggtgttggggatgtcctttgcactgaccctgaactgccagattgacaaaaccagccagaccatagggctatgatctgcagtagtcctgtggtgaagagacttgtttcatctccggaaatgcaaaaccatttatagcatgaagccctacatgatcactgcaggatgatcctcctcccatcctttccctttttaggtccctgtcttatacaaccagagaagtgggtgttggccaggcacatcccatctcaggcagcaagacaatctttcactcactgacggcagcagccatgtctctcaaagtggtgaaactaatatctgagcatcttttagacaagagaggcaaagacaaactggatttaatggcccaacatcaaagggtgaacccaggatatgaatttttgcatcttcccattgtcgaattagtctccagcctctaaataatgcccagtcttct

SEQ ID NO: 5131 - DNA, 2220 bp, Homo sapiens
ccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctggttctcgtcctgtcacccaggctggtatgcggtggtgtgatcgtagctcactgcagtctcgaactcctgggttcaagcgatccttccacttcagcctcccaagtagctggtactacagggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtaagaaagcatagagatttgttcgtatttagaatgggatcacgaggaaaagagaaggaaagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatattttaaaggtaaaacatgctggtgaaccaggggtgttgatggtgataagggaggaatatagaatgaaagactgaatcttcctttgttgcacaaatagagtttggaaaaagcctgtgaaaggtgtcttctttgacttaatgtctttaaaagtatccagagatactacaatattaacataagaaaagattatatattatttctgaatcgagatgtccatagtcaaatttgtaaatcttattcttttgtaatatttatttatatttatttatgacagtgaacattctgattttacatgtaaaacaagaaaagttgaagaagatatgtgaagaaaaatgtatttttcctaaatagaaataaatgatcccattttttggt

SEQ ID NO: 5132 - DNA, 1515 bp, Homo sapiens
gttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgttctgtttatgtgatgaatcacatttattgatttggatatgttgagccaaccttgcatcccaggaataaagcctacttgatcgtgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtaagaaagcat

SEQ ID NO: 5133 - DNA, 2760 bp, Homo sapiens
gagtctagggcccccggggcgtatgacgccggagccctctgaccgcacctctgaccacaacaaacccctactccacccgtcttgtttgtcccacccttggtgacgcagagccccagcccagaccccgcccaaagcactcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtaagaaagcatagagatttgttcgtatttagaatgggatcacgaggaaaagagaaggaaagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatattttaaaggtaaaacatgctggtgaaccaggggtgttgatggtgataagggaggaatatagaatgaaagactgaatcttcctttgttgcacaaatagagtttggaaaaagcctgtgaaaggtgtcttctttgacttaatgtctttaaaagtatccagagatactacaatattaacataagaaaagattatatattatttctgaatcgagatgtccatagtcaaatttgtaaatcttattcttttgtaatatttatttatatttatttatgacagtgaacattctgattttacatgtaaaacaagaaaagttgaagaagatatgtgaagaaaaatgtatttttcctaaatagaaataaatgatcccattttttggtatcatgtagtatgtgaaatttattcttaaacgtgactactttatttctaaataagaaattccctacctgcttcctacaagcagttcagaatgccatgccttggttgtcctagtgtgaataattttcagctactttaaaattatattgtactttctcaagcatgtcatatcctttcctattagagtatctatattacttgttactgatttacctgaaggcaatctgattaatttctaggtttttaccatattcttgtcatcttgccaattacattttaagtgttagactagactaagatgtactagttgtatagaatataactagatttattatggcaatgtttattttgtcattttgcttcatctgttttgttgttgaagtactttaaatttcatacgttcatggcatttcactgtaaagactttaatgtgtatttcttaaaataaaactttttttcctccttaa

SEQ ID NO: 5134 - DNA, 1545 bp, Homo sapiens
gttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgagacggtgtttcaccgtgttatccaggatggtcttgatctcctggcctcgagatctgcctgcctcggcctcccaaagtgctgggattacaggcgtgagccaccgcacctggccagggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtaagaaagcat

SEQ ID NO: 5135 - DNA, 1297 bp, Homo sapiens
actgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaa

SEQ ID NO: 5136 - DNA, 1523 bp, Homo sapiens
gttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgctctgcaagttagaccttttgaagtgtctgggtcatcccacatttcttcaaaaaagatgatgtgcatcctctaggtcactccagttcttggagggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtaagaaagcat

SEQ ID NO: 5137 - DNA, 1033 bp, Homo sapiens
gcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtcagttgacactgttttcagggcacacgtgtttcacgttgacaggtttgcttgggacgctagtaaccatgggcttgctgacttag

SEQ ID NO: 5138 - DNA, 1098 bp, Homo sapiens
gtaggcggtgcttgaacttagggctgcttgtggctgggcactcgcgcagaggccggcccgacgagccatggttgctgggagcgacgcggggcgggccctgggggtcctcagcgtggtctgcctgctgcactgctttggtttcatcagctgtttttcccaacaaatatatggtgttgtgtatgggaatgtaactttccatgtaccaagcaatgtgcctttaaaagaggtcctatggaaaaaacaaaaggataaagttgcagaactggaaaattctgaattcagagctttctcatcttttaaaaatagggtttatttagacactgtgtcaggtagcctcactatctacaacttaacatcatcagatgaagatgagtatgaaatggaatcgccaaatattactgataccatgaagttctttctttatgtgcttgagtctcttccatctcccacactaacttgtgcattgactaatggaagcattgaagtccaatgcatgataccagagcattacaacagccatcgaggacttataatgtactcatgggattgtcctatggagcaatgtaaacgtaactcaaccagtatatattttaagatggaaaatgatcttccacaaaaaatacagtgtactcttagcaatccattatttaatacaacatcatcaatcattttgacaacctgtatcccaagcagcggtcattcaagacacagatatgcacttatacccataccattagcagtaattacaacatgtattgtgctgtatatgaatggtattctgaaatgtgacagaaaaccagacagaaccaactccaattgattggtaacagaagatgaagacaacagcataactaaattattttaaaaactaaaaagccatctgatttctcatttgagtattacaatttttgaacaactgttggaaatgtaacttgaagcagctgctttaagaagaaatacccactaacaaagaacaagcattagttttggctgtcatcaacttattatatgactaggtgcttgctttttttgtcagtaaattgtttttactgatgatgtagatacttttgtaaataaatgtaaatatgtacacaagtg

SEQ ID NO: 5139 - DNA, 1328 bp, Homo sapiens
gaacttagggctgcttgtggctgggcactcgcgcagaggccggcccgacgagccatggttgctgggagcgacgcggggcgggccctgggggtcctcagcgtggtctgcctgctgcactgctttggtttcatcagctgtttttcccaacaaatatatggtgttgtgtatgggaatgtaactttccatgtaccaagcaatgtgcctttaaaagaggtcctatggaaaaaacaaaaggataaagttgcagaactggaaaattctgaattcagagctttctcatcttttaaaaatagggtttatttagacactgtgtcaggtagcctcactatctacaacttaacatcatcagatgaagatgagtatgaaatggaatcgccaaatattactgataccatgaagttctttctttatgtgcttgagtctcttccatctcccacactaacttgtgcattgactaatggaagcattgaagtccaatgcatgataccagagcattacaacagccatcgaggacttataatgtactcatgggattgtcctatggagcaatgtaaacgtaactcaaccagtatatattttaagatggaaaatgatcttccacaaaaaatacagtgtactcttagcaatccattatttaatacaacatcatcaatcattttgacaacctgtatcccaagcagcggtcattcaagacacagatatgcacttatacccataccattagcagtaattacaacatgtattgtgctgtatatgaatggtattctgaaatgtgacagaaaaccagacagaaccaagtaagtacactgcaggctgtgcactctgtgccagaacaacagcagccctgctgtagatgcccattacttgggaagccagattgtactcatctgttggttgccttgtacagtaataagaagtaacatcagcagatatactaaccatagtgtattaagtaccaactgtgtgccatgcactgcactagccactctctgcatatcgtttcctggaaccctctcaatgagccttgcaggaggagtatcataccccttgcttagagacagcgcatatgagattcatagaagtcaagtgagatatcaaagtcacgttgctagtaagtgatgggctgggatttaaatctaggtctttggactccaagagttatactgttaaccactacaatacactccctccacctcccatcccagaaaaagttggatcagggatagggttcacttcaggagccagggtcagagctgggcctgtagtcacatataaaagataggacacaaacacaattagcagcagtgttggtttaataaaccgccgta

SEQ ID NO: 5140 - DNA, 1775 bp, Homo sapiens
aaagaatgcgggggctgagcgcagaagcggctcgaggctggaagaggatcttgggcgccgccagtctttagcaccagttggtgtaggagttgagacctacttcacagtagttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaacc

SEQ ID NO: 5141 - DNA, 1889 bp, Homo sapiens
tgcgggggctgagcgcagaagcggctcgaggctggaagaggatcttgggcgccgccaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaat

SEQ ID NO: 5142 - DNA, 1878 bp, Homo sapiens
tgatggggaagatagtgttattcccacagtgtggtagtacacactggggcttatagggactgagcctactcaagggtatatggtgctgtgggtcagagctggggcatggcccagggattcagtgtgccttgactccccctgtaaatgttcctctcagaagccttcttggccttccagcccttggtttttgagacaaccagcagtcatttgttcgttcctgacattccttcctgtcccttccttccaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttga

SEQ ID NO: 5143 - DNA, 741 bp, Homo sapiens
attatacttcttacagtgaggagccagagcttccaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtggg

SEQ ID NO: 5144 - DNA, 758 bp, Homo sapiens
tttgactcactgaccctgatggggaagatagtgttattcccacagtgtggtagtacacactggggcttatagggactgagcctactcaagggtatatggtgctgtgggtcagagctggggcatggcccagggattcagtgtgccttgactccccctgttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccactt

SEQ ID NO: 5145 - DNA, 825 bp, Homo sapiens
atttgactcactgaccctgatggggaagatagtgttattcccacagtgtggtagtacacactggggcttatagggactgagcctactcaagggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcc

SEQ ID NO: 5146 - DNA, 789 bp, Homo sapiens
ccaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaaacacattcctgaaggcgctaaaagacgaaaagttacaaggactgaagaccaagcaacctggaaagaagtcggcctctctctcctgaggagctgcctaccagagcttgggcagccacctccttaggtgttagtgcttagataatgtgtcccatttgttgtc

SEQ ID NO: 5147 - DNA, 686 bp, Homo sapiens
gcagaagcggctcgaggctggaagaggatcttgggcgccgccagtctctctctgttgcccaagctggagtgcagtggcacagtcttggctcactgcaacctccacctcctgggtgcaagcgattctcgtgtctcagcctctcaagtagctgggattacaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattag

SEQ ID NO: 5148 - DNA, 652 bp, Homo sapiens
gaagcggctcgaggctggaagaggatcttgggcgccgccagtctctctctgttgcccaagctggagtgcagtggcacagtcttggctcactgcaacctccacctcctgggtgcaagcgattctcgtgtctcagcctctcaagtagctgggattacagtctttagcaccagttggtgtaggagttgagacctacttcacagtagttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtag

SEQ ID NO: 5149 - DNA, 3252 bp, Homo sapiens
actcacaggttgggtttgatcgcatgcgtgtcggagaggagagagcagagagagacacaggaacaagaacagcaaagggtagagcagacctgcgccaggggcgcacaacggccgtgtccacctcccggccccaagatggtgcttcccacaggcagccacgcgtagcagccagagacagctccagacatgtggctcttcttcgggatcactggattgctgacggcagccctctcaggtcatccatctccagccccacctgaccagctcaacaccagcagtgcagagagtgagctctgggagccaggggagcggcttccggtccgtctgacaaacgggagcagcagctgcagcgggacggtggaggtgcggctcgaggcgtcctgggagcccgcgtgcggggcgctctgggacagccgcgccgccgaggccgtgtgccgagcactgggctgcggcggggcggaggccgcctctcagctcgccccgccgacccctgagctgccgcccccgcctgcagccgggaacaccagcgtagcagctaatgccactctggccggggcgcccgccctcctgtgcagcggcgccgagtggcggctctgcgaggtggtggagcacgcgtgccgcagcgacgggaggcgggcccgtgtcacctgtgcagagaaccgcgcgctgcgcctggtggacggtggcggcgcctgcgccggccgcgtggagatgctggagcatggcgagtggggatcagtgtgcgatgacacttgggacctggaggacgcccacgtggtgtgcaggcaactgggctgcggctgggcagtccaggccctgcccggcttgcacttcacgcccggccgcgggcctatccaccgggaccaggtgaactgctcgggggccgaagcttacctgtgggactgcccggggctgccaggacagcactactgcggccacaaagaggacgcgggcgcggtgtgctcagagcaccagtcctggcgcctgacagggggcgctgaccgctgcgaggggcaggtggaggtacacttccgaggggtctggaacacagtgtgtgacagtgagtggtacccatcggaggccaaggtgctctgccagtccttgggctgtggaactgcggttgagaggcccaaggggctgccccactccttgtccggcaggatgtactactcatgcaatggggaggagctcaccctctccaactgctcctggcggttcaacaactccaacctctgcagccagtcgctggcagccagggtcctctgctcagcttcccggagtttgcacaatctgtccactcccgaagtccctgcaagtgttcagacagtcactatagaatcttctgtgacagtgaaaatagagaacaaggaatctcgggagctaatgctcctcatcccctccatcgttctgggaattctcctccttggctccctcatcttcatagccttcatcctcttgagaattaaaggaaaatatgccctccccgtaatggtgaaccaccagcacctacccaccaccatcccggcagggagcaatagctatcaaccggtccccatcaccatccccaaagaagttttcatgctgcccatccaggtccaggccccgccccctgaggactcagactctggctcggactcagactatgagcactatgacttcagcgcccagcctcctgtggccctgaccaccttctacaattcccagcggcatcgggtcacagatgaggaggtccagcaaagcaggttccagatgccacccttggaggaaggacttgaagagttgcatgcctcccacatcccaactgccaaccctggacactgcattacagacccgccatccctgggccctcagtatcacccgaggagcaacagtgagtcgagcacctcttcaggggaggattactgcaatagtcccaaaagcaagctgcctccatggaacccccaggtgttttcttcagagaggagttccttcctggagcagcccccaaacttggagctggccggcacccagccagccttttcagcagggcccccggctgatgacagctccagcacctcatccggggagtggtaccagaacttccagccaccaccccagcccccttcggaggagcagtttggctgtccagggtcccccagccctcagcctgactccaccgacaacgatgactacgatgacatcagcgcagcctaggccggggccagccgaggctcctggggtggctctgaccctctggcctcctgctctacctactccctttcccctttcccaccctcccagctcacctccccatggagctgagaggcctcccttggagagatggaaggaaacgttataccttgtacccctcggtctccatccatcaagccaaacctgctgccacagccctcccccggccccagatagcagccccagggaggatgctgcctccaagaggtgtgagccctctgtctcggggatgaacaagcagagtctgggctacctcttgacagctggtggaggggagttggggagctggactggatgactctggaggccccttccaaacctcaagtgtccggcgctttgattgcctgagtttctgacacttcagggcccagaggtcctgcgaggggcagaactggacccccatgccagtgctgctgcaggagggcccatatactagggtctgctgagctgttgtcactgatcggtgggcgctgggggggtagggtagcacaccagctgtcccaggctttgctccgggcggtaactgcacttgggcagggaatatagccttcctgggcacaactagctgacaatgacaggttgactgtgtacccccaaccaaggagctggggcccaaggccagtcctgccccagagacactccaagtccgccaggggcacagaccagttctgcagtgactgtccctggacaatgggtctttattctgagtttcctatggtttacaaagagggccccagcccagccccaccacagatcccagagataggggcccagtctccatgggggcaaggagcatagagatgttttccaggaaggggctcagaagctgcactaggccccgagtccccatgtgtctccttgaattgatgaggatgctcctgggagggatgcgtgactatgtggtgttgcacccggggctgcaaacgtctccgtgcagcccccagagagaggcccatgggctcagaccaggctttgttgtcctgctctgagtatcctgagattaaactgaattgctgaatgaaa

SEQ ID NO: 5150 - DNA, 3190 bp, Homo sapiens
agaccaaaaccacaagcagaacaagcaggcgtgagacactcacaggttgggtttgatcgcatgcgtgtcggagaggagagagcagagagagacacaggaacaagaacagcaaagggtagagcagacctgcgccaggggcgcacaacggccgtgtccacctcccggccccaagatggtgcttcccacaggcagccacgcgtagcagccagagacagctccagacatgtggctcttcttcgggatcactggattgctgacggcagccctctcaggtcatccatctccagccccacctgaccagctcaacaccagcagtgcagagagtgagctctgggagccaggggagcggcttccggtccgtctgacaaacgggagcagcagctgcagcgggacggtggaggtgcggctcgaggcgtcctgggagcccgcgtgcggggcgctctgggacagccgcgccgccgaggccgtgtgccgagcactgggctgcggcggggcggaggccgcctctcagctcgccccgccgacccctgagctgccgcccccgcctgcagccgggaacaccagcgtagcagctaatgccactctggccggggcgcccgccctcctgtgcagcggcgccgagtggcggctctgcgaggtggtggagcacgcgtgccgcagcgacgggaggcgggcccgtgtcacctgtgcagagaaccgcgcgctgcgcctggtggacggtggcggcgcctgcgccggccgcgtggagatgctggagcatggcgagtggggatcagtgtgcgatgacacttgggacctggaggacgcccacgtggtgtgcaggcaactgggctgcggctgggcagtccaggccctgcccggcttgcacttcacgcccggccgcgggcctatccaccgggaccaggtgaactgctcgggggccgaagcttacctgtgggactgcccggggctgccaggacagcactactgcggccacaaagaggacgcgggcgcggtgtgctcagagcaccagtcctggcgcctgacagggggcgctgaccgctgcgaggggcaggtggaggtacacttccgaggggtctggaacacagtgtgtgacagtgagtggtacccatcggaggccaaggtgctctgccagtccttgggctgtggaactgcggttgagaggcccaaggggctgccccactccttgtccggcaggatgtactactcatgcaatggggaggagctcaccctctccaactgctcctggcggttcaacaactccaacctctgcagccagtcgctggcagccagggtcctctgctcagcttcccggagtttgcacaatctgtccactcccgaagtccctgcaagtgttcagacagtcactatagaatcttctgtgacagtgaaaatagagaacaaggaatctcgggagctaatgctcctcatcccctccatcgttctgggaattctcctccttggctccctcatcttcatagccttcatcctcttgagaattaaaggaaaatatgttttcatgctgcccatccaggtccaggccccgccccctgaggactcagactctggctcggactcagactatgagcactatgacttcagcgcccagcctcctgtggccctgaccaccttctacaattcccagcggcatcgggtcacagatgaggaggtccagcaaagcaggttccagatgccacccttggaggaaggacttgaagagttgcatgcctcccacatcccaactgccaaccctggacactgcattacagacccgccatccctgggccctcagtatcacccgaggagcaacagtgagtcgagcacctcttcaggggaggattactgcaatagtcccaaaagcaagctgcctccatggaacccccaggtgttttcttcagagaggagttccttcctggagcagcccccaaacttggagctggccggcacccagccagccttttcagcagggcccccggctgatgacagctccagcacctcatccggggagtggtaccagaacttccagccaccaccccagcccccttcggaggagcagtttggctgtccagggtcccccagccctcagcctgactccaccgacaacgatgactacgatgacatcagcgcagcctaggccggggccagccgaggctcctggggtggctctgaccctctggcctcctgctctacctactccctttcccctttcccaccctcccagctcacctccccatggagctgagaggcctcccttggagagatggaaggaaacgttataccttgtacccctcggtctccatccatcaagccaaacctgctgccacagccctcccccggccccagatagcagccccagggaggatgctgcctccaagaggtgtgagccctctgtctcggggatgaacaagcagagtctgggctacctcttgacagctggtggaggggagttggggagctggactggatgactctggaggccccttccaaacctcaagtgtccggcgctttgattgcctgagtttctgacacttcagggcccagaggtcctgcgaggggcagaactggacccccatgccagtgctgctgcaggagggcccatatactagggtctgctgagctgttgtcactgatcggtgggcgctgggggggtagggtagcacaccagctgtcccaggctttgctccgggcggtaactgcacttgggcagggaatatagccttcctgggcacaactagctgacaatgacaggttgactgtgtacccccaaccaaggagctggggcccaaggccagtcctgccccagagacactccaagtccgccaggggcacagaccagttctgcagtgactgtccctggacaatgggtctttattctgagtttcctatggtttacaaagagggccccagcccagccccaccacagatcccagagataggggcccagtctccatgggggcaaggagcatagagatgttttccaggaaggggctcagaagctgcactaggccccgagtccccatgtgtctccttgaattgatgaggatgctcctgggagggatgcgtgactatgtggtgttgcacccggggctgcaaacgtctccgtgcagcccccagagagaggcccatgggctcagaccaggctttgttgtcctgctctgagtatcctgagattaaactgaattgctgaatg

SEQ ID NO: 5151 - DNA, 3067 bp, Homo sapiens
agaccaaaaccacaagcagaacaagcaggcgtgagacactcacaggttgggtttgatcgcatgcgtgtcggagaggagagagcagagagagacacaggaacaagaacagcaaagggtagagcagacctgcgccaggggcgcacaacggccgtgtccacctcccggccccaagatggtgcttcccacaggcagccacgcgtagcagccagagacagctccagacatgtggctcttcttcgggatcactggattgctgacggcagccctctcaggtcatccatctccagccccacctgaccagctcaacaccagcagtgcagagagtgagctctgggagccaggggagcggcttccggtccgtctgacaaacgggagcagcagctgcagcgggacggtggaggtgcggctcgaggcgtcctgggagcccgcgtgcggggcgctctgggacagccgcgccgccgaggccgtgtgccgagcactgggctgcggcggggcggaggccgcctctcagctcgccccgccgacccctgagctgccgcccccgcctgcagccgggaacaccagcgtagcagctaatgccactctggccggggcgcccgccctcctgtgcagcggcgccgagtggcggctctgcgaggtggtggagcacgcgtgccgcagcgacgggaggcgggcccgtgtcacctgtgcagagaaccgcgcgctgcgcctggtggacggtggcggcgcctgcgccggccgcgtggagatgctggagcatggcgagtggggatcagtgtgcgatgacacttgggacctggaggacgcccacgtggtgtgcaggcaactgggctgcggctgggcagtccaggccctgcccggcttgcacttcacgcccggccgcgggcctatccaccgggaccaggtgaactgctcgggggccgaagcttacctgtgggactgcccggggctgccaggacagcactactgcggccacaaagaggacgcgggcgcggtgtgctcagagcaccagtcctggcgcctgacagggggcgctgaccgctgcgaggggcaggtggaggtacacttccgaggggtctggaacacagtgtgtgacagtgagtggtacccatcggaggccaaggtgctctgccagtccttgggctgtggaactgcggttgagaggcccaaggggctgccccactccttgtccggcaggatgtactactcatgcaatggggaggagctcaccctctccaactgctcctggcggttcaacaactccaacctctgcagccagtcgctggcagccagggtcctctgctcagcttcccggagtttgcacaatctgtccactcccgaagtccctgcaagtgttcagacagtcactatagaatcttctgtgacagtgaaaatagagaacaaggaatctcgggagctaatgctcctcatcccctccatcgttctgggaattctcctccttggctccctcatcttcatagccttcatcctcttgagaattaaaggaaaatatgattcccagcggcatcgggtcacagatgaggaggtccagcaaagcaggttccagatgccacccttggaggaaggacttgaagagttgcatgcctcccacatcccaactgccaaccctggacactgcattacagacccgccatccctgggccctcagtatcacccgaggagcaacagtgagtcgagcacctcttcaggggaggattactgcaatagtcccaaaagcaagctgcctccatggaacccccaggtgttttcttcagagaggagttccttcctggagcagcccccaaacttggagctggccggcacccagccagccttttcagcagggcccccggctgatgacagctccagcacctcatccggggagtggtaccagaacttccagccaccaccccagcccccttcggaggagcagtttggctgtccagggtcccccagccctcagcctgactccaccgacaacgatgactacgatgacatcagcgcagcctaggccggggccagccgaggctcctggggtggctctgaccctctggcctcctgctctacctactccctttcccctttcccaccctcccagctcacctccccatggagctgagaggcctcccttggagagatggaaggaaacgttataccttgtacccctcggtctccatccatcaagccaaacctgctgccacagccctcccccggccccagatagcagccccagggaggatgctgcctccaagaggtgtgagccctctgtctcggggatgaacaagcagagtctgggctacctcttgacagctggtggaggggagttggggagctggactggatgactctggaggccccttccaaacctcaagtgtccggcgctttgattgcctgagtttctgacacttcagggcccagaggtcctgcgaggggcagaactggacccccatgccagtgctgctgcaggagggcccatatactagggtctgctgagctgttgtcactgatcggtgggcgctgggggggtagggtagcacaccagctgtcccaggctttgctccgggcggtaactgcacttgggcagggaatatagccttcctgggcacaactagctgacaatgacaggttgactgtgtacccccaaccaaggagctggggcccaaggccagtcctgccccagagacactccaagtccgccaggggcacagaccagttctgcagtgactgtccctggacaatgggtctttattctgagtttcctatggtttacaaagagggccccagcccagccccaccacagatcccagagataggggcccagtctccatgggggcaaggagcatagagatgttttccaggaaggggctcagaagctgcactaggccccgagtccccatgtgtctccttgaattgatgaggatgctcctgggagggatgcgtgactatgtggtgttgcacccggggctgcaaacgtctccgtgcagcccccagagagaggcccatgggctcagaccaggctttgttgtcctgctctgagtatcctgagattaaactgaattgctgaatg

SEQ ID NO: 5152 - DNA, 1809 bp, Homo sapiens
atgtggctcttcttcgggatcactggattgctgacggcagccctctcaggtcatccatctccagccccacctgaccagctcaacaccagcagtgcagagagtgagctctgggagccaggggagcggcttccggtccgtctgacaaacgggagcagcagctgcagcgggacggtggaggtgcggctcgaggcgtcctgggagcccgcgtgcggggcgctctgggacagccgcgccgccgaggccgtgtgccgagcactgggctgcggcggggcggaggccgcctctcagctcgccccgccgacccctgagctgccgcccccgcctgcagccgggaacaccagcgtagcagctaatgccactctggccggggcgcccgccctcctgtgcagcggcgccgagtggcggctctgcgaggtggtggagcacgcgtgccgcagcgacgggaggcgggcccgtgtcacctgtgcagagaaccgcgcgctgcgcctggtggacggtggcggcgcctgcgccggccgcgtggagatgctggagcatggcgagtggggatcagtgtgcgatgacacttgggacctggaggacgcccacgtggtgtgcaggcaactgggctgcggctgggcagtccaggccctgcccggcttgcacttcacgcccggccgcgggcctatccaccgggaccaggtgaactgctcgggggccgaagcttacctgtgggactgcccggggctgccaggacagcactactgcggccacaaagaggacgcgggcgcggtgtgctcagagcaccagtcctggcgcctgacagggggcgctgaccgctgcgaggggcaggtggaggtacacttccgaggggtctggaacacagtgtgtgacagtgagtggtacccatcggaggccaaggtgctctgccagtccttgggctgtggaactgcggttgagaggcccaaggggctgccccactccttgtccggcaggatgtactactcatgcaatggggaggagctcaccctctccaactgctcctggcggttcaacaactccaacctctgcagccagtcgctggcagccagggtcctctgctcagcttcccggagtttgcacaatctgtccactcccgaagtccctgcaagtgttcagacagtcactatagaatcttctgtgacagtgaaaatagagaacaaggaatctcgggagctaatgctcctcatcccctccatcgttctgggaattctcctccttggctccctcatcttcatagccttcatcctcttgagaattaaaggaaaatatgttttcatgctgcccatccaggtccaggccccgccccctgaggactcagactctggctcggactcagactatgagcactatgacttcagcgcccagcctcctgtggccctgaccaccttctacaattcccagcggcatcgggtcacagatgaggaggtccagcaaagcaggttccagatgccacccttggaggaaggacttgaagagttgcatgcctcccacatcccaactgccaaccctggacactgcattacagacccgccatccctgggccctcagtatcacccgaggagcaacagtgagtcgagcacctcttcaggggaggattactgcaatagtcccaaaagcaagctgcctccatggaacccccaggtgttttcttcagagaggagttccttcctggagcagcccccaaacttggagctggccggcacccagccagccttttcagggtcccccagccctcagcctgactccaccgacaacgatgactacgatgacatcagcgcagcctaggcc

SEQ ID NO: 5153 - DNA, 1782 bp, Homo sapiens
atgtggctcttcttcgggatcactggattgctgacggcagccctctcaggtcatccatctccagccccacctgaccagctcaacaccagcagtgcagagagtgagctctgggagccaggggagcggcttccggtccgtctgacaaacgggagcagcagctgcagcgggacggtggaggtgcggctcgaggcgtcctgggagcccgcgtgcggggcgctctgggacagccgcgccgccgaggccgtgtgccgagcactgggctgcggcggggcggaggccgcctctcagctcgccccgccgacccctgagctgccgcccccgcctgcagccgggaacaccagcgtagcagctaatgccactctggccggggcgcccgccctcctgtgcagcggcgccgagtggcggctctgcgaggtggtggagcacgcgtgccgcagcgacgggaggcgggcccgtgtcacctgtgcagagaaccgcgcgctgcgcctggtggacggtggcggcgcctgcgccggccgcgtggagatgctggagcatggcgagtggggatcagtgtgcgatgacacttgggacctggaggacgcccacgtggtgtgcaggcaactgggctgcggctgggcagtccaggccctgcccggcttgcacttcacgcccggccgcgggcctatccaccgggaccaggtgaactgctcgggggccgaagcttacctgtgggactgcccggggctgccaggacagcactactgcggccacaaagaggacgcgggcgcggtgtgctcagagcaccagtcctggcgcctgacagggggcgctgaccgctgcgaggggcaggtggaggtacacttccgaggggtctggaacacagtgtgtgacagtgagtggtacccatcggaggccaaggtgctctgccagtccttgggctgtggaactgcggttgagaggcccaaggggctgccccactccttgtccggcaggatgtactactcatgcaatggggaggagctcaccctctccaactgctcctggcggttcaacaactccaacctctgcagccagtcgctggcagccagggtcctctgctcagcttcccggagtttgcacaatctgtccactcccgaagtccctgcaagtgttcagacagtcactatagaatcttctgtgacagtgaaaatagagaacaaggaatctcgggagctaatgctcctcatcccctccatcgttctgggaattctcctccttggctccctcatcttcatagccttcatcctcttgagaattaaaggaaaatatgccctccccgtaatggtgaaccaccagcacctacccaccaccatcccggcagggagcaatagctatcaaccggtccccatcaccatccccaaagaagattcccagcggcatcgggtcacagatgaggaggtccagcaaagcaggttccagatgccacccttggaggaaggacttgaagagttgcatgcctcccacatcccaactgccaaccctggacactgcattacagacccgccatccctgggccctcagtatcacccgaggagcaacagtgagtcgagcacctcttcaggggaggattactgcaatagtcccaaaagcaagctgcctccatggaacccccaggtgttttcttcagagaggagttccttcctggagcagcccccaaacttggagctggccggcacccagccagccttttcagggtcccccagccctcagcctgactccaccgacaacgatgactacgatgacatcagcgcagcctaggcc

SEQ ID NO: 5154 - DNA, 1070 bp, Homo sapiens
cgggggtgggcgccttcttccgggtaggggccacgtggccctggccgggcggggggctcggcccaccccgcgccgggcccagtgactcaggccgcagctgttaccgcgtcacatgagggaggccggcggccactcggcgggggaggggaccgtggctggagcccggggcggggccgcgcggcaggcggggcgggagccggggggcgcagctagagagccccggagccgcggcgggagaggaacgcgcagccagccttgggaagcccaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggatta

SEQ ID NO: 5155 - DNA, 855 bp, Homo sapiens
cggcgggagaggaacgcgcagccagccttgggaagcccaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaaga

SEQ ID NO: 5156 - DNA, 607 bp, Homo sapiens
tggaaaatggagaagctgtgctaatagaggggggccagaaatccccactctagaatgctgtagaatgttgggagacacccaggatctctccgccccggcgctcagagggtaactctcacccacctcgtccgcttctctgaaccagagtgacccaggctgcgctccgccccgctctcctaccccgagttggcacggaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgct

SEQ ID NO: 5157 - DNA, 1233 bp, Homo sapiens
gtggcttcggggaagggcttcctccccttttctcagactaggatccctggaaaatggagaagctgtgctaatagaggggggccagaaatccccactctagaatgctgtagaatgttgggagacacccaggatgtgagccagggactttctggaagtgtttgttctggccccacccgaccccaggcagtccccagctgtctgcacagtcggatggggagggggcttgcacagagttggagccagaggagagagctggctcatcccctacggtaggatggggaaacctcacagaccacattgtcacccggcctcagctctccgccccggcgctcagagggtaactctcacccacctcgtccgcttctctgaaccagagtgacccaggctgcgctccgccccgctctcctaccccgagttggcacggaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttt

SEQ ID NO: 5158 - DNA, 788 bp, Homo sapiens
ccggagactggcgggccgagggtcggcgtcaggctcaagcccctgccggcgcccttggatctgtcctgggccccagaggcggcggggcggggtccgggcttcgcggccgtcgcccccacccctctcctgcgggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgctttt

SEQ ID NO: 5159 - DNA, 845 bp, Homo sapiens
gcgcagccagccttgggaagcccaggtgaggccgcggggacccggcggacttcggcgcgggctgggagagaccacccgcagtcccttcctccagggctcgccccaggcccgcggagactcgtccggcgctctccagccgccctggagcaactttgcttcgaagttccctgggcccgggcagggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgagg

SEQ ID NO: 5160 - DNA, 949 bp, Homo sapiens
gcgggtttccgggtgggaggggccgggaatcggggccgtgaagggaagccctcgagggccggccgggagcccggaaaccgaggtcccccttcggccagttttaatccccccgccctcccctctgccccaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaa

SEQ ID NO: 5161 - DNA, 682 bp, Homo sapiens
cggcagccatggcggtggaaggaggaatgaaatgtgtgaagttcttgctctacgtcctcctgctggccttttgcggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcat

SEQ ID NO: 5162 - DNA, 779 bp, Homo sapiens
gcccctctccccctttccctcctcccagcgcttgggggcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaa

SEQ ID NO: 5163 - DNA, 870 bp, Homo sapiens
ggcttgagaggctactgtttgtctagggagggacacatcactcttgctcccttttcctcttcccttctcctggcctaactggccagaggaaccttagtcacagctgatgcgcgcgtgggatgtgcactggaggatagtgagggggcagttctgggagagaattgagctgggagccctggaggcctgtagaaagcattattctaggcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctc

SEQ ID NO: 5164 - DNA, 1741 bp, Homo sapiens
gagagggctgagggagcagggttgagcaactggtgcagacagcctagctggactttgggtgaggcggttcagccatgaggctggctgtgcttttctcgggggccctgctggggctactggcagcccaggggacagggaatgactgtcctcacaaaaaatcagctactttgctgccatccttcacggtgacacccacggttacagagagcactggaacaaccagccacaggactaccaagagccacaaaaccaccactcacaggacaaccaccacaggcaccaccagccacggacccacgactgccactcacaaccccaccaccaccagccatggaaacgtcacagttcatccaacaagcaatagcactgccaccagccagggaccctcaactgccactcacagtcctgccaccactagtcatggaaatgccacggttcatccaacaagcaacagcactgccaccagcccaggattcaccagttctgcccacccagaaccacctccaccctctccgagtcctagcccaacctccaaggagaccattggagactacacgtggaccaatggttcccagccctgtgtccacctccaagcccagattcagattcgagtcatgtacacaacccagggtggaggagaggcctggggcatctctgtactgaaccccaacaaaaccaaggtccagggaagctgtgagggtgcccatccccacctgcttctctcattcccctatggacacctcagctttggattcatgcaggacctccagcagaaggttgtctacctgagctacatggcggtggagtacaatgtgtccttcccccacgcagcacagtggacattctcggctcagaatgcatcccttcgagatctccaagcacccctggggcagagcttcagttgcagcaactcgagcatcattctttcaccagctgtccacctcgacctgctctccctgaggctccaggctgctcagctgccccacacaggggtctttgggcaaagtttctcctgccccagtgaccggtccatcttgctgcctctcatcatcggcctgatccttcttggcctcctcgccctggtgcttattgctttctgcatcatccggagacgcccatccgcctaccaggccctctgagcatttgcttcaaaccccagggcactgagggggttggggtgtggtgggggggtacccttatttcctcgacacgcaactggctcaaagacaatgttattttccttccctttcttgaagaacaaaaagaaagccgggcatgacggctcatgcctgtaatcccagcactttgggaggctgaggcaggtggatcactggaggtcaggagtttgagaccagcctggccaacatggtgaaaccctgtctctactaaaaatacaattagccaggtgtggcggcgtaatcccagctggcctgtaatcccagctacttgggaggctgaggcagaactgcttgaacccaggaggtggaggttgcagtgagccgtcatcgcgccactaagccaagatcgcgccactgcactccagcctgggcgacagagccagactgtctcaaataaataaatatgagataatgcagtcgggagaagggagggagagaattttattaaatgtgacgaactgccccccccccccccccagcaggagagcagcaaaatttatgcaaatctttgacggggttttccttgtcctgccaggattaaaagccatgagtttcttgtcaca

SEQ ID NO: 5165 - DNA, 1532 bp, Homo sapiens
cagacagcctagctggactttgggtgaggcggttcagccatgaggctggctgtgcttttctcgggggccctgctggggctactggcagagagcactggaacaaccagccacaggactaccaagagccacaaaaccaccactcacaggacaaccaccacaggcaccaccagccacggacccacgactgccactcacaaccccaccaccaccagccatggaaatgccacggttcatccaacaagcaacagcactgccaccagcccaggattcaccagttctgcccacccagaaccacctccaccctctccgagtcctagcccaacctccaaggagaccattggagactacacgtggaccaatggttcccagccctgtgtccacctccaagcccagattcagattcgagtcatgtacacaacccagggtggaggagaggcctggggcatctctgtactgaaccccaacaaaaccaaggtccagggaagctgtgagggtgcccatccccacctgcttctctcattcccctatggacacctcagctttggattcatgcaggacctccagcagaaggttgtctacctgagctacatggcggtggagtacaatgtgtccttcccccacgcagcacagtggacattctcggctcagaatgcatcccttcgagatctccaagcacccctggggcagagcttcagttgcagcaactcgagcatcattctttcaccagctgtccacctcgacctgctctccctgaggctccaggctgctcagctgccccacacaggggtctttgggcaaagtttctcctgccccagtgaccggtccatcttgctgcctctcatcatcggcctgatccttcttggcctcctcgccctggtgcttattgctttctgcatcatccggagacgcccatccgcctaccaggccctctgagcatttgcttcaaaccccagggcactgagggggttggggtgtggtgggggggtacccttatttcctcgacacgcaactggctcaaagacaatgttattttccttccctttcttgaagaacaaaaagaaagccgggcatgacggctcatgcctgtaatcccagcactttgggaggctgaggcaggtggatcactggaggtcaggagtttgagaccagcctggccaacatggtgaaaccctgtctctactaaaaatacaattagccaggtgtggcggcgtaatcccagctggcctgtaatcccagctacttgggaggctgaggcagaactgcttgaacccaggaggtggaggttgcagtgagccgtcatcgcgccactaagccaagatcgcgccactgcactccagcctgggcgacagagccagactgtctcaaataaataaatatgagataatgcagtcgggagaagggagggagagaattttattaaatgtgacgaactgccccccccccccccccagcaggagagcagcaaaatttatgcaaatctttgacggggttttccttgtcctgccaggattaaaagccatgagtttcttgtc

SEQ ID NO: 5166 - DNA, 1676 bp, Homo sapiens
agactcaacaagagctccagcaaagactttcactgtagcttgacttgacctgagattaactagggaatcttgagaataaagatgagctctgaaaattgtttcgtagcagagaacagctctttgcatccggagagtggacaagaaaatgatgccaccagtccccatttctcaacacgtcatgaagggtccttccaagttcctgtcctgtgtgctgtaatgaatgtggtcttcatcaccattttaatcatagctctcattgccttatcagtgggccaatacaattgtccaggccaatacacattctcaatgccatcagacagccatgtttcttcatgctctgaggactgggttggctaccagaggaaatgctactttatttctactgtgaagaggagctggacttcagcccaaaatgcttgttctgaacatggtgctactcttgctgtcattgattctgaaaaggacatgaactttctaaaacgatacgcaggtagagaggaacactgggttggactgaaaaaggaacctggtcacccatggaagtggtcaaatggcaaagaatttaacaactggttcaacgttacagggtctgacaagtgtgtttttctgaaaaacacagaggtcagcagcatggaatgtgagaagaatttatactggatatgtaacaaaccttacaaataataaggaaacatgttcacttattgactattatagaatggaactcaaggaaatctgtgtcagtggatgctgctctgtggtccgaagtcttccatagagactttgtgaaaaaaaattttatagtgtcttgggaattttcttccaaacagaactatggaaaaaaaggaagaaattccaggaaaatctgcactgtgggcttttattgccatgagctagaagcatcacaggttgaccaataaccatgcccaagaatgagaagaatgactatgcaacctttggatgcactttatattattttgaatccagaaataatgaaataactaggcgtggacttactatttattgctgaatgactaccaacagtgagagcccttcatgcatttgcactattggaaggagttagatgttggtactagatactgaatgtaaacaaaggaattatggctggtaacataggtttttagtctaattgaatcccttaaactcagggagcatttataaatggacaaatgcttatgaaactaagatttgtaatatttctctctttttagagaaatttgccaatttactttgttatttttccccaaaaagaatgggatgatcatgtatttatttttttacttcctcagctgtagacaggtccttttcgatggtacatatttctttgcctttataatcttttatacagtgtcttacagagaaaagacataagcaaagactatgaggaatatttgcaagacatagaatagtgttggaaaatgtgcaatatgtgatgtggcaaatctctattaggaaatattctgtaatcttcagacctagaataatactagtcttataataggtttgtgactttcctaaatcaattctattacgtgcaatacttcaatacttcatttaaaatatttttatgtgcaataaaatgtatttgtttgtattttgtgttcagtacaattataagctgtttttatatatgtgaaataaaagtagaataaacacaa

SEQ ID NO: 5167 - DNA, 1020 bp, Homo sapiens
agactcaacaagagctccagcaaagactttcactgtagcttgacttgacctgagattaactagggaatcttgagaataaagatgagctctgaaaattgtttcgtagcagagaacagctctttgcatccggagagtggacaagaaaatgatgccaccagtccccatttctcaacacgtcatgaagggtccttccaagttcctgtcctgtgtgctgtaatgaatgtggtcttcatcaccattttaatcatagctctcattgccttatcagtgggccaatacaattgtccaggccaatacacattctcaatgccatcagacagccatgtttcttcatgctctgaggactgggttggctaccagaggaaatgctactttatttctactgtgaagaggagctggacttcagcccaaaatgcttgttctgaacatggtgctactcttgctgtcattgattctgaaaaggacatgaactttctaaaacgatacgcaggtagagaggaacactgggttggactgaaaaaggaacctggtcacccatggaagtggtcaaatggcaaagaatttaacaactggtaagtctccagaagtctctttatattccccagggtggcatctcaggaaaatcactttccttttctcctttcaaagcactttaaatataaaggctgagctcttcaagagctctaacaatctcttctgaatgcgtatactctggaattctttaataacaggctttattattattctttttctttatccacacttataatacataaaataaatgcttatagtaatttttctcagcaaactctaatgtgagtagtagatctggttaatttggaaatatttcaataataattatgatgatgcaacaaaaacccattttcaatgtcacatttagtctttactaataagacagttgctggaaaataaatccttcttactatttctcagttttcatctccacagaataaagaatagtttcaatgcctaattatgagtttctatacacctgaaaga

SEQ ID NO: 5168 - DNA, 1283 bp, Homo sapiens
ctgagctctgagcgcctgcggtctcctgtgtgctgctctctgtggggtcctgtagacccagagaggctcagctgcactcgcccggctgggagagctgggtgtggggaacatggccgggcctccgaggctcctgctgctgcccctgcttctggcgctggctcgcggcctgcctggggccctggctgcccaagaggtgcagcagtctccccactgcacgactgtccccgtgggagcctccgtcaacatcacctgctccaccagcgggggcctgcgtgggatctacctgaggcagctcgggccacagccccaagacatcatttactacgaggacggggtggtgcccactacggacagacggttccggggccgcatcgacttctcagggtcccaggacaacctgactatcaccatgcaccgcctgcagctgtcggacactggcacctacacctgccaggccatcacggaggtcaatgtctacggctccggcaccctggtcctggtgacagaggaacagtcccaaggatggcacagatgctcggacgccccaccaagggcctctgccctccctgccccaccgacaggctccgccctccctgacccgcagacagcctctgccctccctgacccgccagcagcctctgccctccctgcggccctggcggtgatctccttcctcctcgggctgggcctgggggtggcgtgtgtgctggcgaggacacagataaagaaactgtgctcgtggcgggataagaattcggcggcatgtgtggtgtacgaggacatgtcgcacagccgctgcaacacgctgtcctcccccaaccagtaccagtgacccagtgggcccctgcacgtcccgcctgtggtccccccagcaccttccctgccccaccatgccccccaccctgccacacccctcaccctgctgtcctcccacggctgcagcagagtttgaagggcccagccgtgcccagctccaagcagacacacaggcagtggccaggccccacggtgcttctcagtggacaatgatgcctcctccgggaagccttccctgcccagcccacgccgccaccgggaggaagcctgactgtcctttggctgcatctcccgaccatggccaaggagggcttttctgtgggatgggcctgggcacgcggccctctcctgtcagtgccggcccacccaccagcaggcccccaacccccaggcagcccggcagaggacgggaggagaccagtcccccacccagccgtaccagaaataaaggcttctgtgcttccttt

SEQ ID NO: 5169 - DNA, 1548 bp, Homo sapiens
aattgctaagccgtgcagtcacagagggaacacagagcctagttgtaaacggacagagacgagaggggcaagggaggacagtggatgacagggaagacgagtgggggcagagctgctcaggaccatggctgaggccatcacctatgcagatctgaggtttgtgaaggctcccctgaagaagagcatctccagccggttaggacaggacccaggggctgatgatgatggggaaatcacctacgagaatgttcaagtgcccgcagtcctaggggtgccctcaagcttggcttcttctgtactaggggacaaagcagcggtcaagtcggagcagccaactgcgtcctggagagccgtgacgtcaccagctgtcgggcggattctcccctgccgcacaacctgcctgcgatacctcctgctcggcctgctcctcacctgcctgctgttaggagtgaccgccatctgcctgggagtgcgctatctgcaggtgtctcagcagctccagcagacgaacagggttctggaagtcactaacagcagcctgaggcagcagctccgcctcaagataacgcagctgggacagagtgcagaggatctgcaggggtccaggagagagctggcgcagagtcaggaagcactacaggtggaacagagggctcatcaggcggccgaagggcagctacaggcctgccaggcagacagacagaagacgaaggagaccttgcaaagtgaggagcaacagaggagggccttggagcagaagctgagcaacatggagaacagactgaagcccttcttcacatgcggctcagcagacacctgctgtccgtcgggatggataatgcatcagaaaagctgcttttacatctcacttacttcaaaaaattggcaggagagccaaaaacaatgtgaaactctgtcttccaagctggccacattcagtgaaatttatccacaatcacactcttactacttcttaaattcactgttgccaaatggtggttcagggaattcatattggactggcctcagctctaacaaggattggaagttgactgatgatacacaacgcactaggacttatgctcaaagctcaaaatgtaacaaggtacataaaacttggtcatggtggacactggagtcagagtcatgtagaagttctcttccctacatctgtgagatgacagctttcaggtttccagattaggacagtcctttgcactgagttgacactcatgccaacaagaacctgtgcccctccttcctaacctgaggcctggggttcctcagaccatctccttcattctgggcagtgcccagccaccggctgacccacacctgacacttccagccagtctgctgcctgctccctcttcctgaaactggactgttcctgggaaaagggtgaagccacctctagaagggactttggcctccccccaagaacttcccatggtagaatggggtgggggaggagggcgcacgggctgagcggataggggcggcccggagccagccaggcagttttattgaaatctttttaaataattg

SEQ ID NO: 5170 - DNA, 585 bp, Homo sapiens
ctagttgtaaacggacagagacgagaggggcaagggaggacagtggatgacagggaagacgagtgggggcagagctgctcaggaccatggctgaggccatcacctatgcagatctgaggtttgtgaaggctcccctgaagaagagcatctccagccggttaggacaggacccaggggctgatgatgatggggaaatcacctacgagaatgttcaagtgcccgcagtcctaggggtgccctcaagcttggcttcttctgtactaggggacaaagcagcggtcaagtcggagcagccaactgcgtcctggagagccgtgacgtcaccagctgtcgggcggattctcccctgtgagtgtgcctgtgcggggcagccgcggggccaagtgctcgcgcctgtcccggctgcggatggcgctgggccccgcggggtgcagctccttccgggataaacccgggcgcagtccttccgacgcccgggctgccgtgccacattcaccttcatccggtgcgcctgaatccgacgtgcaccgcccccctgcggatggtcccaattcacctacctgccccccttcccctctctccgtc

SEQ ID NO: 5171 - DNA, 849 bp, Homo sapiens
gacgagaggggcaagggaggacagtggatgacagggaagacgagtgggggcagagctgctcaggaccatggctgaggccatcacctatgcagatctgaggtttgtgaaggctcccctgaagaagagcatctccagccggttaggacaggacccaggggctgatgatgatggggaaatcacctacgagaatgttcaagtgcccgcagtcctaggggtgccctcaagcttggcttcttctgtactaggggacaaagcagcggtcaagtcggagcagccaactgcgtcctggagagccgtgacgtcaccagctgtcgggcggattctcccctgccgcacaacctgcctgcgatacctcctgctcggcctgctcctcacctgcctgctgttaggagtgaccgccatctgcctgggagtgcgctgtgagtaaggctgtccctacttcccacttacaccgaacgactttcgtcccgactctcgccccaaagctgatcttcctcagcagggatcatagtcactaccaccacctccttagctttgggtttggtttccagccagggctgttgtcttcctgaattgtcctcacctaatccagtacctccttacgctttagtcagtcaaatcttgtatttcagcctgtgatgcaaaaagttgcaagaagcagaaaaagggctgatgctgcagtctcagggcactagggcagggctggagaagacatccaccaaatctctgtggccaaacagatctgcaggtgtctcagcagctccagcagacgaacagggttctggaagtcactaacagcagcctgaggcagcagctccgcctcaagataacgcagctgggacagagtgc

SEQ ID NO: 5172 - DNA, 2035 bp, Homo sapiens
caccaccaatcatccgagctgttggcatgtgtcacagggccaattgctaagccgtgcagtcacagagggaacacagagcctagttgtaaacggacagagacgagaggggcaagggaggacagtggatgacagggaagacgagtgggggcagagctgctcaggaccatggctgaggccatcacctatgcagatctgaggtttgtgaaggctcccctgaagaagagcatctccagccggttaggacaggacccaggggctgatgatgatggggaaatcacctacgagaatgttcaagtgcccgcagtcctaggggtgccctcaagcttggcttcttctgtactaggggacaaagcagcggtcaagtcggagcagccaactgcgtcctggagagccgtgacgtcaccagctgtcgggcggattctcccctgccgcacaacctgcctgcgatacctcctgctcggcctgctcctcacctgcctgctgttaggagtgaccgccatctgcctgggagtgcgctatctgcaggtgtctcagcagctccagcagacgaacagggttctggaagtcactaacagcagcctgaggcagcagctccgcctcaagataacgcagctgggacagagtgcagaggatctgcaggggtccaggagagagctggcgcagagtcaggaagcactacaggtggaacagagggctcatcaggcggccgaagggcagctacaggcctgccaggcagacagacagaagacgaaggagaccttgcaaagtgaggagcaacagaggagggccttggagcagaagctgagcaacatggagaacagactgaagcccttcttcacatgcggctcagcagacacctgctgtccgtcgggatggataatgcatcagaaaagctgcttttacatctcacttacttcaaaaaattggcaggagagccaaaaacaatgtgaaactctgtcttccaagctggccacattcagtgaaatttatccacaatcacactcttactacttcttaaattcactgttgccaaatggtggttcagggaattcatattggactggcctcagctctaacaaggattggaagttgactgatgatacacaacgcactaggacttatgctcaaagctcaaaatgtaacaaggtacataaaacttggtcatggtggacactggagtcagagtcatgtagaagttctcttccctacatctgtgagatgacagctttcaggtttccagattaggacagtcctttgcactgagttgacactcatgccaacaagaacctgtgcccctccttcctaacctgaggcctggggttcctcagaccatctccttcattctgggcagtgcccagccaccggctgacccacacctgacacttccagccagtctgctgcctgctccctcttcctgaaactggactgttcctgggaaaagggtgaagccacctctagaagggactttggcctccccccaagaacttcccatggtagaatggggtgggggaggagggcgcacgggctgagcggataggggcggcccggagccagccaggcagttttattgaaatctttttaaataattgcacgtgttagtctcatgtgtcagcaatgctgtgtctggttcagtgatccccacgggaacgcgagccggggggtcgactggaagtgctctgtcccttgagtccatgctggggctcccctacacggggagaagagccggtcagcccatctggaactggcactgtccagcaagtgtgctctgttcttacagggtgtcctgaaggccaaagttggaggcctgagaccacgggctccactgctaagagcgtgccccaggcagctgcaggctgggtgtgggtggcttggcgtggtgccctcggtggcagaggagactgcccgcctcacagttcaggttgcggtagcgggcaacagctggtgtggggcgggggcacatggacaggaagccaaagctgaaggggccgaggcagcagccaggacagggcagcccctcatcgggctcccggggagc

SEQ ID NO: 5173 - DNA, 1424 bp, Homo sapiens
atgcaaaccaggaacccccagtctcatggggagaacggagcctcaccctggagctggggagatcgtctgggccctggcccagacccaggggctgatgatgatggggaaatcacctacgagaatgttcaagtgcccgcagtcctaggggtgccctcaagcttggcttcttctgtactaggggacaaagcagcggtcaagtcggagcagccaactgcgtcctggagagccgtgacgtcaccagctgtcgggcggattctcccctgccgcacaacctgcctgcgatacctcctgctcggcctgctcctcacctgcctgctgttaggagtgaccgccatctgcctgggagtgcgctatctgcaggtgtctcagcagctccagcagacgaacagggttctggaagtcactaacagcagcctgaggcagcagctccgcctcaagataacgcagctgggacagagtgcagaggatctgcaggggtccaggagagagctggcgcagagtcaggaagcactacaggtggaacagagggctcatcaggcggccgaagggcagctacaggcctgccaggcagacagacagaagacgaaggagaccttgcaaagtgaggagcaacagaggagggccttggagcagaagctgagcaacatggagaacagactgaagcccttcttcacatgcggctcagcagacacctgctgtccgtcgggatggataatgcatcagaaaagctgcttttacatctcacttacttcaaaaaattggcaggagagccaaaaacaatgtgaaactctgtcttccaagctggccacattcagtgaaatttatccacaatcacactcttactacttcttaaattcactgttgccaaatggtggttcagggaattcatattggactggcctcagctctaacaaggattggaagttgactgatgatacacaacgcactaggacttatgctcaaagctcaaaatgtaacaaggtacataaaacttggtcatggtggacactggagtcagagtcatgtagaagttctcttccctacatctgtgagatgacagctttcaggtttccagattaggacagtcctttgcactgagttgacactcatgccaacaagaacctgtgcccctccttcctaacctgaggcctggggttcctcagaccatctccttcattctgggcagtgcccagccaccggctgacccacacctgacacttccagccagtctgctgcctgctccctcttcctgaaactggactgttcctgggaaaagggtgaagccacctctagaagggactttggcctccccccaagaacttcccatggtagaatggggtgggggaggagggcgcacgggctgagcggataggggcggcccggagccagccaggcagttttattgaaatctttttaaataattg

SEQ ID NO: 5174 - DNA, 981 bp, Homo sapiens
agatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagtactgaccaagtgccaggaagaggtcagccacatccctgctgtccacccgggttcattcaggcccaagtgcgacgagaacggcaactatctgccactccagtgctatgggagcatcggctactgctggtgtgtcttccccaacggcacggaggtccccaacaccagaagccgcgggcaccataactgcagtgagtcactggaactggaggacccgtcttctgggctgggtgtgaccaagcaggatctgggcccagtccccatgtgagagcagcagaggcggtcttcaacatcctgccagccccacacagctacagctttcttgctcccttcagcccccagcccctcccccatct

SEQ ID NO: 5175 - DNA, 1449 bp, Homo sapiens
gggagcccccccgccccacatcctgccccgcaaaaggcagcttcaccaaagtggggtatttccagcctttgtagctttcacttccacatctaccaagtgggcggagtggccttctgtggacgaatcagattcctctccagcaccgactttaagaggcgagccggggggtcagggtcccagatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagagtcactggaactggaggacccgtcttctgggctgggtgtgaccaagcaggatctgggcccagtccccatgtgagagcagcagaggcggtcttcaacatcctgccagccccacacagctacagctttcttgctcccttcagcccccagcccctcccccatctcccaccctgtacctcatcccatgagaccctggtgcctggctctttcgtcacccttggacaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagccaagcttgttatcagctttcagggccatgg

SEQ ID NO: 5176 - DNA, 1138 bp, Homo sapiens
ccggggggtcagggtcccagatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagagtcactggaactggaggacccgtcttctgggctgggtgtgaccaagcaggatctgggcccagtccccatgtgagagcagcagaggcggtcttcaacatcctgccagccccacacagctacagctttcttgctcccttcagcccccagcccctcccccatctcccaccctgtacctcatcccatgagaccctggtgcctggctctttcgtcacccttggacaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagccaagcttgttatcagctttcagggccatggttcacattagaataaaaggtagtaattagaaca

SEQ ID NO: 5177 - DNA, 1727 bp, Homo sapiens
caggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagtactgaccaagtgccaggaagaggtcagccacatccctgctgtccacccgggttcattcaggcccaagtgcgacgagaacggcaactatctgccactccagtgctatgggagcatcggctactgctggtgtgtcttccccaacggcacggaggtccccaacaccagaagccgcgggcaccataactgcagtgagtcactggaactggaggacccgtcttctgggctgggtgtgaccaagcaggatctgggcccaggtaagggccttgcagaggggcatctggtcaccagcagctcatccccagcagggccagctcctttgtgggcaggtgaaggagtgtgacgctgggccactctccaacattcctgggatgtccatttcacagacgaaggaacagggttggggggctgtggggagttacacaaatccatgatggtcattattggacctgagcagggggcaggggagggtggacagtccttaactgctctgcaggtccaggatgttagaaaggggcagggacaacaaatgggtgaccccaacctcaacctgctgcttctctctccagtccccatgtgagagcagcagaggcggtcttcaacatcctgccagccccacacagctacagctttcttgctcccttcagcccccagcccctcccccatctcccaccctgtacctcatcccatgagaccctggtgcctggctctttcgtcacccttggacaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagcc

SEQ ID NO: 5178 - DNA, 563 bp, Homo sapiens
agatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagccccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaaggtacagggagtgggag

SEQ ID NO: 5179 - DNA, 584 bp, Homo sapiens
agatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccaggaagtggccaaaagctagacagatccccgttcctgacatcacagcagcctccaacacaaggctccaagacctaggctcatggacgagatgggaaggcacagggagaagggataaccctacacccagaccccaggctggaca

SEQ ID NO: 5180 - DNA, 1269 bp, Homo sapiens
aggggacaggctgcagccggtgcagttacacgttttcctccaaggagcctcggacgttgtcacgggtttggggtcggggacagagcggtgaccatggccaggctggcgttgtctcctgtgcccagccactggatggtggcgttgctgctgctgctctcagctgagccagtaccagcagccagatcggaggaccggtaccggaatcccaaaggtagtgcttgttcgcggatctggcagagcccacgtttcatagccaggaaacggggcttcacggtgaaaatgcactgctacatgaacagcgcctccggcaatgtgagctggctctggaagcaggagatggacgagaatccccagcagctgaagctggaaaagggccgcatggaagagtcccagaacgaatctctcgccaccctcaccatccaaggcatccggtttgaggacaatggcatctacttctgtcagcagaagtgcaacaacacctcggaggtctaccagggctgcggcacagagctgcgagtcatgggattcagcaccttggcacagctgaagcagaggaacacgctgaaggatggtatcatcatgatccagacgctgctgatcatcctcttcatcatcgtgcctatcttcctgctgctggacaaggatgacagcaaggctggcatggaggaagatcacacctacgagggcctggacattgaccagacagccacctatgaggacatagtgacgctgcggacaggggaagtgaagtggtctgtaggtgagcacccaggccaggagtgagagccaggtcgccccatgacctgggtgcaggctccctggcctcagtgactgcttcggagctgcctggctcatggcccaacccctttcctggaccccccagctggcctctgaagctggcccaccagagctgccatttgtctccagcccctggtccccagctcttgccaaagggcctggagtagaaggacaacagggcagcaacttggagggagttctctggggatggacgggacccagccttctgggggtgctatgaggtgatccgtccccacacatgggatgggggaggcagagactggtccagagcccgcaaatggactcggagccgagggcctcccagcagagcttgggaagggccatggacccaactgggccccagaagagccacaggaacatcattcctctcccgcaaccactcccaccccagggaggccctggcctccagtgccttcccccgtggaataaacggtgtgtcctgagaaacca

SEQ ID NO: 5181 - DNA, 378 bp, Homo sapiens
atggccaggctggcgttgtctcctgtgcccagccactggatggtggcgttgctgctgctgctctcagctgagccagtaccagcagccagatcggaggaccggtaccggaatcccaaaggattcagcaccttggcacagctgaagcagaggaacacgctgaaggatggtatcatcatgatccagacgctgctgatcatcctcttcatcatcgtgcctatcttcctgctgctggacaaggatgacagcaaggctggcatggaggaagatcacacctacgagggcctggacattgaccagacagccacctatgaggacatagtgacgctgcggacaggggaagtgaagtggtctgtaggtgagcacccaggccaggagtga

SEQ ID NO: 5182 - DNA, 1254 bp, Homo sapiens
ggtgcagttacacgttttcctccaaggagcctcggacgttgtcacgggtttggggtcggggacagagcggtgaccatggccaggctggcgttgtctcctgtgcccagccactggatggtggcgttgctgctgctgctctcagcagctgagccagtaccagcagccagatcggaggaccggtaccggaatcccaaaggtagtgcttgttcgcggatctggcagagcccacgtttcatagccaggaaacggggcttcacggtgaaaatgcactgctacatgaacagcgcctccggcaatgtgagctggctctggaagcaggagatggacgagaatccccagcagctgaagctggaaaagggccgcatggaagagtcccagaacgaatctctcgccaccctcaccatccaaggcatccggtttgaggacaatggcatctacttctgtcagcagaagtgcaacaacacctcggaggtctaccagggctgcggcacagagctgcgagtcatgggattcagcaccttggcacagctgaagcagaggaacacgctgaaggatggtatcatcatgatccagacgctgctgatcatcctcttcatcatcgtgcctatcttcctgctgctggacaaggatgacagcaaggctggcatggaggaagatcacacctacgagggcctggacattgaccagacagccacctatgaggacatagtgacgctgcggacaggggaagtgaagtggtctgtaggtgagcacccaggccaggagtgagagccaggtcgccccatgacctgggtgcaggctccctggcctcagtgactgcttcggagctgcctggctcatggcccaacccctttcctggaccccccagctggcctctgaagctggcccaccagagctgccatttgtctccagcccctggtccccagctcttgccaaagggcctggagtagaaggacaacagggcagcaacttggagggagttctctggggatggacgggacccagccttctgggggtgctatgaggtgatccgtccccacacatgggatgggggaggcagagactggtccagagcccgcaaatggactcggagccgagggcctcccagcagagcttgggaagggccatggacccaactgggccccagaagagccacaggaacatcattcctctcccgcaaccactcccaccccagggaggccctggcctccagtgccttcccccgtggaataaacggtgtgtcctgagaaacca

SEQ ID NO: 5183 - DNA, 1498 bp, Homo sapiens
agcgaggcgcgcgcccggccagagagcgagcgcgcaacggcggcgacggcggcgaccccaccgcgcatcctgccaggcctccggcgcccagcgccccacgcgcccccgcgcccccgcgcccccgcgcccctttcttcgcgcccccgcccctcggcccgccaggcccccttgccggccacccgccaggccccgcgccggcccgcccgccgcccaggaccggcccgcgccccgcaggccgcccgccgcccgcgccgccatgggagtggagggctgcaccaagtgcatcaagtacctgctcttcgtcttcaatttcgtcttctggctggctggaggcgtgatcctgggtgtggccctgtggctccgccatgacccgcagaccaccaacctcctgtatctggagctgggagacaagcccgcgcccaacaccttctatgtaggcatctacatcctcatcgctgtgggcgctgtcatgatgttcgttggcttcctgggctgctacggggccatccaggaatcccagtgcctgctggggacgttcttcacctgcctggtcatcctgtttgcctgtgaggtggccgccggcatctggggctttgtcaacaaggaccagatcgccaaggatgtgaagcagttctatgaccaggccctacagcaggccgtggtggatgatgacgccaacaacgccaaggctgtggtgaagaccttccacgagacgcttgactgctgtggctccagcacactgactgctttgaccacctcagtgctcaagaacaatttgtgtccctcgggcagcaacatcatcagcaacctcttcaaggaggactgccaccagaagatcgatgacctcttctccgggaagctgtacctcatcggcattgctgccatcgtggtcgctgtgatcatgatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctacacgtagcctttttacttttggggttttgtttttgttctgaactttcctgttaccttttcagggctgacgtcacatgtaggtggcgtgtatgagtggagacgggcctgggtcttggggactggagggcaggggtccttctgccctggggtcccagggtgctctgcctgctcagccaggcctctcctgggagccactcgcccagagactcagcttggccaacttggggggctgtgtccacccagcccgcccgtcctgtgggctgcacagctcaccttgttccctcctgccccggttcgagagccgagtctgtgggcactctctgccttcatgcacctgtcctttctaacacgtcgccttcaactgtaatcacaacatcctgactccgtcatttaataaagaaggaacatcaggcatgcta

SEQ ID NO: 5184 - DNA, 2471 bp, Homo sapiens
gcgccccggcctaagcgggactaggagggcgcgccacccgcttccgctgcccgccggggaatcccccgggctggcgcgcagggaagttcccgaacgcgcgggcataaaagggcagccggcgcccgcgcgccacagctctgcagctcgtggcagcggcgcagcgctccagccatgtcgcgcggcctccagcttctgctcctgagctgcgcctacagcctggctcccgcgacgccggaggtgaaggtggcttgctccgaagatgtggacttgccctgcaccgccccctgggatccgcaggttccctacacggtctcctgggtcaagttattggagggtggtgaagagaggatggagacaccccaggaagaccacctcaggggacagcactatcatcagaaggggcaaaatggttctttcgacgcccccaatgaaaggccctattccctgaagatccgaaacactaccagctgcaactcggggacatacaggtgcactctgcaggacccggatgggcagagaaacctaagtggcaaggtgatcttgagagtgacaggatgccctgcacagcgtaaagaagagacttttaagaaatacagagcggagattgtcctgctgctggctctggttattttctacttaacactcatcattttcacttgtaagtttgcacggctacagagtatcttcccagatttttctaaagctggcatggaacgagcttttctcccagttacctccccaaataagcatttagggctagtgactcctcacaagacagaactggtatgagcaggatttctgcaggttcttcttcctgaagctgaggctcaggggtgtgcctgtctgttacactggaggagagaagaatgagcctacgctgaagatggcatcctgtgaagtccttcacctcactgaaaacatctggaaggggatcccaccccattttctgtgggcaggcctcgaaaaccatcacatgaccacatagcatgaggccactgctgcttctccatggccaccttttcagcgatgtatgcagctatctggtcaacctcctggacattttttcagtcatataaaagctatggtgagatgcagctggaaaagggtcttgggaaatatgaatgcccccagctggcccgtgacagactcctgaggacagctgtcctcttctgcatcttggggacatctctttgaattttctgtgttttgctgtaccagcccagatgttttacgtctgggagaaattgacagatcaagctgtgagacagtgggaaatatttagcaaataatttcctggtgtgaaggtcctgctattactaaggagtaatctgtgtacaaagaaataacaagtcgatgaactattccccagcagggtcttttcatctgggaaagacatccataaagaagcaataaagaagagtgccacatttatttttatatctatatgtacttgtcaaagaaggtttgtgtttttctgcttttgaaatctgtatctgtagtgagatagcattgtgaactgacaggcagcctggacatagagagggagaagaagtcagagagggtgacaagatagagagctatttaatggccggctggaaatgctgggctgacggtgcagtctgggtgctcgcccacttgtcccactatctgggtgcatgatcttgagcaagttccttctggtgtctgctttctccattgtaaaccacaaggctgttgcatgggctaatgaagatcatatacgtgaaaattatttgaaaacatataaagcactatacagattcgaaactccattgagtcattatccttgctatgatgatggtgttttggggatgagagggtgctatccatttctcatgttttccattgtttgaaacaaagaaggttaccaagaagcctttcctgtagccttctgtaggaattcttttggggaagtgaggaagccaggtccacggtctgttcttgaagcagtagcctaacacactccaagatatggacacacgggagccgctggcagaagggacttcacgaagtgttgcatggatgttttagccattgttggctttcccttatcaaacttgggcccttcccttcttggtttccaaaggcattttattgcttgagttatatgttcactgtccccctaatattagggagtaaaacggataccaagttgatttagtgtttttacctctgtcttggctttcatgttattaaacgtatgcatgtgaagaaagggtgtttttctgttttatattcaactcataagactttgggataggaaaaatgagtaatggttactaggcttaatacctgggtgattacataatctgtacaatgaacccccatgatgtaagtttacctatgtaacaaacctgcacttatacccatgaacttaaaatgaaagttaaaaataaaaaacatatacaaataaaaaaatcccgactttgggatgagtgctaggatgttgtaaa

SEQ ID NO: 5185 - DNA, 2068 bp, Homo sapiens
ggaaggcttgcacagggtgaaagctttgcttctctgctgctgtaacagggactagcacagacacacggatgagtggggtcatttccagatattaggtcacagcagaagcagccaaaatggatccccagtgcactatgggactgagtaacattctctttgtgatggccttcctgctctctgagcttgaggaccctcagcctcccccagaccacattccttggattacagctgtacttccaacagttattatatgtgtgatggttttctgtctaattctatggaaatggaagaagaagaagcggcctcgcaactcttataaatgtggaaccaacacaatggagagggaagagagtgaacagaccaagaaaagagaaaaaatccatatacctgaaagatctgatgaagcccagcgtgtttttaaaagttcgaagacatcttcatgcgacaaaagtgatacatgtttttaattaaagagtaaagcccatacaagtattcattttttctaccctttcctttgtaagttcctgggcaacctttttgatttcttccagaaggcaaaaagacattaccatgagtaataagggggctccaggactccctctaagtggaatagcctccctgtaactccagctctgctccgtatgccaagaggagactttaattctcttactgcttcttttcacttcagagcacacttatgggccaagcccagcttaatggctcatgacctggaaataaaatttaggaccaatacctcctccagatcagattcttctcttaatttcatagattgtgttttttttttaaatagacctctcaatttctggaaaactgccttttatctgcccagaattctaagctggtgccccactgaattttgtgtgtacctgtgactaaacaactacctcctcagtctgggtgggacttatgtatttatgaccttatagtgttaatatcttgaaacatagagatctatgtactgtaatagtgtgattactatgctctagagaaaagtctacccctgctaaggagttctcatccctctgtcagggtcagtaaggaaaacggtggcctagggtacaggcaacaatgagcagaccaacctaaatttggggaaattaggagaggcagagatagaacctggagccacttctatctgggctgttgctaatattgaggaggcttgccccacccaacaagccatagtggagagaactgaataaacaggaaaatgccagagcttgtgaaccctgtttctcttgaagaactgactagtgagatggcctggggaagctgtgaaagaaccaaaagagatcacaatactcaaaagagagagagagagaaaaaagagagatcttgatccacagaaatacatgaaatgtctggtctgtccaccccatcaacaagtcttgaaacaagcaacagatggatagtctgtccaaatggacataagacagacagcagtttccctggtggtcagggaggggttttggtgatacccaagttattgggatgtcatcttcctggaagcagagctggggagggagagccatcaccttgataatgggatgaatggaaggaggcttaggactttccactcctggctgagagaggaagagctgcaacggaattaggaagaccaagacacagatcacccggggcttacttagcctacagatgtcctacgggaacgtgggctggcccagcatagggctagcaaatttgagttggatgattgtttttgctcaaggcaaccagaggaaacttgcatacagagacagatatactgggagaaatgactttgaaaacctggctctaaggtgggatcactaagggatggggcagtctctgcccaaacataaagagaactctggggagcctgagccacaaaaatgttcctttattttatgtaaaccctcaagggttatagactgccatgctagacaagcttgtccatgtaatattcccatgtttttaccctgcccctgccttgattagactcctagcacctggctagtttctaacatgttttgtgcagcacagtttttaataaatgcttgttacattc

SEQ ID NO: 5186 - DNA, 2708 bp, Homo sapiens
ggaaggcttgcacagggtgaaagctttgcttctctgctgctgtaacagggactagcacagacacacggatgagtggggtcatttccagatattaggtcacagcagaagcagccaaaatggatccccagtgcactatgggactgagtaacattctctttgtgatggccttcctgctctctggtgctgctcctctgaagattcaagcttatttcaatgagactgcagacctgccatgccaatttgcaaactctcaaaaccaaagcctgagtgagctagtagtattttggcaggaccaggaaaacttggttctgaatgaggtatacttaggcaaagagaaatttgacagtgttcattccaagtatatgggccgcacaagttttgattcggacagttggaccctgagacttcacaatcttcagatcaaggacaagggcttgtatcaatgtatcatccatcacaaaaagcccacaggaatgattcgcatccaccagatgaattctgaactgtcagtgcttgctaacttcagtcaacctgaaatagtaccaatttctaatataacagaaaatgtgtacataaatttgacctgctcatctatacacggttacccagaacctaagaagatgagtgttttgctaagaaccaagaattcaactatcgagtatgatggtgttatgcagaaatctcaagataatgtcacagaactgtacgacgtttccatcagcttgtctgtttcattccctgatgttacgagcaatatgaccatcttctgtattctggaaactgacaagacgcggcttttatcttcacctttctctatagagcttgaggaccctcagcctcccccagaccacattccttggattacagctgtacttccaacagttattatatgtgtgatggttttctgtctaattctatggaaatggaagaagaagaagcggcctcgcaactcttataaatgtggaaccaacacaatggagagggaagagagtgaacagaccaagaaaagagaaaaaatccatatacctgaaagatctgatgaagcccagcgtgtttttaaaagttcgaagacatcttcatgcgacaaaagtgatacatgtttttaattaaagagtaaagcccatacaagtattcattttttctaccctttcctttgtaagttcctgggcaacctttttgatttcttccagaaggcaaaaagacattaccatgagtaataagggggctccaggactccctctaagtggaatagcctccctgtaactccagctctgctccgtatgccaagaggagactttaattctcttactgcttcttttcacttcagagcacacttatgggccaagcccagcttaatggctcatgacctggaaataaaatttaggaccaatacctcctccagatcagattcttctcttaatttcatagattgtgttttttttttaaatagacctctcaatttctggaaaactgccttttatctgcccagaattctaagctggtgccccactgaattttgtgtgtacctgtgactaaacaactacctcctcagtctgggtgggacttatgtatttatgaccttatagtgttaatatcttgaaacatagagatctatgtactgtaatagtgtgattactatgctctagagaaaagtctacccctgctaaggagttctcatccctctgtcagggtcagtaaggaaaacggtggcctagggtacaggcaacaatgagcagaccaacctaaatttggggaaattaggagaggcagagatagaacctggagccacttctatctgggctgttgctaatattgaggaggcttgccccacccaacaagccatagtggagagaactgaataaacaggaaaatgccagagcttgtgaaccctgtttctcttgaagaactgactagtgagatggcctggggaagctgtgaaagaaccaaaagagatcacaatactcaaaagagagagagagagaaaaaagagagatcttgatccacagaaatacatgaaatgtctggtctgtccaccccatcaacaagtcttgaaacaagcaacagatggatagtctgtccaaatggacataagacagacagcagtttccctggtggtcagggaggggttttggtgatacccaagttattgggatgtcatcttcctggaagcagagctggggagggagagccatcaccttgataatgggatgaatggaaggaggcttaggactttccactcctggctgagagaggaagagctgcaacggaattaggaagaccaagacacagatcacccggggcttacttagcctacagatgtcctacgggaacgtgggctggcccagcatagggctagcaaatttgagttggatgattgtttttgctcaaggcaaccagaggaaacttgcatacagagacagatatactgggagaaatgactttgaaaacctggctctaaggtgggatcactaagggatggggcagtctctgcccaaacataaagagaactctggggagcctgagccacaaaaatgttcctttattttatgtaaaccctcaagggttatagactgccatgctagacaagcttgtccatgtaatattcccatgtttttaccctgcccctgccttgattagactcctagcacctggctagtttctaacatgttttgtgcagcacagtttttaataaatgcttgttacattca

SEQ ID NO: 5187 - DNA, 1405 bp, Homo sapiens
aggagccttaggaggtacggggagctcgcaaatactccttttggtttattcttaccaccttgcttctgtgttccttgggaatgctgctgtgcttatgcatctggtctctttttggagctacagtggacaggcatttgtgacagcactatgggactgagtaacattctctttgtgatggccttcctgctctctggtgctgctcctctgaagattcaagcttatttcaatgagactgcagacctgccatgccaatttgcaaactctcaaaaccaaagcctgagtgagctagtagtattttggcaggaccaggaaaacttggttctgaatgaggtatacttaggcaaagagaaatttgacagtgttcattccaagtatatgggccgcacaagttttgattcggacagttggaccctgagacttcacaatcttcagatcaaggacaagggcttgtatcaatgtatcatccatcacaaaaagcccacaggaatgattcgcatccaccagatgaattctgaactgtcagtgcttgctaacttcagtcaacctgaaatagtaccaatttctaatataacagaaaatgtgtacataaatttgacctgctcatctatacacggttacccagaacctaagaagatgagtgttttgctaagaaccaagaattcaactatcgagtatgatggtgttatgcagaaatctcaagataatgtcacagaactgtacgacgtttccatcagcttgtctgtttcattccctgatgttacgagcaatatgaccatcttctgtattctggaaactgacaagacgcggcttttatcttcacctttctctatagagcttgaggaccctcagcctcccccagaccacattccttggattacagctgtacttccaacagttattatatgtgtgatggttttctgtctaattctatggaaatggaagaagaagaagcggcctcgcaactcttataaatgtggaaccaacacaatggagagggaagagagtgaacagaccaagaaaagagaaaaaatccatatacctgaaagatctgatgaagcccagcgtgtttttaaaagttcgaagacatcttcatgcgacaaaagtgatacatgtttttaattaaagagtaaagcccatacaagtattcattttttctaccctttcctttgtaagttcctgggcaacctttttgatttcttccagaaggcaaaaagacattaccatgagtaataagggggctccaggactccctctaagtggaatagcctccctgtaactccagctctgctccgtatgccaagaggagactttaattctcttactgcttcttttcacttcagagcacacttatgggccaagcccagcttaatggctcatgacctggaaataaaatttaggaccaata

SEQ ID NO: 5188 - DNA, 567 bp, Homo sapiens
gtatttgagttctaccgtcagtcctggcattatttctctctctacaaggagccttaggagcactatgggactgagtaacattctctttgtgatggccttcctgctctctggtgctgctcctctgaagattcaagcttatttcaatgagactgcagacctgccatgccaatttgcaaactctcaaaaccaaagcctgagtgagctagtagtattttggcaggaccaggaaaacttggttctgaatgaggtatacttaggcaaagagaaatttgacagtgttcattccaagtatatgggccgcacaagttttgattcggacagttggaccctgagacttcacaatcttcagatcaaggacaagggcttgtatcaatgtatcatccatcacaaaaagcccacaggaatgattcgcatccaccagatgaattctgaactgtcagtgcttgctaacttcagtcaacctgaaatagtaccaatttctaatataacagaaaatgtgtacataaatttgacctgctcatctatacacggttacccagaacctaagaagatgagtgttttgctaag

SEQ ID NO: 5189 - DNA, 1604 bp, Homo sapiens
attgccgaggaaggcttgcacagggtgaaagctttgcttctctgctgctgtaacagggactagcacagacacacggatgagtggggtcatttccagatattaggtcacagcagaagcagccaaaatggatccccagtggtgctgctcctctgaagattcaagcttatttcaatgagactgcagacctgccatgccaatttgcaaactctcaaaaccaaagcctgagtgagctagtagtattttggcaggaccaggaaaacttggttctgaatgaggtatacttaggcaaagagaaatttgacagtgttcattccaagtatatgggccgcacaagttttgattcggacagttggaccctgagacttcacaatcttcagatcaaggacaagggcttgtatcaatgtatcatccatcacaaaaagcccacaggaatgattcgcatccaccagatgaattctgaactgtcagtgcttgctaacttcagtcaacctgaaatagtaccaatttctaatataacagaaaatgtgtacataaatttgacctgctcatctatacacggttacccagaacctaagaagatgagtgttttgctaagaaccaagaattcaactatcgagtatgatggtgttatgcagaaatctcaagataatgtcacagaactgtacgacgtttccatcagcttgtctgtttcattccctgatgttacgagcaatatgaccatcttctgtattctggaaactgacaagacgcggcttttatcttcacctttctctatagagcttgaggaccctcagcctcccccagaccacattccttggattacagctgtacttccaacagttattatatgtgtgatggttttctgtctaattctatggaaatggaagaagaagaagcggcctcgcaactcttataaatgtggaaccaacacaatggagagggaagagagtgaacagaccaagaaaagagaaaaaatccatatacctgaaagatctgatgaagcccagcgtgtttttaaaagttcgaagacatcttcatgcgacaaaagtgatacatgtttttaattaaagagtaaagcccatacaagtattcattttttctaccctttcctttgtaagttcctgggcaacctttttgatttcttccagaaggcaaaaagacattaccatgagtaataagggggctccaggactccctctaagtggaatagcctccctgtaactccagctctgctccgtatgccaagaggagactttaattctcttactgcttcttttcacttcagagcacacttatgggccaagcccagcttaatggctcatgacctggaaataaaatttaggaccaatacctcctccagatcagattcttctcttaatttcatagattgtgttttttttttaaatagacctctcaatttctggaaaactgccttttatctgcccagaattctaagctggtgccccactgaattttgtgtgtacctgtgactaaacaactacctcctcagtctgggtgggacttatgtatttatgaccttatagtgttaatatcttgaaacatagagatctatgtactgtaatagtgtgattactatgctctag

SEQ ID NO: 5190 - DNA, 1572 bp, Homo sapiens
attgccgaggaaggcttgcacagggtgaaagctttgcttctctgctgctgtaacagggactagcacagacacacggatgagtggggtcatttccagatattaggtcacagcagaagcagccaaaatggatccccagtgcactatgggactgagtaacattctctttgtgatggccttcctgctctctgctaacttcagtcaacctgaaatagtaccaatttctaatataacagaaaatgtgtacataaatttgacctgctcatctatacacggttacccagaacctaagaagatgagtgttttgctaagaaccaagaattcaactatcgagtatgatggtgttatgcagaaatctcaagataatgtcacagaactgtacgacgtttccatcagcttgtctgtttcattccctgatgttacgagcaatatgaccatcttctgtattctggaaactgacaagacgcggcttttatcttcacctttctctatagagcttgaggaccctcagcctcccccagaccacattccttggattacagctgtacttccaacagttattatatgtgtgatggttttctgtctaattctatggaaatggaagaagaagaagcggcctcgcaactcttataaatgtggaaccaacacaatggagagggaagagagtgaacagaccaagaaaagagaaaaaatccatatacctgaaagatctgatgaagcccagcgtgtttttaaaagttcgaagacatcttcatgcgacaaaagtgatacatgtttttaattaaagagtaaagcccatacaagtattcattttttctaccctttcctttgtaagttcctgggcaacctttttgatttcttccagaaggcaaaaagacattaccatgagtaataagggggctccaggactccctctaagtggaatagcctccctgtaactccagctctgctccgtatgccaagaggagactttaattctcttactgcttcttttcacttcagagcacacttatgggccaagcccagcttaatggctcatgacctggaaataaaatttaggaccaatacctcctccagatcagattcttctcttaatttcatagattgtgttttttttttaaatagacctctcaatttctggaaaactgccttttatctgcccagaattctaagctggtgccccactgaattttgtgtgtacctgtgactaaacaactacctcctcagtctgggtgggacttatgtatttatgaccttatagtgttaatatcttgaaacatagagatctatgtactgtaatagtgtgattactatgctctagagaaaagtctacccctgctaaggagttctcatccctctgtcagggtcagtaaggaaaacggtggcctagggtacaggcaacaatgagcagaccaacctaaatttggggaaattaggagaggcagagatagaacctggagccacttctatctgggctgttgctaatattgaggaggcttgccccacccaacaagccatagtggagagaactgaataaacaggaaaatgccagagcttgtgaaccctgtttctctt

SEQ ID NO: 5191 - DNA, 832 bp, Homo sapiens
gcgactgtctccgccgagcccccggggccaggtgtcccgggcgcgccacgatgcggccgcggctgtggctcctcttggccgcgcagctgacagttctccatggcaactcagtcctccagcagacccctgcatacataaaggtgcaaaccaacaagatggtgatgctgtcctgcgaggctaaaatctccctcagtaacatgcgcatctactggctgagacagcgccaggcaccgagcagtgacagtcaccacgagttcctggccctctgggattccgcaaaagggactatccacggtgaagaggtggaacaggagaagatagctgtgtttcgggatgcaagccggttcattctcaatctcacaagcgtgaagccggaagacagtggcatctacttctgcatgatcgtcgggagccccgagctgaccttcgggaagggaactcagctgagtgtggttgatttccttcccaccactgcccagcccaccaagaagtccaccctcaagaagagagtgtgccggttacccaggccagagacccagaagggcccactttgtagccccatcacccttggcctgctggtggctggcgtcctggttctgctggtttccctgggagtggccatccacctgtgctgccggcggaggagagcccggcttcgtttcatgaaacagcctcaaggggaaggtatatcaggaacctttgtcccccaatgcctgcatggatactacagcaatactacaacctcacagaagctgcttaacccatggatcctgaaaacataggcaagaagcacaggtcctgatgagtggatctttactacttttaccagatt

SEQ ID NO: 5192 - DNA, 849 bp, Homo sapiens
gcgactgtctccgccgagcccccggggccaggtgtcccgggcgcgccacgatgcggccgcggctgtggctcctcttggccgcgcagctgacagttctccatggcaactcagtcctccagcagacccctgcatacataaaggtgcaaaccaacaagatggtgatgctgtcctgcgaggctaaaatctccctcagtaacatgcgcatctactggctgagacagcgccaggcaccgagcagtgacagtcaccacgagttcctggccctctgggattccgcaaaagggactatccacggtgaagaggtggaacaggagaagatagctgtgtttcgggatgcaagccggttcattctcaatctcacaagcgtgaagccggaagacagtggcatctacttctgcatgatcgtcgggagccccgagctgaccttcgggaagggaactcagctgagtgtggttgatttccttcccaccactgcccagcccaccaagaagtccaccctcaagaagagagtgtgccggttacccaggccagagacccagaagggccggcggaggagagcccggcttcgtttcatgaaacagcctcaaggggaaggtatatcaggaacctttgtcccccaatgcctgcatggatactacagcaatactacaacctcacagaagctgcttaacccatggatcctgaaaacataggcaagaagcacaggtcctgatgagtggatctttactacttttaccagattcctccctcgctcagagggatcctcccacacacccagcagagacttctctgccaccatcaaccccccaagtcatagggggctcaagttctgccctggtgagctgtggc

SEQ ID NO: 5193 - DNA, 1417 bp, Homo sapiens
accccagccgcgactgtctccgccgagcccccggggccaggtgtcccgggcgcgccacgatgcggccgcggctgtggctcctcttggccgcgcagctgacagttctccatggcaactcagtcctccagcagacccctgcatacataaaggtgcaaaccaacaagatggtgatgctgtcctgcgaggctaaaatctccctcagtaacatgcgcatctactggctgagacagcgccaggcaccgagcagtgacagtcaccacgagttcctggccctctgggattccgcaaaagggactatccacggtgaagaggtggaacaggagaagatagctgtgtttcgggatgcaagccggttcattctcaatctcacaagcgtgaagccggaagacagtggcatctacttctgcatgatcgtcgggagccccgagctgaccttcgggaagggaactcagctgagtgtggttgatttccttcccaccactgcccagcccaccaagaagtccaccctcaagaagagagtgtgccggttacccaggccagagacccagaagggcccactttgtagccccatcacccttggcctgctggtggctggcgtcctggttctgctggtttccctgggagtggccatccacctgtgctgccggcggaggagagcccggcttcgtttcatgaaacaattttacaaatgagcagagaatacggttttggtgtcctgctacaaaaagacatcggtcagtaacgagcacgatgtggaaaaatgagagaagggacacattcaaccctggagagttcaatggctgctgaagctgcctgcttttcactgctgcaaggcctttctgtgtgtgatgtgcatgggagcaacttgttcgtgggtcatcgggaatactagggagaaggtttcattgcccccagggcacttcacagagtgtgctggaggactgagtaagaaatgctgcccatgccaccgcttccggctcctgtgctttccctgaactgggacctttagtggtggccatttagccaccatctttgcaggttgctttgccctggtagggcagtaacattgggtcctgggtctttcatggggtgatgctgggctggctccctcttggtcttcccaggctggggctgaccttcctcgcagagaggccaggtgcaggttgggaatgaggcttgctgagaggggctgtccagttcccagaaggcatatcagtctctgagggcttcctttggggccgggaacttgcgggtttgaggataggagttcacttcatcttctcagctcccatttctactcttaagtttctcagctcccatttctactctcccatggcttaatgcttctttcattttctgtttgttttatacaaatgtcttagttgtacaaataaagtcccaggttaaagataacaaa

SEQ ID NO: 5194 - DNA, 1096 bp, Homo sapiens
gcgactgtctccgccgagcccccggggccaggtgtcccgggcgcgccacgatgcggccgcggctgtggctcctcttggccgcgcagctgacagttctccatggcaactcagtcctccagcagacccctgcatacataaaggtgcaaaccaacaagatggtgatgctgtcctgcgaggctaaaatctccctcagtaacatgcgcatctactggctgagacagcgccaggcaccgagcagtgacagtcaccacgagttcctggccctctgggattccgcaaaagggactatccacggtgaagaggtggaacaggagaagatagctgtgtttcgggatgcaagccggttcattctcaatctcacaagcgtgaagccggaagacagtggcatctacttctgcatgatcgtcgggagccccgagctgaccttcgggaagggaactcagctgagtgtggttgatttccttcccaccactgcccagcccaccaagaagtccaccctcaagaagagagtgtgccggttacccaggccagagacccagaagggcccactttgtagccccatcacccttggcctgctggtggctggcgtcctggttctgctggtttccctgggagtggccatccacctgtgctgccggcggaggagagcccggcttcgtttcatgaaacaactaagattacatccactggagaaatgttccagaatggactactgaatatacaggcctcaaggggaaggtatatcaggaacctttgtcccccaatgcctgcatggatactacagcaatactacaacctcacagaagctgcttaacccatggatcctgaaaacataggcaagaagcacaggtcctgatgagtggatctttactacttttaccagattcctccctcgctcagagggatcctcccacacacccagcagagacttctctgccaccatcaaccccccaagtcatagggggctcaagttctgccctggtgagctgtggcccccatccttgtgaaccccaaagtgtcccccttgtggaaccaaatgtatccatcttgaataaatttgcccaaaatcctaaagaccgggaaaagggaaccattg

SEQ ID NO: 5195 - DNA, 932 bp, Homo sapiens
accccagccgcgactgtctccgccgagcccccggggccaggtgtcccgggcgcgccacgatgcggccgcggctgtggctcctcttggccgcgcagctgacagttctccatggcaactcagtcctccagcagacccctgcatacataaaggtgcaaaccaacaagatggtgatgctgtcctgcgaggctaaaatctccctcagtaacatgcgcatctactggctgagacagcgccaggcaccgagcagtgacagtcaccacgagttcctggccctctgggattccgcaaaagggactatccacggtgaagaggtggaacaggagaagatagctgtgtttcgggatgcaagccggttcattctcaatctcacaagcgtgaagccggaagacagtggcatctacttctgcatgatcgtcgggagccccgagctgaccttcgggaagggaactcagctgagtgtggttgatttccttcccaccactgcccagcccaccaagaagtccaccctcaagaagagagtgtgccggttacccaggccagagacccagaagggcctcaaggggaaggtatatcaggaacctttgtcccccaatgcctgcatggatactacagcaatactacaacctcacagaagctgcttaacccatggatcctgaaaacataggcaagaagcacaggtcctgatgagtggatctttactacttttaccagattcctccctcgctcagagggatcctcccacacacccagcagagacttctctgccaccatcaaccccccaagtcatagggggctcaagttctgccctggtgagctgtggcccccatccttgtgaaccccaaagtgtcccccttgtggaaccaaatgtatccatcttgaataaatttgcccaaaatcctaaagaccgggaaaagggaaccattgagcttggc

SEQ ID NO: 5196 - DNA, 143 bp, Homo sapiens
gcgactgtctccgccgagcccccggggccaggtgtcccgggcgcgccacgatgcggccgcggctgtggctcctcttggccgcgcagctgacaggccggcggaggagagcccggcttcgtttcatgaaacaactgtataaatag

SEQ ID NO: 5197 - DNA, 1526 bp, Homo sapiens
gtcccgggcgcgccacgatgcggccgcggctgtggctcctcttggccgcgcagctgacagttctccatggcaactcagtcctccagcagacccctgcatacataaaggtgcaaaccaacaagatggtgatgctgtcctgcgaggctaaaatctccctcagtaacatgcgcatctactggctgagacagcgccaggcaccgagcagtgacagtcaccacgagttcctggccctctgggattccgcaaaagggactatccacggtgaagaggtggaacaggagaagatagctgtgtttcgggatgcaagccggttcattctcaatctcacaagcgtgaagccggaagacagtggcatctacttctgcatgatcgtcgggagccccgagctgaccttcgggaagggaactcagctgagtgtggttgatttccttcccaccactgcccagcccaccaagaagtccaccctcaagaagagagtgtgccggttacccaggccagagacccagaagggcccactttgtagccccatcacccttggcctgctggtggctggcgtcctggttctgctggtttccctgggagtggccatccacctgtgctgccggcggaggagagcccggcttcgtttcatgaaacagtaagtgtataacctgggtgtggccttgggttcctcagcccctgctgcagcttgcagcctctaactgcagcgaggagccaaagtcagacctcatcttccaaagatcatagactcggccgggcatagtagtgcacacctgtagtcacagctactcgggaggctgaagcaggaggatcacttgagcccaggagttcaaggctgcagtgagctatgatggtaccactgcactccagcctgggcaacagagtgagactccatctaaaaaaaaaaattacagactgtataaatagatggggtgatagagttcaggaacctaagagataacctaaacaatggacaaacaaaatgtatttttgaatactctaaaattgtaaatagccatataaattcatattactatatgctctgcattgttgtacacattatatttatatcgagagtggcttaaacatgcctgctggattttatgggcaattttcaatgatattttaattgtgtacaattttcaccttgtgtgttggatttagaagctgccccctacccaagagataataacttgagtgtagctgtctcaggccagacctctagaaagttccattcaaggccgggtgcagtggctcaagcctgtaatcccagcactttgggaggcccaaggcaggtagatcgcctgaggtcaggagtttgagaccagcctggccaacatggtgaaaccccatctctactaaaaatacaaaaaattaactggacgtggtggcaggcgcctatgtaatcccagctactcgagaggctgaggtaagagaatcacttgaaccccggaggcagaggttgcaatgagcagagatcacaccattccgctgcagcctgggcaacaagagtgaaactctgtctc

SEQ ID NO: 5198 - DNA, 150 bp, Homo sapiens
gaaagagggagagagagaagagtgaaactgcgattttcggcaaggcctcaaggggaaggtatatcaggaacctttgtcccccaatgcctgcatggatactacagcaatactacaacctcacagaagctgcttaacccatggatcctgaaa

SEQ ID NO: 5199 - DNA, 1169 bp, Homo sapiens
cgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatg

SEQ ID NO: 5200 - DNA, 1229 bp, Homo sapiens
gtggggagccgggccctcttgagatgaggcgtgcgggagggtcctgagcactttagctcgcctaggatttgagctggggtgtgtgtctgctcccagctcaagtccctccgagtgccagagaggaaggcagggagaagcggagcacccctctttgggccaaggccaaggaggactgtgcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatg

SEQ ID NO: 5201 - DNA, 1554 bp, Homo sapiens
ctgcccagccctcagctgtgttattattcggtgataggtatttgctaattacttccaaaagcctcccatctgtcatcccacccagactgcgcgcttctaattcctcctaccccacatgctgtgcccaatgaaaagtatggtcagcgagcgaaggtttgcaaggagacagacgagggcgaaattaagccaggcggcttccctttaaatcctcgcaaagcagaagggcccctcactctggcagcaggccttggccaaggggcctttagccctgacgacccggggaagagtctcccaaagcagaacgcccggtccggcgcccagaccaaacgcgggggaaccggaagggcgaggcctccaccgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatg

SEQ ID NO: 5202 - DNA, 800 bp, Homo sapiens
cggagaccagcctacagccgcctgcatctgtatccagcgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactggcaactaaaaggactatgtttcccccttttctcgaggaccacgtttgctttttttccctgaatccacagttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtgg

SEQ ID NO: 5203 - DNA, 1229 bp, Homo sapiens
gaccagcctacagccgcctgcatctgtatccagcgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaacctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatgtc

SEQ ID NO: 5204 - DNA, 915 bp, Homo sapiens
agccgcctgcatctgtatccagcgccaggtcccgccagtcccagctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataat

SEQ ID NO: 5205 - DNA, 4324 bp, Homo sapiens
ataaacagacccaggcgtgtgtggtagagttcgggttttttagcacgaagtgggtggctggagtttgcttgaaaacatcaattgactttgtgatcattacagaaatgctggtgtaaggtgttcagaagacaatggagaaaaaatggaaatactgtgctgtctattacatcatccagatacattttgtcaagggagtttgggaaaaaacagtcaacacagaagaaaatgtttatgctacacttggctctgatgtcaacctgacctgccaaacacagacagtaggcttcttcgtgcagatgcaatggtccaaggtcaccaataagatagacctgattgctgtctatcatccccaatacggcttctactgtgcctatgggagaccctgtgagtcacttgtgactttcacagaaactcctgagaatgggtcaaaatggactctgcacttaaggaatatgtcttgttcagtcagtggaaggtacgagtgtatgcttgttctgtatccagagggcattcagactaaaatctacaaccttctcattcagacacacgttacagcagatgaatggaacagcaaccatacgatagaaatagagataaatcagactctggaaataccatgctttcaaaatagctcctcaaaaatttcatctgagttcacctatgcatggtcggtggaaaacagcagcacggattcttgggtccttctttctaagggtataaaggaggataatggaactcaggaaacacttatctcccaaaatcacctcatcagcaattccacattacttaaagatagagtcaagcttggtacagactacagactccacctctctccagtccaaatcttcgatgatgggcggaagttctcttgccacattagagtcggtcctaacaaaatcttgaggagctccaccacagtcaaggtttttgctaaaccagaaatccctgtgattgtggaaaataactccacggatgtcttggtagagagaagatttacctgcttactaaagaatgtatttcccaaagcaaatatcacatggtttatagatggaagttttcttcatgatgaaaaagaaggaatatatattactaatgaagagagaaaaggcaaagatggatttttggaactgaagtctgttttaacaagggtacatagtaataaaccagcccaatcagacaacttgaccatttggtgtatggctctgtctccagtcccaggaaataaagtgtggaacatctcatcagaaaagatcacttttctcttaggttctgaaatttcctcaacagaccctccactgagtgttacagaatctacccttgacacccaaccttctccagccagcagtgtatctcctgcaagatatccagctacatcttcagtgacccttgtagatgtgagtgccttgaggccaaacaccactcctcaacccagcaattccagtatgactacccgaggcttcaactatccctggacctccagtgggacagataccaaaaaatcagtttcacggatacctagtgaaacatacagttcatccccgtcaggtgcaggctcaacacttcatgacaatgtctttaccagcacagccagagcattttcagaagtccccacaactgccaatggatctacgaaaactaatcacgtccatatcactggtattgtggtcaataagcccaaagatggaatgtcctggccagtgattgtagcagctttactcttttgctgcatgatattgtttggtcttggagtgagaaaatggtgtcagtaccaaaaagaaataatggaaagacctccacctttcaagccaccaccacctcccatcaagtacacttgcattcaagagcccaacgaaagtgatctgccttatcatgagatggagaccctctagtctcgtgagactttgccccatggcagaactctgctggaatcctattgagaaggtagacattgtgctttattaatatagtcgctcttcagccatgcctttgctgcagctgaaatggaagtcagaagtgagtgacctgttttcccagcaactcaccctcttccatctccaaacgcctgaagcttaaccaagagtgagaggatatgtcatgttcacactcaatgcaattcgtagtggttttcttgcttatgtaagaagtacatattagtctgccatctttaaaaaaaaatacagtattttcatttaaattctctgatggagggacaacaatggtttcaactgtatgcccatgcctgatcctcttatttgaacatctatcaacattgtaaactctttgccaaaatcctggggctttgctgcattccctaagataattacaggaaaaagaaaatgtaaaagtgctaacaaggctgccaagtaatggagaagtatggttagtcttcatattgaaattctgttgcttattttcatggaaggaaacagaatactttgcacaggaaccacattttcaatcctccttcactgtcttcctaccatgttcagcccagactcctgccacatggaccaggatgaagagggatcaaagagataattagccaaaaacccagtagcctagaagatacaaaactccactggcctctaaaattatattagccaagagtggtttcatttgagtgccttcgtgtgtatgtccatcaaactggaaccaaactgttttgtaagtaaacaggcagcctaagcccaaccctactttctaattccagttattctctttttcatctggggatttacctgttcatttaatctgcctgttttgatctgttttgaaaaagataaagagcctcaaatcagaccagcactgattaattaaccctgctcctaccaatcttttttaaagcagttgaagcagaatgtataggtgtcagagaagaaacctagtcagccagacgtgctctgtattcagcaatagtttgtgaatgaataaattactaatcctccttgtcgcttgaaaccttcccacactccctgctccaggagggaaaaacagatgttgttgacagatagagtgataggcaaattctgtgtggactttagtcccaaaaggaaactttagttcacttgcagtatgcttatccttgactgcacatgagaatgccttgtgcagagttatttggagattatgtctttttcttaaacaccatggctgtcacacttcagttcaattaaatcagaatgtctgaggagtgagacacaggcatcaacactctcaaatgattcacatgttcagccaaagttgagaaccatcgagcctgtggaagttctttctcatggctcagaatcttaggtaggtgcttaactcttgtggtggccagcctccaagatgagccccagtgttcttgcctcctactattcacatctttatgtggtcccctccaatgctgaatacagatgatttgtgtaacctgaggccaggattaaggggaggcaatcaatgcacctagggaaaaaatttaaggaggtattcacactcagggtcatgcacttgcacaatgttgagaatgagtaccactctcaccattggtatagccaaaaaagcttggaagtgaccaaggctaggtcacaaaatacactgtggcttcttctttgatctctctttgaccatactgacactgggaaaagcccattcccatgccatgaagacaccaaggcagccctattgagaaatctacctgtcgtggccgggcgcagtggctcacgcctgtaatcccagcactttgggaggccgaggtgggtggatcacgaggtcaggagatcgagaccatcctggctaacacagtgaaaccccgtctctactaaaaatacaaaaaattagccgggtgtggtgtcgggcacctgtagtcccagctactcaggaggctgaggcaggagaagggtgggaacccgggaggcagagcttgcagtgagccgagattgtgccactgcacactccaatctgggtgaaagaccgagactccgcctcaaaaaaaaaaaaaaaagaaagaaagaaagaaagaaagaaatctacctgtcaaggaactaaggtattttgctaacaagcaccaacttgccagccatgtaagggagccatcttggaagcagatcctccagcctccagtcaagtcttcagataattgcaacttcagttgatcttttgaccaagacctcaagagagccagaactacccagctaagccttttactaaatttctgaacttctaacactattagataataagtgcttattgtttaacaccattaattttgagtataatttgttacatagcgacagataactatacagctcaacaactagaaaaataaactgtttacctgccttaa

SEQ ID NO: 5206 - DNA, 4315 bp, Homo sapiens
ttcctgtctacgtttcatttcctgggggcttgccaagtgataaacagacccaggcgtgtgtggtagagttcgggttttttagcacgaagtgggtggctggagtttgcttgaaaacatcaattgactttgtgatcattacagaaatgctggtgtaaggtgttcagaagacaatggagaaaaaatggaaatactgtgctgtctattacatcatccagatacattttgtcaagggagtttgggaaaaaacagtcaacacagaagaaaatgtttatgctacacttggctctgatgtcaacctgacctgccaaacacagacagtaggcttcttcgtgcagatgcaatggtccaaggtcaccaataagatagacctgattgctgtctatcatccccaatacggcttctactgtgcctatgggagaccctgtgagtcacttgtgactttcacagaaactcctgagaatgggtcaaaatggactctgcacttaaggaatatgtcttgttcagtcagtggaaggtacgagtgtatgcttgttctgtatccagagggcattcagactaaaatctacaaccttctcattcagacacacgttacagcagatgaatggaacagcaaccatacgatagaaatagagataaatcagactctggaaataccatgctttcaaaatagctcctcaaaaatttcatctgagttcacctatgcatggtcggtggaggataatggaactcaggaaacacttatctcccaaaatcacctcatcagcaattccacattacttaaagatagagtcaagcttggtacagactacagactccacctctctccagtccaaatcttcgatgatgggcggaagttctcttgccacattagagtcggtcctaacaaaatcttgaggagctccaccacagtcaaggtttttgctaaaccagaaatccctgtgattgtggaaaataactccacggatgtcttggtagagagaagatttacctgcttactaaagaatgtatttcccaaagcaaatatcacatggtttatagatggaagttttcttcatgatgaaaaagaaggaatatatattactaatgaagagagaaaaggcaaagatggatttttggaactgaagtctgttttaacaagggtacatagtaataaaccagcccaatcagacaacttgaccatttggtgtatggctctgtctccagtcccaggaaataaagtgtggaacatctcatcagaaaagatcacttttctcttaggttctgaaatttcctcaacagaccctccactgagtgttacagaatctacccttgacacccaaccttctccagccagcagtgtatctcctgcaagatatccagctacatcttcagtgacccttgtagatgtgagtgccttgaggccaaacaccactcctcaacccagcaattccagtatgactacccgaggcttcaactatccctggacctccagtgggacagataccaaaaaatcagtttcacggatacctagtgaaacatacagttcatccccgtcaggtgcaggctcaacacttcatgacaatgtctttaccagcacagccagagcattttcagaagtccccacaactgccaatggatctacgaaaactaatcacgtccatatcactggtattgtggtcaataagcccaaagatggaatgtcctggccagtgattgtagcagctttactcttttgctgcatgatattgtttggtcttggagtgagaaaatggtgtcagtaccaaaaagaaataatggaaagacctccacctttcaagccaccaccacctcccatcaagtacacttgcattcaagagcccaacgaaagtgatctgccttatcatgagatggagaccctctagtctcgtgagactttgccccatggcagaactctgctggaatcctattgagaaggtagacattgtgctttattaatatagtcgctcttcagccatgcctttgctgcagctgaaatggaagtcagaagtgagtgacctgttttcccagcaactcaccctcttccatctccaaacgcctgaagcttaaccaagagtgagaggatatgtcatgttcacactcaatgcaattcgtagtggttttcttgcttatgtaagaagtacatattagtctgccatctttaaaaaaaaatacagtattttcatttaaattctctgatggagggacaacaatggtttcaactgtatgcccatgcctgatcctcttatttgaacatctatcaacattgtaaactctttgccaaaatcctggggctttgctgcattccctaagataattacaggaaaaagaaaatgtaaaagtgctaacaaggctgccaagtaatggagaagtatggttagtcttcatattgaaattctgttgcttattttcatggaaggaaacagaatactttgcacaggaaccacattttcaatcctccttcactgtcttcctaccatgttcagcccagactcctgccacatggaccaggatgaagagggatcaaagagataattagccaaaaacccagtagcctagaagatacaaaactccactggcctctaaaattatattagccaagagtggtttcatttgagtgccttcgtgtgtatgtccatcaaactggaaccaaactgttttgtaagtaaacaggcagcctaagcccaaccctactttctaattccagttattctctttttcatctggggatttacctgttcatttaatctgcctgttttgatctgttttgaaaaagataaagagcctcaaatcagaccagcactgattaattaaccctgctcctaccaatcttttttaaagcagttgaagcagaatgtataggtgtcagagaagaaacctagtcagccagacgtgctctgtattcagcaatagtttgtgaatgaataaattactaatcctccttgtcgcttgaaaccttcccacactccctgctccaggagggaaaaacagatgttgttgacagatagagtgataggcaaattctgtgtggactttagtcccaaaaggaaactttagttcacttgcagtatgcttatccttgactgcacatgagaatgccttgtgcagagttatttggagattatgtctttttcttaaacaccatggctgtcacacttcagttcaattaaatcagaatgtctgaggagtgagacacaggcatcaacactctcaaatgattcacatgttcagccaaagttgagaaccatcgagcctgtggaagttctttctcatggctcagaatcttaggtaggtgcttaactcttgtggtggccagcctccaagatgagccccagtgttcttgcctcctactattcacatctttatgtggtcccctccaatgctgaatacagatgatttgtgtaacctgaggccaggattaaggggaggcaatcaatgcacctagggaaaaaatttaaggaggtattcacactcagggtcatgcacttgcacaatgttgagaatgagtaccactctcaccattggtatagccaaaaaagcttggaagtgaccaaggctaggtcacaaaatacactgtggcttcttctttgatctctctttgaccatactgacactgggaaaagcccattcccatgccatgaagacaccaaggcagccctattgagaaatctacctgtcgtggccgggcgcagtggctcacgcctgtaatcccagcactttgggaggccgaggtgggtggatcacgaggtcaggagatcgagaccatcctggctaacacagtgaaaccccgtctctactaaaaatacaaaaaattagccgggtgtggtgtcgggcacctgtagtcccagctactcaggaggctgaggcaggagaagggtgggaacccgggaggcagagcttgcagtgagccgagattgtgccactgcacactccaatctgggtgaaagaccgagactccgcctcaaaaaaaaaaaaaaaagaaagaaagaaagaaagaaagaaatctacctgtcaaggaactaaggtattttgctaacaagcaccaacttgccagccatgtaagggagccatcttggaagcagatcctccagcctccagtcaagtcttcagataattgcaacttcagttgatcttttgaccaagacctcaagagagccagaactacccagctaagccttttactaaatttctgaacttctaacactattagataataagtgcttattgtttaacaccattaattttgagtataatttgttacatagcgacagataactatacagctcaacaactagaaaaataaactgtttacctgccttaa

SEQ ID NO: 5207 - DNA, 3229 bp, Homo sapiens
cgccccccctccttcataaagtcctggcctcgggacagcctgcacagctgcctagcctgtggagacgggacagccctgtcccactcactctttcccctgccgctcctgccggcagctccaaccatgggaggccgcgtctttctcgcattctgtgtctggctgactctgccgggagctgaaacccaggactccaggggctgtgcccggtggtgccctcagaactcctcgtgtgtcaatgccaccgcctgtcgctgcaatccagggttcagctctttttctgagatcatcaccaccccgacggagacttgtgacgacatcaacgagtgtgcaacaccgtcgaaagtgtcatgcggaaaattctcggactgctggaacacagaggggagctacgactgcgtgtgcagcccgggatatgagcctgtttctggggcaaaaacattcaagaatgagagcgagaacacctgtcaagatgtggacgaatgtcagcagaacccaaggctctgtaaaagctacggcacctgcgtcaacacccttggcagctatacctgccagtgcctgcctggcttcaagttcatacctgaggatccgaaggtctgcacagatgtgaatgaatgcacctccggacaaaacccgtgccacagctccacccactgcctcaacaacgtgggcagctatcagtgccgctgccgcccgggctggcaaccgattccggggtcccccaatggcccaaacaataccgtctgtgaagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactccaagacaagctcagccgaggtcaccatccagaatgtcatcaaattggtggatgaactgatggaagctcctggagacgtagaggccctggcgccacctgtccggcacctcatagccacccagctgctctcaaaccttgaagatatcatgaggatcctggccaagagcctgcctaaaggccccttcacctacatttccccttcgaacacagagctgaccctgatgatccaggagcggggggacaagaacgtcactatgggtcagagcagcgcacgcatgaagctgaattgggctgtggcagctggagccgaggatccaggccccgccgtggcgggcatcctctccatccagaacatgacgacattgctggccaatgcctccttgaacctgcattccaagaagcaagccgaactggaggagatatatgaaagcagcatccgtggtgtccaactcagacgcctctctgccgtcaactccatctttctgagccacaacaacaccaaggaactcaactcccccatccttttcgccttctcccaccttgagtcctccgatggggaggcgggaagagaccctcctgccaaggacgtgatgcctgggccacggcaggagctgctctgtgccttctggaagagtgacagcgacaggggagggcactgggccaccgagggctgccaggtgctgggcagcaagaacggcagcaccacctgccaatgcagccacctgagcagctttgcgatccttatggctcattatgacgtggaggactggaagctgaccctgatcaccagggtgggactggcgctgtcactcttctgcctgctgctgtgcatcctcactttcctgctggtgcggcccatccagggctcgcgcaccaccatacacctgcacctctgcatctgcctcttcgtgggctccaccatcttcctggccggcatcgagaacgaaggcggccaggtggggctgcgctgccgcctggtggccgggctgctgcactactgtttcctggccgccttctgctggatgagcctcgaaggcctggagctctactttcttgtggtgcgcgtgttccaaggccagggcctgagtacgcgctggctctgcctgatcggctatggcgtgcccctgctcatcgtgggcgtctcggctgccatctacagcaagggctacggccgccccagatactgctggttggactttgagcagggcttcctctggagcttcttgggacctgtgaccttcatcattttgtgcaatgctgtcattttcgtgactaccgtctggaagctcactcagaagttttctgaaatcaatccagacatgaagaaattaaagaaggcgagggcgctgaccatcacggccatcgcgcagctcttcctgttgggctgcacctgggtctttggcctgttcatcttcgacgatcggagcttggtgctgacctatgtgtttaccatcctcaactgcctgcagggcgccttcctctacctgctgcactgcctgctcaacaagaaggttcgggaagaataccggaagtgggcctgcctagttgctggggggagcaagtactcagaattcacctccaccacgtctggcactggccacaatcagacccgggccctcagggcatcagagtccggcatatgaaggcgcatggttctggacggcccagcagctcctgtggccacagcagctttgtacacgaagaccatccatcctcccttcgtccaccactctactccctccaccctccctccctgatcccgtgtgccaccaggagggagtggcagctatagtctggcaccaaagtccaggacacccagtggggtggagtcggagccactggtcctgctgctggctgcctctctgctccaccttgtgacccagggtggggacaggggctggcccagggctgcaatgcagcatgttgccctggcacctgtggccagtactcgggacagactaagggcgcttgtcccatcctggacttttcctctcatgtctttgctgcagaactgaagagactaggcgctggggctcagcttccctcttaagctaagactgatgtcagaggccccatggcgaggccccttggggccactgcctgaggctcacggtacagaggcctgccctgcctggccgggcaggaggttctcactgttgtgaaggttgtagacgttgtgtaatgtgtttttatctgttaaaatttttcagtgttgacacttaaaattaaacacatgcatac

SEQ ID NO: 5208 - DNA, 3082 bp, Homo sapiens
cgccccccctccttcataaagtcctggcctcgggacagcctgcacagctgcctagcctgtggagacgggacagccctgtcccactcactctttcccctgccgctcctgccggcagctccaaccatgggaggccgcgtctttctcgcattctgtgtctggctgactctgccgggagctgaaacccaggactccaggggctgtgcccggtggtgccctcagaactcctcgtgtgtcaatgccaccgcctgtcgctgcaatccagggttcagctctttttctgagatcatcaccaccccgacggagacttgtgacgacatcaacgagtgtgcaacaccgtcgaaagtgtcatgcggaaaattctcggactgctggaacacagaggggagctacgactgcgtgtgcagcccgggatatgagcctgtttctggggcaaaaacattcaagaatgagagcgagaacacctgtcaagatgtggacgaatgtcagcagaacccaaggctctgtaaaagctacggcacctgcgtcaacacccttggcagctatacctgccagtgcctgcctggcttcaagttcatacctgaggatccgaaggtctgcacagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactccaagacaagctcagccgaggtcaccatccagaatgtcatcaaattggtggatgaactgatggaagctcctggagacgtagaggccctggcgccacctgtccggcacctcatagccacccagctgctctcaaaccttgaagatatcatgaggatcctggccaagagcctgcctaaaggccccttcacctacatttccccttcgaacacagagctgaccctgatgatccaggagcggggggacaagaacgtcactatgggtcagagcagcgcacgcatgaagctgaattgggctgtggcagctggagccgaggatccaggccccgccgtggcgggcatcctctccatccagaacatgacgacattgctggccaatgcctccttgaacctgcattccaagaagcaagccgaactggaggagatatatgaaagcagcatccgtggtgtccaactcagacgcctctctgccgtcaactccatctttctgagccacaacaacaccaaggaactcaactcccccatccttttcgccttctcccaccttgagtcctccgatggggaggcgggaagagaccctcctgccaaggacgtgatgcctgggccacggcaggagctgctctgtgccttctggaagagtgacagcgacaggggagggcactgggccaccgagggctgccaggtgctgggcagcaagaacggcagcaccacctgccaatgcagccacctgagcagctttgcgatccttatggctcattatgacgtggaggactggaagctgaccctgatcaccagggtgggactggcgctgtcactcttctgcctgctgctgtgcatcctcactttcctgctggtgcggcccatccagggctcgcgcaccaccatacacctgcacctctgcatctgcctcttcgtgggctccaccatcttcctggccggcatcgagaacgaaggcggccaggtggggctgcgctgccgcctggtggccgggctgctgcactactgtttcctggccgccttctgctggatgagcctcgaaggcctggagctctactttcttgtggtgcgcgtgttccaaggccagggcctgagtacgcgctggctctgcctgatcggctatggcgtgcccctgctcatcgtgggcgtctcggctgccatctacagcaagggctacggccgccccagatactgctggttggactttgagcagggcttcctctggagcttcttgggacctgtgaccttcatcattttgtgcaatgctgtcattttcgtgactaccgtctggaagctcactcagaagttttctgaaatcaatccagacatgaagaaattaaagaaggcgagggcgctgaccatcacggccatcgcgcagctcttcctgttgggctgcacctgggtctttggcctgttcatcttcgacgatcggagcttggtgctgacctatgtgtttaccatcctcaactgcctgcagggcgccttcctctacctgctgcactgcctgctcaacaagaaggttcgggaagaataccggaagtgggcctgcctagttgctggggggagcaagtactcagaattcacctccaccacgtctggcactggccacaatcagacccgggccctcagggcatcagagtccggcatatgaaggcgcatggttctggacggcccagcagctcctgtggccacagcagctttgtacacgaagaccatccatcctcccttcgtccaccactctactccctccaccctccctccctgatcccgtgtgccaccaggagggagtggcagctatagtctggcaccaaagtccaggacacccagtggggtggagtcggagccactggtcctgctgctggctgcctctctgctccaccttgtgacccagggtggggacaggggctggcccagggctgcaatgcagcatgttgccctggcacctgtggccagtactcgggacagactaagggcgcttgtcccatcctggacttttcctctcatgtctttgctgcagaactgaagagactaggcgctggggctcagcttccctcttaagctaagactgatgtcagaggccccatggcgaggccccttggggccactgcctgaggctcacggtacagaggcctgccctgcctggccgggcaggaggttctcactgttgtgaaggttgtagacgttgtgtaatgtgtttttatctgttaaaatttttcagtgttgacacttaaaattaaacacatgcatac

SEQ ID NO: 5209 - DNA, 2950 bp, Homo sapiens
cgccccccctccttcataaagtcctggcctcgggacagcctgcacagctgcctagcctgtggagacgggacagccctgtcccactcactctttcccctgccgctcctgccggcagctccaaccatgggaggccgcgtctttctcgcattctgtgtctggctgactctgccgggagctgaaacccaggactccaggggctgtgcccggtggtgccctcagaactcctcgtgtgtcaatgccaccgcctgtcgctgcaatccagggttcagctctttttctgagatcatcaccaccccgacggagacttgtgacgacatcaacgagtgtgcaacaccgtcgaaagtgtcatgcggaaaattctcggactgctggaacacagaggggagctacgactgcgtgtgcagcccgggatatgagcctgtttctggggcaaaaacattcaagaatgagagcgagaacacctgtcaagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactccaagacaagctcagccgaggtcaccatccagaatgtcatcaaattggtggatgaactgatggaagctcctggagacgtagaggccctggcgccacctgtccggcacctcatagccacccagctgctctcaaaccttgaagatatcatgaggatcctggccaagagcctgcctaaaggccccttcacctacatttccccttcgaacacagagctgaccctgatgatccaggagcggggggacaagaacgtcactatgggtcagagcagcgcacgcatgaagctgaattgggctgtggcagctggagccgaggatccaggccccgccgtggcgggcatcctctccatccagaacatgacgacattgctggccaatgcctccttgaacctgcattccaagaagcaagccgaactggaggagatatatgaaagcagcatccgtggtgtccaactcagacgcctctctgccgtcaactccatctttctgagccacaacaacaccaaggaactcaactcccccatccttttcgccttctcccaccttgagtcctccgatggggaggcgggaagagaccctcctgccaaggacgtgatgcctgggccacggcaggagctgctctgtgccttctggaagagtgacagcgacaggggagggcactgggccaccgagggctgccaggtgctgggcagcaagaacggcagcaccacctgccaatgcagccacctgagcagctttgcgatccttatggctcattatgacgtggaggactggaagctgaccctgatcaccagggtgggactggcgctgtcactcttctgcctgctgctgtgcatcctcactttcctgctggtgcggcccatccagggctcgcgcaccaccatacacctgcacctctgcatctgcctcttcgtgggctccaccatcttcctggccggcatcgagaacgaaggcggccaggtggggctgcgctgccgcctggtggccgggctgctgcactactgtttcctggccgccttctgctggatgagcctcgaaggcctggagctctactttcttgtggtgcgcgtgttccaaggccagggcctgagtacgcgctggctctgcctgatcggctatggcgtgcccctgctcatcgtgggcgtctcggctgccatctacagcaagggctacggccgccccagatactgctggttggactttgagcagggcttcctctggagcttcttgggacctgtgaccttcatcattttgtgcaatgctgtcattttcgtgactaccgtctggaagctcactcagaagttttctgaaatcaatccagacatgaagaaattaaagaaggcgagggcgctgaccatcacggccatcgcgcagctcttcctgttgggctgcacctgggtctttggcctgttcatcttcgacgatcggagcttggtgctgacctatgtgtttaccatcctcaactgcctgcagggcgccttcctctacctgctgcactgcctgctcaacaagaaggttcgggaagaataccggaagtgggcctgcctagttgctggggggagcaagtactcagaattcacctccaccacgtctggcactggccacaatcagacccgggccctcagggcatcagagtccggcatatgaaggcgcatggttctggacggcccagcagctcctgtggccacagcagctttgtacacgaagaccatccatcctcccttcgtccaccactctactccctccaccctccctccctgatcccgtgtgccaccaggagggagtggcagctatagtctggcaccaaagtccaggacacccagtggggtggagtcggagccactggtcctgctgctggctgcctctctgctccaccttgtgacccagggtggggacaggggctggcccagggctgcaatgcagcatgttgccctggcacctgtggccagtactcgggacagactaagggcgcttgtcccatcctggacttttcctctcatgtctttgctgcagaactgaagagactaggcgctggggctcagcttccctcttaagctaagactgatgtcagaggccccatggcgaggccccttggggccactgcctgaggctcacggtacagaggcctgccctgcctggccgggcaggaggttctcactgttgtgaaggttgtagacgttgtgtaatgtgtttttatctgttaaaatttttcagtgttgacacttaaaattaaacacatgcatac

SEQ ID NO: 5210 - DNA, 2956 bp, Homo sapiens
ggcgggcggatcatgagagcattctgtgtctggctgactctgccgggagctgaaacccaggactccaggggctgtgcccggtggtgccctcagaactcctcgtgtgtcaatgccaccgcctgtcgctgcaatccagggttcagctctttttctgagatcatcaccaccccgacggagacttgtgacgacatcaacgagtgtgcaacaccgtcgaaagtgtcatgcggaaaattctcggactgctggaacacagaggggagctacgactgcgtgtgcagcccgggatatgagcctgtttctggggcaaaaacattcaagaatgagagcgagaacacctgtcaagatgtggacgaatgtcagcagaacccaaggctctgtaaaagctacggcacctgcgtcaacacccttggcagctatacctgccagtgcctgcctggcttcaagttcatacctgaggatccgaaggtctgcacagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactccaagacaagctcagccgaggtcaccatccagaatgtcatcaaattggtggatgaactgatggaagctcctggagacgtagaggccctggcgccacctgtccggcacctcatagccacccagctgctctcaaaccttgaagatatcatgaggatcctggccaagagcctgcctaaaggccccttcacctacatttccccttcgaacacagagctgaccctgatgatccaggagcggggggacaagaacgtcactatgggtcagagcagcgcacgcatgaagctgaattgggctgtggcagctggagccgaggatccaggccccgccgtggcgggcatcctctccatccagaacatgacgacattgctggccaatgcctccttgaacctgcattccaagaagcaagccgaactggaggagatatatgaaagcagcatccgtggtgtccaactcagacgcctctctgccgtcaactccatctttctgagccacaacaacaccaaggaactcaactcccccatccttttcgccttctcccaccttgagtcctccgatggggaggcgggaagagaccctcctgccaaggacgtgatgcctgggccacggcaggagctgctctgtgccttctggaagagtgacagcgacaggggagggcactgggccaccgagggctgccaggtgctgggcagcaagaacggcagcaccacctgccaatgcagccacctgagcagctttgcgatccttatggctcattatgacgtggaggactggaagctgaccctgatcaccagggtgggactggcgctgtcactcttctgcctgctgctgtgcatcctcactttcctgctggtgcggcccatccagggctcgcgcaccaccatacacctgcacctctgcatctgcctcttcgtgggctccaccatcttcctggccggcatcgagaacgaaggcggccaggtggggctgcgctgccgcctggtggccgggctgctgcactactgtttcctggccgccttctgctggatgagcctcgaaggcctggagctctactttcttgtggtgcgcgtgttccaaggccagggcctgagtacgcgctggctctgcctgatcggctatggcgtgcccctgctcatcgtgggcgtctcggctgccatctacagcaagggctacggccgccccagatactgctggttggactttgagcagggcttcctctggagcttcttgggacctgtgaccttcatcattttgtgcaatgctgtcattttcgtgactaccgtctggaagctcactcagaagttttctgaaatcaatccagacatgaagaaattaaagaaggcgagggcgctgaccatcacggccatcgcgcagctcttcctgttgggctgcacctgggtctttggcctgttcatcttcgacgatcggagcttggtgctgacctatgtgtttaccatcctcaactgcctgcagggcgccttcctctacctgctgcactgcctgctcaacaagaaggttcgggaagaataccggaagtgggcctgcctagttgctggggggagcaagtactcagaattcacctccaccacgtctggcactggccacaatcagacccgggccctcagggcatcagagtccggcatatgaaggcgcatggttctggacggcccagcagctcctgtggccacagcagctttgtacacgaagaccatccatcctcccttcgtccaccactctactccctccaccctccctccctgatcccgtgtgccaccaggagggagtggcagctatagtctggcaccaaagtccaggacacccagtggggtggagtcggagccactggtcctgctgctggctgcctctctgctccaccttgtgacccagggtggggacaggggctggcccagggctgcaatgcagcatgttgccctggcacctgtggccagtactcgggacagactaagggcgcttgtcccatcctggacttttcctctcatgtctttgctgcagaactgaagagactaggcgctggggctcagcttccctcttaagctaagactgatgtcagaggccccatggcgaggccccttggggccactgcctgaggctcacggtacagaggcctgccctgcctggccgggcaggaggttctcactgttgtgaaggttgtagacgttgtgtaatgtgtttttatctgttaaaatttttcagtgttgacacttaaaattaaacacatgcatac

SEQ ID NO: 5211 - DNA, 756 bp, Homo sapiens
accagaaaaagaagctatgcttcaaagaaaatgaaagagcttccatgtgcgtgttcctcagtgtttagggagaagaaagcaacccttaaaatagaggaaaatgaagctgcttggattaccctgttgaagttcatctctgcctgtgccatgcatgaaaaaatactggcaaagtcttcacttacatgagtgttagactccatgttcccagtgggtctcggggttcagaactgagtgctctcatccaagcaataggagcgtcgacctcaggaaagcccaagtgttttgtgtgtattttgaggagtgggttatctgttgcactgagcctctctgtgtattttcttcttcttttcagcagaacaaggggaggtggacatggagagccaccggaatgccaacgcagagccagctgttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcaccccccc

SEQ ID NO: 5212 - DNA, 530 bp, Homo sapiens
atggcccgcggggctgcgctggcgctgctgctcttcggcctgctgggtgttctggtcgccgccccggggtttggggacctgcgtcttcaggccgcgcgcggaggccgccctggagttgcctgtcacagccacgccctgcgtcccgggcctaaatttggaatcgctaggagcctgagacccgggtggtggggggaagggaaggaaaagttagaaaaaaactttgagccctgaaaatgttcaaaaatactctgtggatgcgggctccgggaatttcagcgcgtgctgtgcgccaagcaacacggggcgcagaaagaaacgtgtgcttaccaaattgtccatctgcggcggtggagaattcggaaaacagaaaaagtgggcagggaagaaagagccacggtcaccctcccacgccctaaaccgggcctatttctaattattactttaatcatgtttttctgtttccctccctttgaaacggaaacggagaccctgccggatgtggtatgttataaattcttttttcatgttat

SEQ ID NO: 5213 - DNA, 918 bp, Homo sapiens
ggcccgtgggggagtatctgtcctgccgccttcgcccacgccctgcactccgggaccgtccctgcgcgctctgggcgcaccatggcccgcggggctgcgctggcgctgctgctcttcggcctgctgggtgttctggtcgccgccccggatggtggtttcgatttatccgatgcccttcctgacaatgaaaacaagaaacccactgcaatccccaagaaacccagtgctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaaaaagaagctatgcttcaaagaaaatggtcagctggcaggctctttgggaccttgtattgggatccgccgtgaagctgatggctgaagacctaggggtgagcagagaacccagcccaggcctgcggagcgtcctgaccgtaatcgttttatctgctaagacatagccttaaagcaaacccttccatctgccgctcccctcgccctgctggcaaattcccaccacgatgggattctcaatcacatggcggattctctgccttcagttccatatgcttttgcctttctggatgcacagaagctcattatagcaaatcatatttctgcataagagcttcagaaaatgaagagaaatgcagatattttcttttaaacatgaatctaacagaaa

SEQ ID NO: 5214 - DNA, 892 bp, Homo sapiens
acccggcccgtgggggagtatctgtcctgccgccttcgcccacgccctgcactccgggaccgtccctgcgcgctctgggcgcaccatggcccgcggggctgcgctggcgctgctgctcttcggcctgctgggtgttctggtcgccgccccggatggtggtttcgatttatccgatgcccttcctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaaaaagaagctatgcttcaaagaaaatgcagaacaaggggaggtggacatggagagccaccggaatgccaacgcagagccagctgttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatg

SEQ ID NO: 5215 - DNA, 1245 bp, Homo sapiens
gcgcgcgtggaggccggggcggggcgggcgcagccggcgctgagcttgcagggccgctcccctcacccgcccccttcgagtccccgggcttcgccccacccggcccgtgggggagtatctgtcctgccgccttcgcccacgccctgcactccgggaccgtccctgcgcgctctgggcgcaccatggcccgcggggctgcgctggcgctgctgctcttcggcctgctgggtgttctggtcgccgccccggatggtggtttcgatttatccgatgcccttcctgacaatgaaaacaagaaacccactgcaatccccaagaaacccagtgctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaaaaagaagctatgcttcaaagaaaatgcagaacaaggggaggtggacatggagagccaccggaatgccaacgcagagccagctgttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaatttgtttcttcaatatttctttcatttgtagggatatttgtttttcatatcagactaataaaaagaaattagaaaccaa

SEQ ID NO: 5216 - DNA, 604 bp, Homo sapiens
cggcgttgggggcgccccgcggggacacccggagcctcctccctgcccggcaggacgcgctgtgcccacgggggcccaggcccggaggaggcgcccactttctccccaacgcttttcctggagccgttccagagagaaaagtcagcgtttgttgtcggagttgcaaactcttacatgtggggcggccttgggagagatggtggtttcgatttatccgatgcccttcctgacaatgaaaacaagaaacccactgcaatccccaagaaacccagtgctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaaaaagaagctatgcttcaaagaaaatg

SEQ ID NO: 5217 - DNA, 556 bp, Homo sapiens
gctttgggcgggaccctgcagaggcggcggggctcctcctcccgctcctcctcggcctccccttcgggcgctctcgcgctaactgtgctcctccggggccctccgcctgctcccagccatggtggcctggcgctcggcgttccttgtctgcctcgctttctccttggccaccctggtccagcgaggatctggggactttgatgattttaacctggaggatgcagtgaaagaaacttcctcagtaaagcctgccttaggaatgtaccacaaactagatggcttaaaacaacagaactttattctgtcactgttctggatgctagaagttctatatcaaggtgttggttgggccacattctctctgaaggctctagggaagaatctttccttgactttccccacttctggtggctctaggtgttccttggtttgtggttgcatcactccaatctctgcctctgttgtcacgtggtgttcccctttctgtgtctctctcctttctcttacaaagatgcttgttagtgggtttaaggcccacctggataatccaggatga

SEQ ID NO: 5218 - DNA, 3496 bp, Homo sapiens
gcagcctcgccccgccccccggcctaaccccagcccaggcgccctcaggcgccggctctctagcgcgcccgacctccatcttcccggggccgcgccgcgcgcgcgcgcgggctttgggcgggaccctgcagaggcggcggggctcctcctcccgctcctcctcggcctccccttcgggcgctctcgcgctaactgtgctcctccggggccctccgcctgctcccagccatggtggcctggcgctcggcgttccttgtctgcctcgctttctccttggccaccctggtccagcgaggatctggggactttgatgattttaacctggaggatgcagtgaaagaaacttcctcagtaaagcgaaatgattttgacttggctgatgccctggatgatcgaaatgatcgagatgatggccgcaggaaaccaattgctggaggaggaggtttttcagacaaggatcttgaagacatagtagggggtggagaatacaaacctgacaagggtaaaggtgatggccggtacggcagcaatgacgaccctggatctggcatggtggcagagcctggcaccattgccggggtggccagcgccctggccatggccctcatcggtgccgtctccagctacatctcctaccagcagaagaagttctgcttcagcattcagcagggtctcaacgcagactacgtgaagggagagaacctggaagccgtggtatgtgaggaaccccaagtgaaatactccacgttgcacacgcagtctgcagagccgccgccgccgcccgaaccagcccggatctgagggccctgtccagctgcaggcatgcacaatggtgccaccgcttgtcacccggctccccccaccccttcatttggacccgcagctgctgtgctgctctgtgccatcggctccttgttggtctgagtttcccggatgagctctgggtgtttgtgagtttggtttctctgccctgccccaagcgtgctgagacttggtgccgaaattcaagagccagctctgatagaaagccagcaccagcctcgggagctgctgagccaccaactcccaaagccagcctgcctccagctttactgagcacaggatgcgggggccaagatgatgctgaggcctgatgacatttatgcttaggggacaagagtttgaactcaagggactgtgacccctgcacactggagtggctcattgtggcaggtttctgccaatagacagcccctgacagtggcctcaaggagctgcaggtggggggctcagcctgcacccacttggagcccctgcaaggagcgaaccggtcagcaccaagtaacaccacacacacgcagcacccaggatgatggtttcacttcagtcttccccatcccaggttttatgttgctgggcttccggagagccggtccaagcggaggctttcagtgatttaagtacaaacatgcatctcgtgatagtcctgccttgagagcttaggaatcttccggataagtatgaagcaattcgtaggcctgtttcccatctgattccatagggggctgggtgtggccttcgggttgacatgagaaaggtctttagcaatcatttctgcaccggagatgagttttatcctgtgttggggagaggtgctcaccctccaccctgtgtccctgttttggtagcaagagtgaccgatgtcaagaacgagcatcaaagccagaatcctgcttgtttgcttaaaaatgtaattgggggcggcgggggaggagaggggaaagagacattcgcttggtttagtgaaacgcaggtgactttgtagctctgtggtcagcctacttgtctgctctgagggagagtgcgtggggagccatgctcaccgtggcaaacacaggaaccccatgactcgcccctcacctggcgtggagctgcctggtttgggctggagcagagctggtttcctggaatgttcctttggcccacatatggttctgtcccggtgagctctgttgtcagaggctcacgggacagaaccacatgctagggtctagggcccctgtctactgatagtcagtttgctgtgtcagaaagcacttctgaaagcagatatgagtcaccagacaggcaggatcttacaaaactcacgggcctctttggtctgcatgatggccccatgcgtttcataggctgtccactgagcgggattgtctgctgagtgggatgagccaactccagtttcttaaggaaaccactggaatctgcagcccccacatgcatctgtctaacgcatgcctcgtgttcgttttgcaaacatgcctgtggtggagggtggtcagttgtagccctgtgcgtctcaaggctgccttgtgaggccattcccagtgcgtgcccttgagctccttaccaccccttttcctgctcggccctttaatccctgacagacctggactgtgtggctgaagggggacctgcagcactgcagaaatgcctctgcgtggtgccatgaaggaaagaaaccttggcctggtctcgagaagcttcccatgcttcaggaagttagtaagggtggggtggcttgcaggattggcctgtttccagggcctcccacactcattggccagattgtgaactttgtcaggcttgtccctccctgataccaagtatgtcgagaaccgatggccccaccctctggctggtgctgggccggaggtggctatggaggattttggcatgcgtggcctgtcgccacctggacagcgtgacctcaggggttgtccactttacctttatggtgaggcctgtcggatggctaagtccttgaaaccctagagctgtgacgtagaatatgtgctgtctgtgagaccgtgttcccaggagcactgactgcagttgagagagacccattttgctctcccttaccgccccccgccccgggtgctttctgcacaaagcctagagcctggcactcaagcccaccggtggcagctcctagtgactggacatgcctggaagacccctcagccttctgtttgcagaacgttcatttcaggagcttctccttcccacagacatcttacacttgctcgacactgccacctgcagaagcctggcgggctctggtcaccatgtgtctatctgaaggttgcactggccagcatgggcctgtcccaagcgagaggggagacacagtggactgaaaggactggttgaaagtggccaatctctatcagcttaatttggcagagaaaatttgtaacaactctgagcacatgctgggtgaagtcacagctcaaggaaagataaagctgggcggaaggaggtgtgcgtggcttctggggtgggacccagaggggaggctctgggacaggggctggggttcagtgccagggccctgaggaagaaatggggactgatctcaaaattccagaattccctgtacatctgttcacgtgcttgtgtccaggtgtgacttgtaaactgtctagtgtttgcattaaataaaatggcaccgagc

SEQ ID NO: 5219 - DNA, 3604 bp, Homo sapiens
gctttgggcgggaccctgcagaggcggcggggctcctcctcccgctcctcctcggcctccccttcgggcgctctcgcgctaactgtgctcctccggggccctccgcctgctcccagccatggtggcctggcgctcggcgttccttgtctgcctcgctttctccttggccaccctggtccagcgaggatctggggactttgatgattttaacctggaggatgcagtgaaagaaacttcctcagtaaagcagccatgggaccacaccaccaccaccacaaccaataggccaggaaccaccagagctccggcaaaacctccaggtagtggattggacttggctgatgctttggatgatcaagatgatggccgcaggaaaccgggtataggaggaagagagagatggaaccatgtaaccaccacgaccaagaggccagtaaccaccagagctccagcaaatactttaggaaatgattttgacttggctgatgccctggatgatcgaaatgatcgagatgatggccgcaggaaaccaattgctggaggaggaggtttttcagacaaggatcttgaagacatagtagggggtggagaatacaaacctgacaagggtaaaggtgatggccggtacggcagcaatgacgaccctggatctggcatggtggcagagcctggcaccattgccggggtggccagcgccctggccatggccctcatcggtgccgtctccagctacatctcctaccagcagaagaagttctgcttcagcattcagcagggtctcaacgcagactacgtgaagggagagaacctggaagccgtggtatgtgaggaaccccaagtgaaatactccacgttgcacacgcagtctgcagagccgccgccgccgcccgaaccagcccggatctgagggccctgtccagctgcaggcatgcacaatggtgccaccgcttgtcacccggctccccccaccccttcatttggacccgcagctgctgtgctgctctgtgccatcggctccttgttggtctgagtttcccggatgagctctgggtgtttgtgagtttggtttctctgccctgccccaagcgtgctgagacttggtgccgaaattcaagagccagctctgatagaaagccagcaccagcctcgggagctgctgagccaccaactcccaaagccagcctgcctccagctttactgagcacaggatgcgggggccaagatgatgctgaggcctgatgacatttatgcttaggggacaagagtttgaactcaagggactgtgacccctgcacactggagtggctcattgtggcaggtttctgccaatagacagcccctgacagtggcctcaaggagctgcaggtggggggctcagcctgcacccacttggagcccctgcaaggagcgaaccggtcagcaccaagtaacaccacacacacgcagcacccaggatgatggtttcacttcagtcttccccatcccaggttttatgttgctgggcttccggagagccggtccaagcggaggctttcagtgatttaagtacaaacatgcatctcgtgatagtcctgccttgagagcttaggaatcttccggataagtatgaagcaattcgtaggcctgtttcccatctgattccatagggggctgggtgtggccttcgggttgacatgagaaaggtctttagcaatcatttctgcaccggagatgagttttatcctgtgttggggagaggtgctcaccctccaccctgtgtccctgttttggtagcaagagtgaccgatgtcaagaacgagcatcaaagccagaatcctgcttgtttgcttaaaaatgtaattgggggcggcgggggaggagaggggaaagagacattcgcttggtttagtgaaacgcaggtgactttgtagctctgtggtcagcctacttgtctgctctgagggagagtgcgtggggagccatgctcaccgtggcaaacacaggaaccccatgactcgcccctcacctggcgtggagctgcctggtttgggctggagcagagctggtttcctggaatgttcctttggcccacatatggttctgtcccggtgagctctgttgtcagaggctcacgggacagaaccacatgctagggtctagggcccctgtctactgatagtcagtttgctgtgtcagaaagcacttctgaaagcagatatgagtcaccagacaggcaggatcttacaaaactcacgggcctctttggtctgcatgatggccccatgcgtttcataggctgtccactgagcgggattgtctgctgagtgggatgagccaactccagtttcttaaggaaaccactggaatctgcagcccccacatgcatctgtctaacgcatgcctcgtgttcgttttgcaaacatgcctgtggtggagggtggtcagttgtagccctgtgcgtctcaaggctgccttgtgaggccattcccagtgcgtgcccttgagctccttaccaccccttttcctgctcggccctttaatccctgacagacctggactgtgtggctgaagggggacctgcagcactgcagaaatgcctctgcgtggtgccatgaaggaaagaaaccttggcctggtctcgagaagcttcccatgcttcaggaagttagtaagggtggggtggcttgcaggattggcctgtttccagggcctcccacactcattggccagattgtgaactttgtcaggcttgtccctccctgataccaagtatgtcgagaaccgatggccccaccctctggctggtgctgggccggaggtggctatggaggattttggcatgcgtggcctgtcgccacctggacagcgtgacctcaggggttgtccactttacctttatggtgaggcctgtcggatggctaagtccttgaaaccctagagctgtgacgtagaatatgtgctgtctgtgagaccgtgttcccaggagcactgactgcagttgagagagacccattttgctctcccttaccgccccccgccccgggtgctttctgcacaaagcctagagcctggcactcaagcccaccggtggcagctcctagtgactggacatgcctggaagacccctcagccttctgtttgcagaacgttcatttcaggagcttctccttcccacagacatcttacacttgctcgacactgccacctgcagaagcctggcgggctctggtcaccatgtgtctatctgaaggttgcactggccagcatgggcctgtcccaagcgagaggggagacacagtggactgaaaggactggttgaaagtggccaatctctatcagcttaatttggcagagaaaatttgtaacaactctgagcacatgctgggtgaagtcacagctcaaggaaagataaagctgggcggaaggaggtgtgcgtggcttctggggtgggacccagaggggaggctctgggacaggggctggggttcagtgccagggccctgaggaagaaatggggactgatctcaaaattccagaattccctgtacatctgttcacgtgcttgtgtccaggtgtgacttgtaaactgtctagtgtttgcattaaataaaatggcaccgagcag

SEQ ID NO: 5220 - DNA, 966 bp, Homo sapiens
gaaacttcctcagtaaagcagccatgggaccacaccaccaccaccacaaccaataggccaggaaccaccagagctccggcaaaacctccaggtagtggattggacttggctgatgctttggatgatcaagatgatggccgcaggaaaccgggtataggaggaagagagagatggaaccatgtaaccaccacgaccaagaggccagtaaccaccagagctccagcaaatactttaggaaatgattttgacttggctgatgccctggatgatcgaaatgatcgagatgatggccgcaggaaaccaattgctggaggaggaggtttttcagacaaggatcttgaagacatagtagggggtggagaatacaaacctgacaagggtaaaggtgatggccggtacggcagcaatgacgaccctggatctggtgggtttctgaatcctgaggctcctgttggccatgtgaaaggaaaatgaatctcaggaccccaaaatcactaagccaagggaaaagtcaagctagaaactgcatcaggcaaacgtgcctcccattctactcctaaataagatagctgcaaagatggaaaaagctgcacgcctccctcacaatttgcctacaaagaaatttcttatgggcctcaatatctttaccctaaaacagttctgtgaatttcaccctggcaatacaaactgatagctgatctttacagagggagagagagccgtccctctgctcccctgatacaaatgcatctctggttgcttcctctgcccaattgcttatgtaaaaatgcaggttcactgagccagacaaaattgtgtattcagtgaaaggctgatcaaggactcaaaagaatgcaaccttttgtctctttctcttatctccctatgacctggaagcaccccacctctacccctgctttgagttgtcccacctttctggaccaaaccaatgtacgtcttacacat

SEQ ID NO: 5221 - DNA, 3493 bp, Homo sapiens
gcagcctcgccccgccccccggcctaaccccagcccaggcgccctcaggcgccggctctctagcgcgcccgacctccatcttcccggggccgcgccgcgcgcgcgcgcgggctttgggcgggaccctgcagaggcggcggggctcctcctcccgctcctcctcggcctccccttcgggcgctctcgcgctaactgtgctcctccggggccctccgcctgctcccagccatggtggcctggcgctcggcgttccttgtctgcctcgctttctccttggccaccctggtccagcgaggatctggggactttgatgattttaacctggaggatgcagtgaaagaaacttcctcagtaaagcagccatgggaccacaccaccaccaccacaaccaataggccaggaaccaccagagctccggcaaaacctccaggtagtggattggacttggctgatgctttggatgatcaagatgatggccgcaggaaaccgggtataggaggaagaggtgatggccggtacggcagcaatgacgaccctggatctggcatggtggcagagcctggcaccattgccggggtggccagcgccctggccatggccctcatcggtgccgtctccagctacatctcctaccagcagaagaagttctgcttcagcattcagcagggtctcaacgcagactacgtgaagggagagaacctggaagccgtggtatgtgaggaaccccaagtgaaatactccacgttgcacacgcagtctgcagagccgccgccgccgcccgaaccagcccggatctgagggccctgtccagctgcaggcatgcacaatggtgccaccgcttgtcacccggctccccccaccccttcatttggacccgcagctgctgtgctgctctgtgccatcggctccttgttggtctgagtttcccggatgagctctgggtgtttgtgagtttggtttctctgccctgccccaagcgtgctgagacttggtgccgaaattcaagagccagctctgatagaaagccagcaccagcctcgggagctgctgagccaccaactcccaaagccagcctgcctccagctttactgagcacaggatgcgggggccaagatgatgctgaggcctgatgacatttatgcttaggggacaagagtttgaactcaagggactgtgacccctgcacactggagtggctcattgtggcaggtttctgccaatagacagcccctgacagtggcctcaaggagctgcaggtggggggctcagcctgcacccacttggagcccctgcaaggagcgaaccggtcagcaccaagtaacaccacacacacgcagcacccaggatgatggtttcacttcagtcttccccatcccaggttttatgttgctgggcttccggagagccggtccaagcggaggctttcagtgatttaagtacaaacatgcatctcgtgatagtcctgccttgagagcttaggaatcttccggataagtatgaagcaattcgtaggcctgtttcccatctgattccatagggggctgggtgtggccttcgggttgacatgagaaaggtctttagcaatcatttctgcaccggagatgagttttatcctgtgttggggagaggtgctcaccctccaccctgtgtccctgttttggtagcaagagtgaccgatgtcaagaacgagcatcaaagccagaatcctgcttgtttgcttaaaaatgtaattgggggcggcgggggaggagaggggaaagagacattcgcttggtttagtgaaacgcaggtgactttgtagctctgtggtcagcctacttgtctgctctgagggagagtgcgtggggagccatgctcaccgtggcaaacacaggaaccccatgactcgcccctcacctggcgtggagctgcctggtttgggctggagcagagctggtttcctggaatgttcctttggcccacatatggttctgtcccggtgagctctgttgtcagaggctcacgggacagaaccacatgctagggtctagggcccctgtctactgatagtcagtttgctgtgtcagaaagcacttctgaaagcagatatgagtcaccagacaggcaggatcttacaaaactcacgggcctctttggtctgcatgatggccccatgcgtttcataggctgtccactgagcgggattgtctgctgagtgggatgagccaactccagtttcttaaggaaaccactggaatctgcagcccccacatgcatctgtctaacgcatgcctcgtgttcgttttgcaaacatgcctgtggtggagggtggtcagttgtagccctgtgcgtctcaaggctgccttgtgaggccattcccagtgcgtgcccttgagctccttaccaccccttttcctgctcggccctttaatccctgacagacctggactgtgtggctgaagggggacctgcagcactgcagaaatgcctctgcgtggtgccatgaaggaaagaaaccttggcctggtctcgagaagcttcccatgcttcaggaagttagtaagggtggggtggcttgcaggattggcctgtttccagggcctcccacactcattggccagattgtgaactttgtcaggcttgtccctccctgataccaagtatgtcgagaaccgatggccccaccctctggctggtgctgggccggaggtggctatggaggattttggcatgcgtggcctgtcgccacctggacagcgtgacctcaggggttgtccactttacctttatggtgaggcctgtcggatggctaagtccttgaaaccctagagctgtgacgtagaatatgtgctgtctgtgagaccgtgttcccaggagcactgactgcagttgagagagacccattttgctctcccttaccgccccccgccccgggtgctttctgcacaaagcctagagcctggcactcaagcccaccggtggcagctcctagtgactggacatgcctggaagacccctcagccttctgtttgcagaacgttcatttcaggagcttctccttcccacagacatcttacacttgctcgacactgccacctgcagaagcctggcgggctctggtcaccatgtgtctatctgaaggttgcactggccagcatgggcctgtcccaagcgagaggggagacacagtggactgaaaggactggttgaaagtggccaatctctatcagcttaatttggcagagaaaatttgtaacaactctgagcacatgctgggtgaagtcacagctcaaggaaagataaagctgggcggaaggaggtgtgcgtggcttctggggtgggacccagaggggaggctctgggacaggggctggggttcagtgccagggccctgaggaagaaatggggactgatctcaaaattccagaattccctgtacatctgttcacgtgcttgtgtccaggtgtgacttgtaaactgtctagtgtttgcattaaataaaatggcaccgagc

SEQ ID NO: 5222 - DNA, 3554 bp, Homo sapiens
aactgtgctcctccggggccctccgcctgctcccagccatggtggcctggcgctcggcgttccttgtctgcctcgctttctccttggccaccctggtccagcgaggatctggggactttgatgattttaacctggaggatgcagtgaaagaaacttcctcagtaaagcagccatgggaccacaccaccaccaccacaaccaataggccaggaaccaccagagctccggcaaaacctccagggcccactgaaggtagtggattggacttggctgatgctttggatgatcaagatgatggccgcaggaaaccgggtataggaggaagagagagatggaaccatgtaaccaccacgaccaagaggccagtaaccaccagagctccagcaaatactttaggaaatgattttgacttggctgatgccctggatgatcgaaatgatcgagatgatggccgcaggaaaccaattgctggaggaggaggtttttcagacaaggatcttgaagacatagtagggggtggagaatacaaacctgacaagggtaaaggtgatggccggtacggcagcaatgacgaccctggatctggcatggtggcagagcctggcaccattgccggggtggccagcgccctggccatggccctcatcggtgccgtctccagctacatctcctaccagcagaagaagttctgcttcagcattcagcatgcagcagcaggtcaagagggtctcaacgcagactacgtgaagggagagaacctggaagccgtggtatgtgaggaaccccaagtgaaatactccacgttgcacacgcagtctgcagagccgccgccgccgcccgaaccagcccggatctgagggccctgtccagctgcaggcatgcacaatggtgccaccgcttgtcacccggctccccccaccccttcatttggacccgcagctgctgtgctgctctgtgccatcggctccttgttggtctgagtttcccggatgagctctgggtgtttgtgagtttggtttctctgccctgccccaagcgtgctgagacttggtgccgaaattcaagagccagctctgatagaaagccagcaccagcctcgggagctgctgagccaccaactcccaaagccagcctgcctccagctttactgagcacaggatgcgggggccaagatgatgctgaggcctgatgacatttatgcttaggggacaagagtttgaactcaagggactgtgacccctgcacactggagtggctcattgtggcaggtttctgccaatagacagcccctgacagtggcctcaaggagctgcaggtggggggctcagcctgcacccacttggagcccctgcaaggagcgaaccggtcagcaccaagtaacaccacacacacgcagcacccaggatgatggtttcacttcagtcttccccatcccaggttttatgttgctgggcttccggagagccggtccaagcggaggctttcagtgatttaagtacaaacatgcatctcgtgatagtcctgccttgagagcttaggaatcttccggataagtatgaagcaattcgtaggcctgtttcccatctgattccatagggggctgggtgtggccttcgggttgacatgagaaaggtctttagcaatcatttctgcaccggagatgagttttatcctgtgttggggagaggtgctcaccctccaccctgtgtccctgttttggtagcaagagtgaccgatgtcaagaacgagcatcaaagccagaatcctgcttgtttgcttaaaaatgtaattgggggcggcgggggaggagaggggaaagagacattcgcttggtttagtgaaacgcaggtgactttgtagctctgtggtcagcctacttgtctgctctgagggagagtgcgtggggagccatgctcaccgtggcaaacacaggaaccccatgactcgcccctcacctggcgtggagctgcctggtttgggctggagcagagctggtttcctggaatgttcctttggcccacatatggttctgtcccggtgagctctgttgtcagaggctcacgggacagaaccacatgctagggtctagggcccctgtctactgatagtcagtttgctgtgtcagaaagcacttctgaaagcagatatgagtcaccagacaggcaggatcttacaaaactcacgggcctctttggtctgcatgatggccccatgcgtttcataggctgtccactgagcgggattgtctgctgagtgggatgagccaactccagtttcttaaggaaaccactggaatctgcagcccccacatgcatctgtctaacgcatgcctcgtgttcgttttgcaaacatgcctgtggtggagggtggtcagttgtagccctgtgcgtctcaaggctgccttgtgaggccattcccagtgcgtgcccttgagctccttaccaccccttttcctgctcggccctttaatccctgacagacctggactgtgtggctgaagggggacctgcagcactgcagaaatgcctctgcgtggtgccatgaaggaaagaaaccttggcctggtctcgagaagcttcccatgcttcaggaagttagtaagggtggggtggcttgcaggattggcctgtttccagggcctcccacactcattggccagattgtgaactttgtcaggcttgtccctccctgataccaagtatgtcgagaaccgatggccccaccctctggctggtgctgggccggaggtggctatggaggattttggcatgcgtggcctgtcgccacctggacagcgtgacctcaggggttgtccactttacctttatggtgaggcctgtcggatggctaagtccttgaaaccctagagctgtgacgtagaatatgtgctgtctgtgagaccgtgttcccaggagcactgactgcagttgagagagacccattttgctctcccttaccgccccccgccccgggtgctttctgcacaaagcctagagcctggcactcaagcccaccggtggcagctcctagtgactggacatgcctggaagacccctcagccttctgtttgcagaacgttcatttcaggagcttctccttcccacagacatcttacacttgctcgacactgccacctgcagaagcctggcgggctctggtcaccatgtgtctatctgaaggttgcactggccagcatgggcctgtcccaagcgagaggggagacacagtggactgaaaggactggttgaaagtggccaatctctatcagcttaatttggcagagaaaatttgtaacaactctgagcacatgctgggtgaagtcacagctcaaggaaagataaagctgggcggaaggaggtgtgcgtggcttctggggtgggacccagaggggaggctctgggacaggggctggggttcagtgccagggccctgaggaagaaatggggactgatctcaaaattccagaattccctgtacatctgttcacgtgcttgtgtccaggtgtgacttgtaaactgtctagtgtttgcattaaataaaatggcaccgagcag

SEQ ID NO: 5223 - DNA, 988 bp, Homo sapiens
gctaactgtgctcctccggggccctccgcctgctcccagccatggtggcctggcgctcggcgttccttgtctgcctcgctttctccttggccaccctggtccagcgaggatctggggactttgatgattttaacctggaggatgcagtgaaagaaacttcctcagtaaagcagagatggaaccatgtaaccaccacgaccaagaggccagtaaccaccagagctccagcaaatactttaggaaatgattttgacttggctgatgccctggatgatcgaaatgatcgagatgatggccgcaggaaaccaattgctggaggaggaggtttttcagacaaggatcttgaagacatagtagggggtggagaatacaaacctgacaagggtaaaggtgatggccggtacggcagcaatgacgaccctggatctggcatggtggcagagcctggcaccattgccggggtggccagcgccctggccatggccctcatcggtgccgtctccagctacatctcctaccagcagaagaagttctgcttcagcattcagcagggtctcaacgcagactacgtgaagggagagaacctggaagccgtggtatgtgaggaaccccaagtgaaatactccacgttgcacacgcagtctgcagagccgccgccgccgcccgaaccagcccggatctgagggccctgtccagctgcaggcatgcacaatggtgccaccgcttgtcacccggctccccccaccccttcatttggacccgcagctgctgtgctgctctgtgccatcggctccttgttggtctgagtttcccggatgagctctgggtgtttgtgagtttggtttctctgccctgccccaagcgtgctgagacttggtgccgaaattcaagagccagctctgatagaaagccagcaccagcctcgggagctgctgagccaccaactcccaaagccagcctgcctccagctttactgagcacaggatgc

SEQ ID NO: 5224 - DNA, 4137 bp, Homo sapiens
atcactttggaagccgggggaagactttgccctgccctgagagctggtctgcgtttcccaggcgcggcggcggcggagcagcagctgcagcagccgagtccaaataggagcggccacagccaggggcgtgagcgccccgcgcggagcgagctcgggttcccctcggaatgtccccggggcgcccggcgcgctgaccccgaagccgcctccgccttcggcgcctgctgcctccctcggccaggcttgttgttcgggactgtgagcttcctggctcctgggcagtggggaagcccccgggggcgagtgacttcagctggccacgacccagccctcccccgtgcgtatctcgcttaagatggcagcggagtcaggggaactaatcggggcttgtgagttcatgaaagatcggttatattttgctactttaaggaatagaccaaaaagcacagtaaatacccactatttctccatcgatgaggagctggtctatgaaaatttctatgcagattttggaccgctgaacttggcaatggtgtacagatattgctgcaaactaaacaagaaactaaaatcatacagtttgtcaagaaagaaaatagtgcactacacctgttttgaccaacggaaaagagcaaatgcagcatttttgataggtgcctatgcagtaatctatttaaagaagacaccagaagaagcctacagagcactcctgtctggctcaaaccccccctatcttccattcagggatgcttcctttggaaattgcacttacaatctcaccattctcgactgtttgcagggaatcagaaagggattacaacatggattttttgactttgagacatttgatgtggatgaatatgaacattatgagcgagttgaaaatggtgacttcaactggattgttccaggaaaatttttagcatttagtggaccacatcctaaaagcaaaattgagaatggttatcctcttcacgcccctgaagcctactttccttatttcaaaaagcataatgtgactgcagttgtgaggctaaacaaaaagatttatgaggcaaagcgcttcacagacgctggcttcgagcactatgacctcttcttcatagatggcagcacacccagtgacaacatcgtgcgaaggttcctgaacatctgtgagaacaccgaaggggccatcgccgttcactgcaaagctggtcttggaagaacagggacattgatagcctgttatgtaatgaaacactacaggtttacacatgctgaaataattgcttggattagaatatgccggccaggctctattataggaccccagcagcacttcctggaagaaaaacaagcatcgttgtgggtccaaggagacattttccgatccaaactgaaaaatcgaccatccagtgaaggaagtattaataaaattctttctggcctagatgatatgtctattggtggaaatctttcaaaaacacaaaacatggaacgatttggagaggataacttagaagatgatgatgtggaaatgaaaaatggtataacccagggagacaaactacgtgccttaaaaagtcagagacagccacgtacctcaccatcctgtgcatttaggtcagatgatacaaaaggacatccaagagcagtgtcccagcctttcagattaagttcatccctgcaaggatctgcagttactttgaagacatcaaaaatggcactgtccccttcagcaacggccaagaggatcaacagaacttctttgtcttcgggtgccactgtaagaagcttttccataaactcccggctagccagttctctagggaacttgaatgctgcaacagatgatccagagaacaaaaagacctcctcatcctctaaggcaggcttcacagccagcccgtttaccaacctcttgaatggcagctcccagccaactaccagaaattaccctgagctcaacaataatcagtacaacagaagcagcaacagcaacgggggcaacctgaacagccccccaggcccccacagcgccaagacagaggagcacaccaccatcctccgaccctcctacaccgggctttcttcttcttcagcgagattcctgagccgttctatcccttcccttcagtctgaatatgttcattactaaggccttgccactccagtgaaagctgttcttctcttagacacaatttcttcatctggacgagcagtggagagggaaagcaacttcttgctggaagaatatctctgccttcttaccttaaattaaaaagagcactaagataacaccttcaagagacttgaaaacagaaaactggttaatgactactataaatgcactgaaactatgtttatggagatttccatacttttaaagacagttttaatgttgaatttggtattttgaagggttatttttaatgtattttggtaatacatttattattatatttacatgtacagtgttacattatatatgtattgtgaactttaaaagactattttgataaatttataaatatataaaattatgtaaaaactacactatattttgatttagattttcctgctgtttgctaccaaaaatttgtattttaaatctgtttagttttagtatggttttgtctctaatgaataaataattccttcttattaagaagaagtaagggagaaagtttttagaaagtgatttttatgctcgcactataaatatggcaggtcagttcattcttttgggaagtcagtttagttacactgagtttatccaagtttatctctaccaagagtataatggcatgggatggcttatttaggacaattccctttcctattgtttttgttgctgagccaatttgagttagttttgcatcctggggggctttaaaatacagcatgcagtgaaagatcagaattcactgaatatttcttctgagagcatggtttcatggtttttctctatgaaatgactcaatattccaaatgtttttttttccttcctcctttcaaaagagttcttaacccaattaggatatcctgctttgggtatgaggttgttgttgcctgtaatcacacatggtttgacatcagttttaaatcaatggagagaaaaaactgaaaaagatgctgctaagtagttctctgtattaaaggagatatttttaaaacagggtacaaccccctgctgcacacgctagcatatctggaacctactatgaaaatgaaaggacccttataggtactcacagccctttcatgtaagtatgatctgatatttaggtcttcagaagcctgtaggtttcatttctatgaggaatcgaggagcgttacatcctgatatccttccaggctgcttaagaatggactgcttcgacactgaaagtgctagttaaatggattcatatgaagtgctttactcccaaccattgagttatttataatgtatttattaggggagggtaccttgagtctattatatatgcttcatcaaaacatcttgttcatgttttatgtttttaaaaaaggcatttgaatgaatgtttgactcaggtttgttaaattaaccttcagtaactgcagtaccaaaaattacactcaactgatgaaaaaaacgaattgtatgatttaggaatcaaaaactaaaataagtggaattatgtatcttttctaaagttaaaaaagtaaaatattttattatgagttattataaaaattggttaattgtataggaagatgacagtatttttttcaagttatcataaaaagtaattcagatgacatttgagaagtaggggaaagggaatcatgttgacagttttagttctgtgaacactaatttgtgtgaagctattaaaatgattgtaaagttgactactgtaaatttcccataattatgtgtgtatatgtgtcatatgtatgtacatgtatatgtctaaaaattactttacacatgtgcctacatagacacaccaagaagtggatgtatataatatagaaagtatatagcaaagtaattttactctgataataaaaattgtttgacatgtattttgttatgaatagtttatcttccaaaagatattttgctctattttaaagtgtagaagaatacactgctaataaataataaaagttttattcaattta

SEQ ID NO: 5225 - DNA, 2417 bp, Homo sapiens
cgaaggaggatccggagcagctgctgccagcccgcgggcactgaagtcctcccggctgccgctcgagtagccacgggcgcgatcgggaccagaagtctcctcctccatgatcactttggaagccgggggaagactttgccctgccctgagagctggtctgcgtttcccaggcgcggcggcggcggagcagcagctgcagcagccgagtccaaataggagcggccacagccaggggcgtgagcgccccgcgcggagcgagctcgggttcccctcggaatgtccccggggcgcccggcgcgctgaccccgaagccgcctccgccttcggcgcctgctgcctccctcggccaggcttgttgttcgggactgtgagcttcctggctcctgggcagtggggaagcccccgggggcgagtgacttcagctggccacgacccagccctcccccgtgcgtatctcgcttaagatggcagcggagtcaggggaactaatcggggcttgtgagttcatgaaagatcggttatattttgctactttaaggaatagaccaaaaagcacagtaaatacccactatttctccatcgatgaggagctggtctatgaaaatttctatgcagattttggaccgctgaacttggcaatggtgtacagatattgctgcaaactaaacaagaaactaaaatcatacagtttgtcaagaaagaaaatagtgcactacacctgttttgaccaacggaaaagagcaaatgcagcatttttgataggtgcctatgcagtaatctatttaaagaagacaccagaagaagcctacagagcactcctgtctggctcaaaccccccctatcttccattcagggatgcttcctttggaaattgcacttacaatctcaccattctcgactgtttgcagggaatcagaaagggattacaacatggattttttgactttgagacatttgatgtggatgaatatgaacattatgagcgagttgaaaatggtgacttcaactggattgttccaggaaaatttttagcatttagtggaccacatcctaaaagcaaaattgagaatggttatcctcttcacgcccctgaagcctactttccttatttcaaaaagcataatgtgactgcagttgtgaggctaaacaaaaagatttatgaggcaaagcgcttcacagacgctggcttcgagcactatgacctcttcttcatagatggcagcacacccagtgacaacatcgtgcgaaggttcctgaacatctgtgagaacaccgaaggggccatcgccgttcactgcaaagctggtcttggaagaacagggacattgatagcctgttatgtaatgaaacactacaggtttacacatgctgaaataattgcttggattagaatatgccggccaggctctattataggaccccagcagcacttcctggaagaaaaacaagcatcgttgtgggtccaaggagacattttccgatccaaactgaaaaatcgaccatccagtgaaggaagtattaataaaattctttctggcctagatgatatgtctattggtggaaatctttcaaaaacacaaaacatggaacgatttggagaggataacttagaagatgatgatgtggaaatgaaaaatggtataacccagggagacaaactacgtgccttaaaaagtcagagacagccacgtacctcaccatcctgtgcatttaggtcagatgatacaaaaggacatccaagagcagtgtcccagcctttcagattaagttcatccctgcaaggatctgcagttactttgaagacatcaaaaatggcactgtccccttcagcaacggccaagaggatcaacagaacttctttgtcttcgggtgccactgtaagaagcttttccataaactcccggctagccagttctctagggaacttgaatgctgcaacagatgatccagagaacaaaaagacctcctcatcctctaaggcaggcttcacagccagcccgtttaccaacctcttgaatggcagctcccagccaactaccagaaattaccctgagctcaacaataatcagtacaacagaagcagcaacagcaacgggggcaacctgaacagccccccaggcccccacagcgccaagacagaggagcacaccaccatcctccgaccctcctacaccgggctttcttcttcttcagcgagattcctgagccgttctatccctgtaagtgcgcagacaccacctcctggtcctcagaaccctgaatgcaacttctgtgccttgccttcccagccgaggctgccaccaaagaaatttaatagtgccaaggaagccttctgagcgatgccttccctctgtgctgtgaaactgtctatgcactacattctgctagctcctcttcaagtaaacgccaagtcacaa

SEQ ID NO: 5226 - DNA, 1883 bp, Homo sapiens
ccggagcagctgctgccagcccgcgggcactgaagtcctcccggctgccgctcgagtagccacgggcgcgatcgggaccagaagtctcctcctccatgatcactttggaagccgggggaagactttgccctgccctgagagctggtctgcgtttcccaggcgcggcggcggcggagcagcagctgcagcagccgagtccaaataggagcggccacagccaggggcgtgagcgccccgcgcggagcgagctcgggttcccctcggaatgtccccggggcgcccggcgcgctgaccccgaagccgcctccgccttcggcgcctgctgcctccctcggccaggcttgttgttcgggactgtgagcttcctggctcctgggcagtggggaagcccccgggggcgagtgacttcagctggccacgacccagccctcccccgtgcgtatctcgcttaagatggcagcggagtcaggggaactaatcggggcttgtgagttcatgaaagatcggttatattttgctactttaaggaatagaccaaaaagcacagtaaatacccactatttctccatcgatgaggagctggtctatgaaaatttctatgcagattttggaccgctgaacttggcaatggtgtacagatattgctgcaaactaaacaagaaactaaaatcatacagtttgtcaagaaagaaaatagtgcactacacctgttttgaccaacggaaaagagcaaatgcagcatttttgataggtgcctatgcagtaatctatttaaagaagacaccagaagaagcctacagagcactcctgtctggctcaaaccccccctatcttccattcagggatgcttcctttggaaattgcacttacaatctcaccattctcgactgtttgcagggaatcagaaagggattacaacatggattttttgactttgagacatttgatgtggatgaatatgaacattatgagcgagttgaaaatggtgacttcaactggattgttccaggaaaatttttagcatttagtggaccacatcctaaaagcaaaattgagaatggttatcctcttcacgcccctgaagcctactttccttatttcaaaaagcataatgtgactgcagttgtgaggctaaacaaaaagatttatgaggcaaagcgcttcacagacgctggcttcgagcactatgacctcttcttcatagatggcagcacacccagtgacaacatcgtgcgaaggttcctgaacatctgtgagaacaccgaaggggccatcgccgttcactgcaaagctggtcttggaagaacagggacattgatagcctgttatgtaatgaaacactacaggtttacacatgctgaaataattgcttggattagaatatgccggccaggctctattataggaccccagcagcacttcctggaagaaaaacaagcatcgttgtgggtccaaggagacattttccgatccaaactgaaaaatcgaccatccagtgaaggaagtattaataaaattctttctggcctagatgatatgtctattggtggaaatctttcaaaaacacaaaacatggaacgatttggagaggtaagttttccctaggagattctatcttcttaaaactgatgttctgcatttgtttctcagttggacctatataacatagcagtgtcttttctctggatgccacgagtaccaagtttttagaagtagagccatccgtctatatagcaagaagcagaggaaagaaaccaattgcccttaaaaaaaaaaaagctataatttaaggagtaaattataaaggaggctactctggtaaggggtaatatttatagaaaggaaacagaaaagcaaactttctatttgaaaattaaaataaa

SEQ ID NO: 5227 - DNA, 4181 bp, Homo sapiens
agagtaactgctgaaaggaggtggcgaaggaggatccggagcagctgctgccagcccgcgggcactgaagtcctcccggctgccgctcgagtagccacgggcgcgatcgggaccagaagtctcctcctccatgatcactttggaagccgggggaagactttgccctgccctgagagctggtctgcgtttcccaggcgcggcggcggcggagcagcagctgcagcagccgagtccaaataggagcggccacagccaggggcgtgagcgccccgcgcggagcgagctcgggttcccctcggaatgtccccggggcgcccggcgcgctgaccccgaagccgcctccgccttcggcgcctgctgcctccctcggccaggcttgttgttcgggactgtgagcttcctggctcctgggcagtggggaagcccccgggggcgagtgacttcagctggccacgacccagccctcccccgtgcgtatctcgcttaagatggcagcggagtcaggggaactaatcggggcttgtgagttcatgaaagatcggttatattttgctactttaaggaatagaccaaaaagcacagtaaatacccactatttctccatcgatgaggagctggtctatgaaaatttctatgcagattttggaccgctgaacttggcaatggtgtacagatattgctgcaaactaaacaagaaactaaaatcatacagtttgtcaagaaagaaaatagtgcactacacctgttttgaccaacggaaaagagcaaatgcagcatttttgataggtgcctatgcagtaatctatttaaagaagacaccagaagaagcctacagagcactcctgtctggctcaaaccccccctatcttccattcagggatgcttcctttggaaattgcacttacaatctcaccattctcgactgtttgcagggaatcagaaagggattacaacatggattttttgactttgagacatttgatgtggatgaatatgaacattatgaggttatcctcttcacgcccctgaagcctactttccttatttcaaaaagcataatgtgactgcagttgtgaggctaaacaaaaagatttatgaggcaaagcgcttcacagacgctggcttcgagcactatgacctcttcttcatagatggcagcacacccagtgacaacatcgtgcgaaggttcctgaacatctgtgagaacaccgaaggggccatcgccgttcactgcaaagctggtcttggaagaacagggacattgatagcctgttatgtaatgaaacactacaggtttacacatgctgaaataattgcttggattagaatatgccggccaggctctattataggaccccagcagcacttcctggaagaaaaacaagcatcgttgtgggtccaaggagacattttccgatccaaactgaaaaatcgaccatccagtgaaggaagtattaataaaattctttctggcctagatgatatgtctattggtggaaatctttcaaaaacacaaaacatggaacgatttggagaggataacttagaagatgatgatgtggaaatgaaaaatggtataacccagggagacaaactacgtgccttaaaaagtcagagacagccacgtacctcaccatcctgtgcatttaggtcagatgatacaaaaggacatccaagagcagtgtcccagcctttcagattaagttcatccctgcaaggatctgcagttactttgaagacatcaaaaatggcactgtccccttcagcaacggccaagaggatcaacagaacttctttgtcttcgggtgccactgtaagaagcttttccataaactcccggctagccagttctctagggaacttgaatgctgcaacagatgatccagagaacaaaaagacctcctcatcctctaaggcaggcttcacagccagcccgtttaccaacctcttgaatggcagctcccagccaactaccagaaattaccctgagctcaacaataatcagtacaacagaagcagcaacagcaacgggggcaacctgaacagccccccaggcccccacagcgccaagacagaggagcacaccaccatcctccgaccctcctacaccgggctttcttcttcttcagcgagattcctgagccgttctatcccttcccttcagtctgaatatgttcattactaaggccttgccactccagtgaaagctgttcttctcttagacacaatttcttcatctggacgagcagtggagagggaaagcaacttcttgctggaagaatatctctgccttcttaccttaaattaaaaagagcactaagataacaccttcaagagacttgaaaacagaaaactggttaatgactactataaatgcactgaaactatgtttatggagatttccatacttttaaagacagttttaatgttgaatttggtattttgaagggttatttttaatgtattttggtaatacatttattattatatttacatgtacagtgttacattatatatgtattgtgaactttaaaagactattttgataaatttataaatatataaaattatgtaaaaactacactatattttgatttagattttcctgctgtttgctaccaaaaatttgtattttaaatctgtttagttttagtatggttttgtctctaatgaataaataattccttcttattaagaagaagtaagggagaaagtttttagaaagtgatttttatgctcgcactataaatatggcaggtcagttcattcttttgggaagtcagtttagttacactgagtttatccaagtttatctctaccaagagtataatggcatgggatggcttatttaggacaattccctttcctattgtttttgttgctgagccaatttgagttagttttgcatcctggggggctttaaaatacagcatgcagtgaaagatcagaattcactgaatatttcttctgagagcatggtttcatggtttttctctatgaaatgactcaatattccaaatgtttttttttccttcctcctttcaaaagagttcttaacccaattaggatatcctgctttgggtatgaggttgttgttgcctgtaatcacacatggtttgacatcagttttaaatcaatggagagaaaaaactgaaaaagatgctgctaagtagttctctgtattaaaggagatatttttaaaacagggtacaaccccctgctgcacacgctagcatatctggaacctactatgaaaatgaaaggacccttataggtactcacagccctttcatgtaagtatgatctgatatttaggtcttcagaagcctgtaggtttcatttctatgaggaatcgaggagcgttacatcctgatatccttccaggctgcttaagaatggactgcttcgacactgaaagtgctagttaaatggattcatatgaagtgctttactcccaaccattgagttatttataatgtatttattaggggagggtaccttgagtctattatatatgcttcatcaaaacatcttgttcatgttttatgtttttaaaaaaggcatttgaatgaatgtttgactcaggtttgttaaattaaccttcagtaactgcagtaccaaaaattacactcaactgatgaaaaaaacgaattgtatgatttaggaatcaaaaactaaaataagtggaattatgtatcttttctaaagttaaaaaagtaaaatattttattatgagttattataaaaattggttaattgtataggaagatgacagtatttttttcaagttatcataaaaagtaattcagatgacatttgagaagtaggggaaagggaatcatgttgacagttttagttctgtgaacactaatttgtgtgaagctattaaaatgattgtaaagttgactactgtaaatttcccataattatgtgtgtatatgtgtcatatgtatgtacatgtatatgtctaaaaattactttacacatgtgcctacatagacacaccaagaagtggatgtatataatatagaaagtatatagcaaagtaattttactctgataataaaaattgtttgacatgtattttgttatgaatagtttatcttccaaaagatattttgctctattttaaagtgtagaagaatacactgctaataaataataaaagttttattcaattt

SEQ ID NO: 5228 - DNA, 841 bp, Homo sapiens
gatgagagggcgtggagaaccagatgggaaactttttgtcccgtgagaacaaagtacaagttatatcagagtctgatcggttatattttgctactttaaggaatagaccaaaaagcacagtaaatacccactatttctccatcgatgaggagctggtctatgaaaatttctatgcagattttggaccgctgaacttggcaatggtgtacagatattgctgcaaactaaacaagaaactaaaatcatacagtttgtcaagaaagaaaatagtgcactacacctgttttgaccaacggaaaagagcaaatgcagcatttttgataggtgcctatgcagtaatctatttaaagaagacaccagaagaagcctacagagcactcctgtctggctcaaaccccccctatcttccattcagggatgcttcctttggaaattgcacttacaatctcaccattctcgactgtttgcagggaatcagaaagggattacaacatggattttttgactttgagacatttgatgtggatgaatatgaacattatgagcgagttgaaaatggtgacttcaactggattgttccaggaaaatttttagcatttagtggaccacatcctaaaagcaaaattgagaatggttatcctcttcacgcccctgaagcctactttccttatttcaaaaagcataatgtgactgcagttgtgaggctaaacaaaaagatttatgaggcaaagcgcttcacagacgctggcttcgagcactatgacctcttcttcatagatggcagcacacccagtgacaacatcgtgcgaaggttcctgaacatctgtgagaacaccgaagg

SEQ ID NO: 5229 - DNA, 2065 bp, Homo sapiens
aggggaatttaggaatccattgaggatgcctgaatggggttgttggccctgatcacactctagagacaggcatatcatcacaggcaatcagaaatgaagaaggacattaacttgtaccctgtggaattgtcttcagttgataaaaaggacttctctatcggttatattttgctactttaaggaatagaccaaaaagcacagtaaatacccactatttctccatcgatgaggagctggtctatgaaaatttctatgcagattttggaccgctgaacttggcaatggtgtacagatattgctgcaaactaaacaagaaactaaaatcatacagtttgtcaagaaagaaaatagtgcactacacctgttttgaccaacggaaaagagcaaatgcagcatttttgataggtgcctatgcagtaatctatttaaagaagacaccagaagaagcctacagagcactcctgtctggctcaaaccccccctatcttccattcagggatgcttcctttggaaattgcacttacaatctcaccattctcgactgtttgcagggaatcagaaagggattacaacatggattttttgactttgagacatttgatgtggatgaatatgaacattatgagcgagttgaaaatggtgacttcaactggattgttccaggaaaatttttagcatttagtggaccacatcctaaaagcaaaattgagaatggttatcctcttcacgcccctgaagcctactttccttatttcaaaaagcataatgtgactgcagttgtgaggctaaacaaaaagatttatgaggcaaagcgcttcacagacgctggcttcgagcactatgacctcttcttcatagatggcagcacacccagtgacaacatcgtgcgaaggttcctgaacatctgtgagaacaccgaaggggccatcgccgttcactgcaaagctggtcttggaagaacagggacattgatagcctgttatgtaatgaaacactacaggtttacacatgctgaaataattgcttggattagaatatgccggccaggctctattataggaccccagcagcacttcctggaagaaaaacaagcatcgttgtgggtccaaggagacattttccgatccaaactgaaaaatcgaccatccagtgaaggaagtattaataaaattctttctggcctagatgatatgtctattggtggaaatctttcaaaaacacaaaacatggaacgatttggagaggataacttagaagatgatgatgtggaaatgaaaaatggtataacccagggagacaaactacgtgccttaaaaagtcagagacagccacgtacctcaccatcctgtgcatttaggtcagatgatacaaaaggacatccaagagcagtgtcccagcctttcagattaagttcatccctgcaaggatctgcagttactttgaagacatcaaaaatggcactgtccccttcagcaacggccaagaggatcaacagaacttctttgtcttcgggtgccactgtaagaagcttttccataaactcccggctagccagttctctagggaacttgaatgctgcaacagatgatccagagaacaaaaagacctcctcatcctctaaggcaggcttcacagccagcccgtttaccaacctcttgaatggcagctcccagccaactaccagaaattaccctgagctcaacaataatcagtacaacagaagcagcaacagcaacgggggcaacctgaacagccccccaggcccccacagcgccaagacagaggagcacaccaccatcctccgaccctcctacaccgggctttcttcttcttcagcgagattcctgagccgttctatccctgtaagtgcgcagacaccacctcctggtcctcagaaccctgaatgcaacttctgtgccttgccttcccagccgaggctgccaccaaagaaatttaatagtgccaaggaagccttctgagcgatgccttccctctgtgctgtgaaactgtctatgcactacattctgctagctcctcttcaagtaaacgccaagtcacaactggg

SEQ ID NO: 5230 - DNA, 1928 bp, Homo sapiens
cttaagatggcagcggagtcaggggaactaatcggggcttgtgagttcatgaaagatcggttatattttgctactttaaggaatagaccaaaaagcacagtaaatacccactatttctccatcgatgaggagctggtctatgaaaatttctatgcagattttggaccgctgaacttggcaatggtgtacagatattgctgcaaactaaacaagaaactaaaatcatacagtttgtcaagaaagaaaatagtgcactacacctgttttgaccaacggaaaagagcaaatgcagcatttttgataggtgcctatgcagtaatctatttaaagaagacaccagaagaagcctacagagcactcctgtctggctcaaaccccccctatcttccattcagggatgcttcctttggaaattgcacttacaatctcaccattctcgactgtttgcagggaatcagaaagggattacaacatggattttttgactttgagacatttgatgtggatgaatatgaacattatgagcgagttgaaaatggtgacttcaactggattgttccaggaaaatttttagcatttagtggaccacatcctaaaagcaaaattgagaatggttatcctcttcacgcccctgaagcctactttccttatttcaaaaagcataatgtgactgcagttgtgaggctaaacaaaaagatttatgaggcaaagcgcttcacagacgctggcttcgagcactatgacctcttcttcatagatggcagcacacccagtgacaacatcgtgcgaaggttcctgaacatctgtgagaacaccgaaggggccatcgccgttcactgcaaagctggtcttggaagaacagggacattgatagcctgttatgtaatgaaacactacaggtttacacatgctgaaataattgcttggattagaatatgccggccaggctctattataggaccccagcagcacttcctggaagaaaaacaagcatcgttgtgggtccaaggagacattttccgatccaaactgaaaaatcgaccatccagtgaaggaagtattaataaaattctttctggcctagatgatatgtctattggtggaaatctttcaaaaacacaaaacatggaacgatttggagaggataacttagaagatgatgatgtggaaatgaaaaatggtataacccagggagacaaactacgtgccttaaaaagtcagagacagccacgtacctcaccatcctgtgcatttaggtcagatgatacaaaaggacatccaagagcagtgtcccagcctttcagattaagttcatccctgcaaggatctgcagttactttgaagacatcaaaaatggcactgtccccttcagcaacggccaagaggatcaacagaacttctttgtcttcgggtgccactgtaagaagcttttccataaactcccggctagccagttctctagggaacttgaatgctgcaacagatgatccagagaacaaaaagacctcctcatcctctaaggcaggcttcacagccagcccgtttaccaacctcttgaatggcagctcccagccaactaccagaaattaccctgagctcaacaataatcagtacaacagaagcagcaacagcaacgggggcaacctgaacagccccccaggcccccacagcgccaagacagaggagcacaccaccatcctccgaccctcctacaccgggctttcttcttcttcagcgagattcctgagccgttctatcccttgttcatgcctactgctagtctttaggaagccctttcttggaagccccctgctctccttaccaatttctcatctttaaataaagacatatattacctcccatgtcttctgtgaagctctccccatcccttcagtctgaatatgttcattactaaggccttgccactc

SEQ ID NO: 5231 - DNA, 1868 bp, Homo sapiens
cacggaacagccctcctggggtccccacgagccgcgtcctgctgtgccccggcgcctacgcagcagcggccgcggccgcggtgggcacgcacggttaccccgggcagctccggccgccagctgcagccccgtcgcctcggccgcgccagccggctgcgggcacctgggggcgggctgggggcgccggccgcggcaggaggcgctgtagcgagggctgcggcgccggtcctgcggcggccgcgggaggcagcggggcaggcgctgtgggccgggctcctcctccggctcctgcgcgaccgcctcccgccgggctctgccggcgcccgccgtccccgcagcgccgctctgcgcccgccgccccgagcgcccgcgcggggctggcgggagcctcggcgggcgcgcgggcgcgcggggccatggtcgtggccccctgacgggccgcggccgcctccatgaagcggaaaagcgagcggcggtcgagctgggccgccgcgcccccctgctcgcggcgctgctcgtcgacctcgccgggtgtgaagaagatccgcagctccacgcagcaagacccgcgccgccgggacccccaggacgacgtgtacctggacatcaccgatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaaaagcagaaaatggagatttaaattggataataccagaccgatttattgccttctgtggacctcattcaagagccagacttgaaagtggttaccaccaacattctcctgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaagaattcctagatatctgtgaaaatgctgagggtgccattgcagtacattgcaaagctggccttggtcgcacgggcactctgatagcctgctacatcatgaagcattacaggatgacagcagccgagaccattgcgtgggtcaggatctgcagacctggctcggtgattgggcctcagcagcagtttttggtgatgaagcaaaccaacctctggctggaaggggactattttcgtcagaagttaaaggggcaggagaatggacaacacagagcagccttctccaaacttctctctggcgttgatgacatttccataaatggggtcgagaatcaagatcagcaagaacccgaaccgtacagtgatgatgacgaaatcaatggagtgacacaaggtgatagacttcgggccttgaaaagcagaagacaatccaaaacaaacgctattcctctcaccgatggttggctgtcccaggctgtcacctttctagaccggcttctgatctggctcgggatccacaaggactag

SEQ ID NO: 5232 - DNA, 1910 bp, Homo sapiens
cacggaacagccctcctggggtccccacgagccgcgtcctgctgtgccccggcgcctacgcagcagcggccgcggccgcggtgggcacgcacggttaccccgggcagctccggccgccagctgcagccccgtcgcctcggccgcgccagccggctgcgggcacctgggggcgggctgggggcgccggccgcggcaggaggcgctgtagcgagggctgcggcgccggtcctgcggcggccgcgggaggcagcggggcaggcgctgtgggccgggctcctcctccggctcctgcgcgaccgcctcccgccgggctctgccggcgcccgccgtccccgcagcgccgctctgcgcccgccgccccgagcgcccgcgcggggctggcgggagcctcggcgggcgcgcgggcgcgcggggccatggtcgtggccccctgacgggccgcggccgcctccatgaagcggaaaagcgagcggcggtcgagctgggccgccgcgcccccctgctcgcggcgctgctcgtcgacctcgccgggtgtgaagaagatccgcagctccacgcagcaagacccgcgccgccgggacccccaggacgacgtgtacctggacatcaccgatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaaaagcagaaaatggagatttaaattggataataccagaccgatttattgccttctgtggacctcattcaagagccagacttgaaagtggttaccaccaacattctcctgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaagaattcctagatatctgtgaaaatgctgagggtgccattgcagtacattgcaaagctggccttggtcgcacgggcactctgatagcctgctacatcatgaagcattacaggatgacagcagccgagaccattgcgtgggtcaggatctgcagacctggctcggtgattgggcctcagcagcagtttttggtgatgaagcaaaccaacctctggctggaaggggactattttcgtcagaagttaaaggggcaggagaatggacaacacagagcagccttctccaaacttctctctggcgttgatgacatttccataaatggggtcgagaatcaagatcagcaagaacccgaaccgtacagtgatgatgacgaaatcaatggagtgacacaaggtgatagacttcgggccttgaaaagcagaagacaatccaaaacaaacgctattcctctcacatgtcccctagctgtgctgacctctgcactgtgtagtgttgtcatctggtggattgtttgtgactacattcttcccatcctgctattctgtctcgatggtttcagaacacagtag

SEQ ID NO: 5233 - DNA, 2547 bp, Homo sapiens
atgaagcggaaaagcgagcggcggtcgagctgggccgccgcgcccccctgctcgcggcgctgctcgtcgacctcgccgggtgtgaagaagatccgcagctccacgcagcaagacccgcgccgccgggacccccaggacgacgtgtacctggacatcaccgatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaaaagcagaaaatggagatttaaattggataataccagaccgatttattgccttctgtggacctcattcaagagccagacttgaaagtggttaccaccaacattctcctgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaagaattcctagatatctgtgaaaatgctgagggtgccattgcagtacattgcaaagctggccttggtcgcacgggcactctgatagcctgctacatcatgaagcattacaggatgacagcagccgagaccattgcgtgggtcaggatctgcagacctggctcggtgattgggcctcagcagcagtttttggtgatgaagcaaaccaacctctggctggaaggggactattttcgtcagaagttaaaggggcaggagaatggacaacacagagcagccttctccaaacttctctctggcgttgatgacatttccataaatggggtcgagaatcaagatcagcaagaacccgaaccgtacagtgatgatgacgaaatcaatggagtgacacaaggtgatagacttcgggccttgaaaagcagaagacaatccaaaacaaacgctattcctctcactctctccatttcaaggactaaaacagtcttgcgttaagtaaaaacctgtgaccagagctgaaggaagactctaggactgaaaactgcaacagaaattagcacaatttgaaaacaaaacaaaattgcaaaagccttagttgctttttccacctaagaagttgatcaatggagaaaatgtccactggagtttgaataatgaactttgagtttgggtgcaagcaaatgactcagagaagggtccagctctcaagctgaatgacaaacatgctgttgtaaatttagtctcaggtgtaaatacccaagccctctggtacccagggagctggctggtctgtggtgcatgtgtgtccctgtgatggcaatcattgtagttgctggccttcagaagaattgaggatctgatggaggttttttatgtatttattttctgttcaccttgtgaccctgtgtcaaaatttataaagatacaaaaggcattactgaaatggtactttctgtaatttgatactatttggcttaatcatcttcacttgactatttgtaatactgttgtaatgttaactctgttaagtacccaagctgcttgtcttccaccaaagagtgctttattaacaagaatctgtgaaaatcacatttaaacactgttgcatgttgtaagaccaggtggtaccttagtaacctaaaacttgcaagagaatattaatggtagctttagaagactcaggaggagaaactgacttcagagttggaagatgttgcaagtcgttcctttttctgtccttcagggactgaagaactgggaggctgcccattgtttggttgccagtcatacaaattaaaatcatatttccttccatgaatggaagaaacacactattggtttttccccttggaaacagcaatcccaaataatgtcggcttacaaaaaaaaaaagttaccacttttttagagtccttccctgtaacattggattttttttttcccttatgagatccacctaaggccattgacgtggcctgcgatctcagtgacaatgatctgcttctggatctcactgttgcctttggttagggaacacaactagtaactctgcagagtgccttctcccgcagccctactggaacacagcagagtctgtgccatgaagcagttacagaaacagaattgatgtgctgctaaaaaaaaaaaaaaaaatggggcccg

SEQ ID NO: 5234 - DNA, 5589 bp, Homo sapiens
cacggaacagccctcctggggtccccacgagccgcgtcctgctgtgccccggcgcctacgcagcagcggccgcggccgcggtgggcacgcacggttaccccgggcagctccggccgccagctgcagccccgtcgcctcggccgcgccagccggctgcgggcacctgggggcgggctgggggcgccggccgcggcaggaggcgctgtagcgagggctgcggcgccggtcctgcggcggccgcgggaggcagcggggcaggcgctgtgggccgggctcctcctccggctcctgcgcgaccgcctcccgccgggctctgccggcgcccgccgtccccgcagcgccgctctgcgcccgccgccccgagcgcccgcgcggggctggcgggagcctcggcgggcgcgcgggcgcgcggggccatggtcgtggccccctgacgggccgcggccgcctccatgaagcggaaaagcgagcggcggtcgagctgggccgccgcgcccccctgctcgcggcgctgctcgtcgacctcgccgggtgtgaagaagatccgcagctccacgcagcaagacccgcgccgccgggacccccaggacgacgtgtacctggacatcaccgatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaaaagcagaaaatggagatttaaattggataataccagaccgatttattgccttctgtggacctcattcaagagccagacttgaaagtggttaccaccaacattctcctgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaagaattcctagatatctgtgaaaatgctgagggtgccattgcagtacattgcaaagctggccttggtcgcacgggcactctgatagcctgctacatcatgaagcattacaggatgacagcagccgagaccattgcgtgggtcaggatctgcagacctggctcggtgattgggcctcagcagcagtttttggtgatgaagcaaaccaacctctggctggaaggggactattttcgtcagaagttaaaggggcaggagaatggacaacacagagcagccttctccaaacttctctctggcgttgatgacatttccataaatggggtcgagaatcaagatcagcaagaacccgaaccgtacagtgatgatgacgaaatcaatggagtgacacaaggtgatagacttcgggccttgaaaagcagaagacaatccaaaacaaacgctattcctctcacagtaattcttcaatccagtgttcagagctgtaaaacatctgaacctaacatttctggcagtgcaggcattactaaaagaaccaccagatctgcttcaaggaaaagcagtgttaaaagtctctccatttcaaggactaaaacagtcttgcgttaagtaaaaacctgtgaccagagctgaaggaagactctaggactgaaaactgcaacagaaattagcacaatttgaaaacaaaacaaaattgcaaaagccttagttgctttttccacctaagaagttgatcaatggagaaaatgtccactggagtttgaataatgaactttgagtttgggtgcaagcaaatgactcagagaagggtccagctctcaagctgaatgacaaacatgctgttgtaaatttagtctcaggtgtaaatacccaagccctctggtacccagggagctggctggtctgtggtgcatgtgtgtccctgtgatggcaatcattgtagttgctggccttcagaagaattgaggatctgatggaggttttttatgtatttattttctgttcaccttgtgaccctgtgtcaaaatttataaagatacaaaaggcattactgaaatggtactttctgtaatttgatactatttggcttaatcatcttcacttgactatttgtaatactgttgtaatgttaactctgttaagtacccaagctgcttgtcttccaccaaagagtgctttattaacaagaatctgtgaaaatcacatttaaacactgttgcatgttgtaagaccaggtggtaccttagtaacctaaaacttgcaagagaatattaatggtagctttagaagactcaggaggagaaactgacttcagagttggaagatgttgcaagtcgttcctttttctgtccttcagggactgaagaactgggaggctgcccattgtttggttgccagtcatacaaattaaaatcatatttccttccatgaatggaagaaacacactattggtttttccccttggaaacagcaatcccaaataatgtcggcttacaaaaaaaaaaagttaccacttttttagagtccttccctgtaacattggattttttttttcccttatgagatccacctaaggccattgacgtggcctgcgatctcagtgacaatgatctgcttctggatctcactgttgcctttggttagggaacacaactagtaactctgcagagtgccttctcccgcagccctactggaacacagcagagtctgtgccatgaagcagttacagaaacagaattgatgtgctgctaaaaaaaaaaaaaaaaatggggcccgaaataaaagaatatatagtactcacctcagttccttccataagaagtgggtggtttaatgattgttaagccatttttgcctgtgccgggagcatggagggctgagatgtcgacaggcagtgggaaacaaatgccctcctaagccacaaggcgtgcgccagattagtaggcaactccattttaagaagctgcctttttcacaaaactggaagaaataaaagcggttggaataaacaagttaaaagtctttaatgcaaaaagtaattgaaaggcagtgcctccattttggtgtactttcttggaagaaagtataaaattgaccggcatcatgagagacggaagatgccgtgttctcagccaaacaagcaactctttccccgccaggcactgtcgggtggggtcaggccagcttttaaacactggggactggatcacagaaaaacagtggttttctgtccctggaaatgaataggcacaaagacccacttggctgtgggcagactactcttcaataagatttgggtgggaggaggaacattccttttgctattttgagctgagacaatataaatattcaaactgtgccatgcataaagcattgaattctcagggcacctcttcttccccttaccccttttaaggccatcccctccattaataataatccaggtagttgtgaaaatcgtgcttctatctgatcccttcttagtttggcttttcatcccatcagaacaagtaaacgtaggcgccacagctcttgtgagtactgtctccctcacggtgaatgagcctcctggtgtttcgtccaagaaaagaaagggtgtcactggaaccacagccctttttcattttataaactgcctcttcatgttgcctgctcaagtttccacctagaattgctatcactgtggctctttctaaaaatctttctatttaactggttcactgaaattagtcatagaaaacttgtgatttggtgaagaggcattccttgtaataaccaaatgacttgggatggtgtgcatagcaagggcagtgttacacttatgaggactgtctctagcatccaggaagtctctgggtctgagggatggaaagttcttcctgctatgaatgagagtggactcttcccctcacccccaactgaaaccacaaacaaccagaatcttctggaattctgacttagagtcgttgttatagaagaccttgttgctatggaacatgaaactgtgtgtcagatggagagatccccttaacctaagagccttaaatagccctgaaagtacactgggacggtttgcgatggaattaaaattggaagtgaatatttttaggtgctcttgaagctttctggggactcaaaattatcaaaagtcagggacagtccggaggaagagcgtctgcaaaactgggttcctagaagtatagacggacttagctttttgtagaatttggtgaggagcagcgcctcgtgagagcagaatggcctggcgtggccagtgcttcccggcagcacgcagctctgcggcctccagaattcccctgttctgagcttgatgcccctagcctgtcccctacctacttcctcccctcctctctagccctctcacaggggtgattgctacctctctgttttcttgggcctaggcaagttttagaggagttcccaagcattgttatgaggccagtgtgctcgctgggctgggcgggatggcctgggcttgtgtgtggcctgagggctctcctggggccttctcttttcccagtcacctttggagccacagaagcagtgcactcattggatgtctgttcttaacacagcttctctttctacattaaaaaaaatcattattgcattttggaaagcagtgctcatcaaaagcaacttttaaaacctattttattgttcctttaaatgttctctcccgctgaaactgccctggagaggctatctgctgctcttccatttacccacatcaggttattctccatgtcactcagtggagatgactccagatgtgtttaaagactggacaattcacctatactgtgtaggaaattacctccttaattacctggtagaattgtcagcagacatgttcatccgatgatagtactgcagttttctattaataatttgcagacttttatctaacctgcactcatgtacagattattaaaagttttaaaatgtaactgatcagtattgatcaatcattgtcttgatttttttttacagcgtatatttctaatcatattttttaaagccaagagaactggttgaatgaatgtttattttcctgaaggtatttttaagataaagcttcctaatggcgtgtaaactttgcatatgtatgtagtttgatacatattgtcacatttgaaaatcttgtgggttgtaactggttttatacaaaatatcgaatagtggaaattgtataattacaatcatgtaattaaaagtattaacccaa

SEQ ID NO: 5235 - DNA, 2965 bp, Homo sapiens
ccttttgctcgaagtcctttaatcgctaaggagctttcccagactcttccctctgcaggcccgctggcctctgacgcatgtcccctctgcggagcgtttgggcactggaggagccctggttggcacaggccgccccgcgttcccagctggggaaggaaggcgggcggccaggcggggggaaagaaagcgggaggtggggcggggtgctgtccgtccccacggcctcgtcgcgcgcggggctttttccaggacttggggacttccggggttgcgctgtcgtgtcaggccgttgggccgccgaggggtgtcgctgcgcccgctgccccgcgcggccctttaaactttgttttttaaacttcgggggtgtggtcgcggcgcctcccctctcggcggctggcagtccttgcctctgccccgccttccagatgctttggagtcatgagccgggagggcgcgggggcagctttggtagccgaggtgatcaaagatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaaaagcagaaaatggagatttaaattggataataccagaccgatttattgccttctgtggacctcattcaagagccagacttgaaagtggttaccaccaacattctcctgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaagaattcctagatatctgtgaaaatgctgagggtgccattgcagtacattgcaaagctggccttggtcgcacgggcactctgatagcctgctacatcatgaagcattacaggatgacagcagccgagaccattgcgtgggtcaggatctgcagacctggctcggtgattgggcctcagcagcagtttttggtgatgaagcaaaccaacctctggctggaaggggactattttcgtcagaagttaaaggggcaggagaatggacaacacagagcagccttctccaaacttctctctggcgttgatgacatttccataaatggggtcgagaatcaagatcagcaagaacccgaaccgtacagtgatgatgacgaaatcaatggagtgacacaaggtgatagacttcgggccttgaaaagcagaagacaatccaaaacaaacgctattcctctcacagtaattcttcaatccagtgttcagagctgtaaaacatctgaacctaacatttctggcagtgcaggcattactaaaagaaccaccagatctgcttcaaggaaaagcagtgttaaaagtctctccatttcaaggactaaaacagtcttgcgttaagtaaaaacctgtgaccagagctgaaggaagactctaggactgaaaactgcaacagaaattagcacaatttgaaaacaaaacaaaattgcaaaagccttagttgctttttccacctaagaagttgatcaatggagaaaatgtccactggagtttgaataatgaactttgagtttgggtgcaagcaaatgactcagagaagggtccagctctcaagctgaatgacaaacatgctgttgtaaatttagtctcaggtgtaaatacccaagccctctggtacccagggagctggctggtctgtggtgcatgtgtgtccctgtgatggcaatcattgtagttgctggccttcagaagaattgaggatctgatggaggttttttatgtatttattttctgttcaccttgtgaccctgtgtcaaaatttataaagatacaaaaggcattactgaaatggtactttctgtaatttgatactatttggcttaatcatcttcacttgactatttgtaatactgttgtaatgttaactctgttaagtacccaagctgcttgtcttccaccaaagagtgctttattaacaagaatctgtgaaaatcacatttaaacactgttgcatgttgtaagaccaggtggtaccttagtaacctaaaacttgcaagagaatattaatggtagctttagaagactcaggaggagaaactgacttcagagttggaagatgttgcaagtcgttcctttttctgtccttcagggactgaagaactgggaggctgcccattgtttggttgccagtcatacaaattaaaatcatatttccttccatgaatggaagaaacacactattggtttttccccttggaaacagcaatcccaaataatgtcggcttacaaaaaaaaaaagttaccacttttttagagtccttccctgtaacattggattttttttttcccttatgagatccacctaaggccattgacgtggcctgcgatctcagtgacaatgatctgcttctggatctcactgttgcctttggttagggaacacaactagtaactctgcagagtgccttctcccgcagccctactggaacacagcagagtctgtgccatgaagcagttacagaaacagaattgatgtgctgct

SEQ ID NO: 5236 - DNA, 1734 bp, Homo sapiens
ctgacgggccgcggccgcctccatgaagcggaaaagcgagcggcggtcgagctgggccgccgcgcccccctgctcgcggcgctgctcgtcgacctcgccgggtgtgaagaagatccgcagctccacgcagcaagacccgcgccgccgggacccccaggacgacgtgtacctggacatcaccgatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaaaagcagaaaatggagatttaaattggataataccagaccgatttattgccttctgtggacctcattcaagagccagacttgaaagtggttaccaccaacattctcctgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaagaattcctagatatctgtgaaaatgctgagggtgccattgcagtacattgcaaagctggccttggtcgcacgggcactctgatagcctgctacatcatgaagcattacaggatgacagcagccgagaccattgcgtgggtcaggatctgcagacctggctcggtgattgggcctcagcagcagtttttggtgatgaagcaaaccaacctctggctggaaggggactattttcgtcagaagttaaaggggcaggagaatggacaacacagagcagccttctccaaacttctctctggcgttgatgacatttccataaatggggtcgagaatcaagatcagcaagaacccgaaccgtacagtgatgatgacgaaatcaatggagtgacacaaggtgatagacttcgggccttgaaaagcagaagacaatccaaaacaaacgctattcctctcacatgtcccctagctgtgctgacctctgcactgtgtagtgttgtcatctggtggattgtttgtgactacattcttcccatcctgctattctgtctcgatggtttcagaacacagtagccatcaggaccccctgacagatagctgcttctctccatttcaaggactaaaacagtcttgcgttaagtaaaaacctgtgaccagagctgaaggaagactctaggactgaaaactgcaacagaaattagcacaatttgaaaacaaaacaaaattgcaaaagccttagttgctttttccacctaagaagttgatcaatggagaaaatgtccactggagtttgaataatgaactttgagtttgggtgcaagcaaatg
